United States Patent 11,098,302 (IDENTIFICATION OF POLYNUCLEOTIDES ASSOCIATED WITH A SAMPLE) - sequence listing, part 68

SEQ ID NO: 233475 - DNA, 541 bp, Homo sapiens
  misc_feature: GYAE6OF01CFMV9.39.86.H09.1.454.CMB.1.raw
  modified_base (305)..(305): a, c, t, g, unknown or other
  misc_feature (305)..(305): n is a, c, g, or t
  modified_base (470)..(470): a, c, t, g, unknown or other
  misc_feature (470)..(470): n is a, c, g, or t
  modified_base (512)..(512): a, c, t, g, unknown or other
  misc_feature (512)..(512): n is a, c, g, or t
  modified_base (514)..(541): a, c, t, g, unknown or other
  misc_feature (514)..(541): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacacgcccccaaactcatcatttatgaggtcagtaatccggccctcgaggggttctaatcgcttctctggctccaagtctggcaaacgaccggccctccctagacctatcctcgtcgggcctccgaggcgtggacggacgaggctgtaatttagttactggctagcctntagtttgactaatcgagtgagtcgtttatgtaccgttaggaggtcgggaacctaaggtcaagtccgtaccgtaggtaccacggaccccaacggaccccaacccgtatccgtacacccgttccgtcccgtaccccgtccctcccgtacgacttaggccgacgtacncgggtaggcccgggtctagggaccgaaggggcccagtaacgngnnnnnnnnnnnnnnnnnnnnnnnnnnnn

SEQ ID NO: 233476 - DNA, 629 bp, Homo sapiens
  misc_feature: GYAE6OF01CYR6L.39.86.H09.1.454.CMB.1.raw
  modified_base (328)..(328): a, c, t, g, unknown or other
  misc_feature (328)..(328): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacgagggtcctcgggcccagtctcgccctgactcgaggctcgcctccgtgtcgtgggtctcgtaggacagtcgatcactactctcctgcacgtacggaacagcgtagtggtacggtttgggggttatggtactagtcgttctacgtaggtaccagacatacgcgagaccacaccgaccccaatcactctatttangacgtacaagtaccgcgtacctaggttacgggttactaacgtcgtacttcgtcgtacgtcctacgtaagtccgtacggaccaaccgtcccggcccctacgtaccgtacctacgtccgtcggtcggacccttaccggaggtcgtagggacggtacgtcggtacgtagtactttacgtacgtacgtacgtacgtcctatagttcgactagtacgagtacgtagtccgttagtcgtacggttacggtaggtcggtaacgtagtacgtacgttaccggtactacggactacccgaaccgtacccg

SEQ ID NO: 233477 - DNA, 594 bp, Homo sapiens
  misc_feature: GYAE6OF01ENGTF.39.86.H09.1.454.CMB.1.raw
  modified_base (304)..(304): a, c, t, g, unknown or other
  misc_feature (304)..(304): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgtacggttgggggttatgactatgtctcctggtaccagcaatatccaggcacacgcccccaaatcatcatttagngagtcagtaactccggccctcgaggggtttactaagtcgtacttctcgtcggcctaccgaagttccgtggacctaacgaccggtccctcccgtacgaccctacgtccgtcgtcgggacctccgaggtcgaggacggacggaggtcgtagtatttacgttactgcgtacgtctactagtttgactaatcgagttcggaaggttactttagtcgttcgttacgggtaaggttacgggaacctaagggtctaacgttccggtacgttacggtccacgaccccggtaaacccgg

SEQ ID NO: 233478 - DNA, 698 bp, Homo sapiens
  misc_feature: GYAE6OF01BDIJF.39.86.H09.1.454.CMB.1.raw
  modified_base (225)..(225): a, c, t, g, unknown or other
  misc_feature (225)..(225): n is a, c, g, or t
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
tcagtcgcactagtcacgaccggtgctcgatttagtgctatagacgttgggtttggggggggtcgtcacggaggcagcgctcctcaggacatctaccacccatggcctgggcttcctgcctgctcctcaccctcgtcacctcagggtctacgagggtcctgggcccagtcctgccctgacctcaggctgcctccgtgtctggtctctagggacagtcgatcaccntcgtccngcactggaaccngcagtgacgttggggtatgacgtatgtacctcgtggtacctgcctaatctccaggtctacgacgccccaaactcactacgtactttatggaggtccagtaacgtcggaccctacgtaggggtttacaagttccgacttcctacgtacggtcctacctaagtcgttacgggaccaaccgaccggtacccttcccgtaggaccctaacgttcctaccggtcggggtacccttacccggacggtacgttcgggaacggttaccgacggtacgttacggtaatttaacggttcgtcgggactacgtccgtacgttacgtttacggtaccgaaacgttcgtacgggtaccgaggttaaccgtttacgtcgggttaacgtttcggggtaacgtacggggttacgtaacgggttcaacggttcccggtacgtaagttccgtaacggtcccctaaacccggg

SEQ ID NO: 233479 - DNA, 255 bp, Homo sapiens
  misc_feature: GYAE6OF01C1NPJ.39.86.H09.1.454.CMB.1.raw
  modified_base (247)..(255): a, c, t, g, unknown or other
  misc_feature (247)..(255): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtctaggtcagcccaaggccaacccatgtcactctcgttccccgccctcctcactagtgcgactgagcgggctggacaaggcgcatagnnnnnnnnn

SEQ ID NO: 233480 - DNA, 665 bp, Homo sapiens
  misc_feature: GYAE6OF01DU90J.39.86.H09.1.454.CMB.1.raw
  modified_base (207)..(207): a, c, t, g, unknown or other
  misc_feature (207)..(207): n is a, c, g, or t
  modified_base (363)..(363): a, c, t, g, unknown or other
  misc_feature (363)..(363): n is a, c, g, or t
  modified_base (576)..(576): a, c, t, g, unknown or other
  misc_feature (576)..(576): n is a, c, g, or t
tcagtcgcactagtcacgaccggtgctcgatttagtgctatagacttggggtttggatggggatggatcagcggcgccaacggtaagacattgtattcagagaacttcccaggacagacgtcctccctcaccagtgacacatccgcgaacacagtctacatggaaatgaggagcctcacatactaaagacacggctactatattacngcgcgagactacggttatgtcctgagactggactaggacggacggtcggtcgttcggttacccaccccgtggggacccaagggaaccctggtccaccggtcctcccacgcctaccaaccgaacgggcccagttccggtccttcccccgtaggcccncccgtgcccgttaccgaacgggacgacctaacccgtccggaagacggcctaacgacggccggcccgtgggacctcgtcccgtaggtaacctaaagggaccttacctttaccgaacgttagggtaccggaccgaacggttcgggaaacgggtccggggtactacgggggacccgaaacggggtacccgtaaccgtaaagttacggcaacgcganacggagacgcgacgagcgagacgtacgacgacgtacgacgacgtacgtacgtacgacgcgacgacgacgtcgacgacgactcgtcgtcg

SEQ ID NO: 233481 - DNA, 468 bp, Homo sapiens
  misc_feature: GYAE6OF01A1WDH.39.86.H09.1.454.CMB.1.raw
  modified_base (368)..(368): a, c, t, g, unknown or other
  misc_feature (368)..(368): n is a, c, g, or t
  modified_base (449)..(468): a, c, t, g, unknown or other
  misc_feature (449)..(468): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacagcccccaaactcatcatttatgaggtcagtaatcggccctcaggggtttctaatcgcttctctggctccaagtctggcaacacggcctccctgaccatctctgggctccaggctgaggacgaggctgattattactgcagctcatttgcaatcagtgaggtcttatgtcttcgggaagtgggaacctaaggtcatcgtcctaggtcagaccccaaggaccccaaccctntgtccacttctaccgttccccgcccttcctcaccgtagtcgcgtactgacgccgggtctacgggcaacggcaccgatacgnnnnnnnnnnnnnnnnnnnn

SEQ ID NO: 233482 - DNA, 621 bp, Homo sapiens
  misc_feature: GYAE6OF01B7MQ3.39.86.H09.1.454.CMB.1.raw
  modified_base (225)..(225): a, c, t, g, unknown or other
  misc_feature (225)..(225): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctcctgcactggaaccngcaggtgacggttgggggttatgactatgtctcctggtaccagcaatactccaggcacacgaccccaactcatactatttatgagtcagtactccggcccttcgaggggtttactagtcgtcttctcgtcgctacagtctggacacgaccgtcctccctcgacctatcctcgtcgggtccctaccgacggtcgtacggacgggacgtacggtctaggttatttaacgttaccgtgacgtacgtccttacgttacgttttacgactaacgttcgtaggttaggtacggttactttacgttcggttaacggttacgggtaagggttacggggtacctaagggttcctacgttccggttaaccggtacggtaccgtaaccggaccccggtaaacccggg

SEQ ID NO: 233483 - DNA, 621 bp, Homo sapiens
  misc_feature: GYAE6OF01A3MPD.39.86.H09.1.454.CMB.1.raw
  modified_base (229)..(229): a, c, t, g, unknown or other
  misc_feature (229)..(229): n is a, c, g, or t
  modified_base (306)..(306): a, c, t, g, unknown or other
  misc_feature (306)..(306): n is a, c, g, or t
  modified_base (312)..(312): a, c, t, g, unknown or other
  misc_feature (312)..(312): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacggttggggtatgactatgtctcctggtaccagcaatctcaggcacacgacccccaaatcatctatttangagtanaagtactccggtcctgtaggggttctaatcgtcttctctggcctacaagtctaggaccaacgccggtccctcctagacctatcctcgtcgggctaccgaggcgtaggacggacggacggtcgtagtaactttacgttactcgtactagtccttactagttttcgacttaacgtcgtagtacggtagttactttacggttggtttaccggttaacgggtaagggtaccgggtaaaccgtaacggttaccgtacggtttcccgtacccggttaacgggtccctaaacccgggtaccccgtaaaaccccggg

SEQ ID NO: 233484 - DNA, 731 bp, Homo sapiens
  misc_feature: GYAE6OF01EEYAL.39.86.H09.1.454.CMB.1.raw
  modified_base (238)..(238): a, c, t, g, unknown or other
  misc_feature (238)..(238): n is a, c, g, or t
tcagtcgcactagtcacgaccggtgctcgatttagtgctatagacttggggtttgggggggggtctcaggaggcagcgctctcaggacatcctccaccatggcctgggctctgctgctcctccaccctcctcactcagggcacgagggtcctgggcccagtctgccctgactcaggctgcctccgtgtcgtgggtctcgtaggacagtcgatcacctatcctcctgcactcggaaccngcaggtggtacggttgggggttatgtactattcgtccttccgtacggtaccagacaatactccgacggaccaaccaccgaacccccctaaaacgtccaacttacctaattttacgaggtaaggttactaaggttacgtcccggtcccgttacggttaacggggtttacctaacgtccgttccttccgtcgtacggtacctaccgtaagttccggtacggaaccaacccggacccgggtcccctacccgtacgaacccttaccgttccgttccgggtacgggtccctaccggacgggtccgtaagggacgggaaccggtaggtacttacgtaactttacgttacgtcgactacgtaccttacgttacgtttacgactaagtccgtaggttacggacgttagtttcgtacggtttaccggttacgggtaggttaccgggtaacgtaacggttctacgttccggtacgtacgggactaccggacccgtaaccccgg

SEQ ID NO: 233485 - DNA, 566 bp, Homo sapiens
  misc_feature: GYAE6OF01EI94J.39.86.H09.1.454.CMB.1.raw
  modified_base (284)..(284): a, c, t, g, unknown or other
  misc_feature (284)..(284): n is a, c, g, or t
  modified_base (367)..(367): a, c, t, g, unknown or other
  misc_feature (367)..(367): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatggactatgtctcctggtaccagcaatatccaggcacncgacccccaaatcatcatttatgagtcagtaatcgccctcgtaggggtttctaatcgcttcgtctggctcaagtctggcaacncggcctccctgaccatctctgggctccgaggctgagggacgaggctgtatttagttactgcagcttactagtttcgactaaatccgaagtgacgggttctttacgtagtttccgttacgggtaagggttacggggaaccaaacgggttctaacgttccggttacccgttaagggtcccacggaccccgtaaaccccggg

SEQ ID NO: 233486 - DNA, 683 bp, Homo sapiens
  misc_feature: GYAE6OF01BUBN9.39.86.H09.1.454.CMB.1.raw
  modified_base (636)..(636): a, c, t, g, unknown or other
  misc_feature (636)..(636): n is a, c, g, or t
tcagtcgcactagtcacgaccggtgctcgatttagtgctatagacttggggtttggggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactcggaaccagcaggtgacggttggggtatgactatgtactccgtgtaccagacatactccaggcacacgacccccaaactcactactatttactgagtactaagtacgtccggtaccctacgttacggggtttactaagttccgtacttctcgtcggtccttaccgtaaacgttccgtacggtacccgaaaccgtaccccgggtcccttaccccgtacgtacccgtaacttccgtccgttacgggtcctaccggacggtccgtaggacgggtacgacgggtcttacggtacttttaacgttaccgtgacctacgtaccttactacgtttcgactaaacgtcgtaaggttcggtaagttaccgtttagttacggttcggttacgggtaagggttaccgggtaaccgaacggttntaccggttctacccggttaggaccgtaccggaccccgtaaaccccgg

SEQ ID NO: 233487 - DNA, 674 bp, Homo sapiens
  misc_feature: GYAE6OF01BJS08.39.86.H09.1.454.CMB.1.raw
  modified_base (224)..(224): a, c, t, g, unknown or other
  misc_feature (224)..(224): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacgttggtcgtcttaataatttatgttcctccgttggttaccaaacgagtcctattccgaggcacggcccgaccccgtaaaacttcgtttaaatttagtggtacggttcctttccggtaccggtcccttacggtacggggttttctaggtccgtcttccgtccggtctaccgaagtcgtggacctaacgccggtccctcccagaccctattcctcgtactaccgtacgaacgtcgtagggacggaacgtcggctagtacttaagtttactcgactacgtcctacgtaatactacgtagtaacgtactagttacggtactaccgtacgtggtaccgttcgggttaccgggaaccgggtaaggggaacccttaagggttcccggtaaaccccgttacggttacggtaccctaacgggtaccccgtaacgggtcccgtacccccggg

SEQ ID NO: 233488 - DNA, 614 bp, Homo sapiens
  misc_feature: GYAE6OF01ERT5Y.39.86.H09.1.454.CMB.1.raw
  modified_base (228)..(228): a, c, t, g, unknown or other
  misc_feature (228)..(228): n is a, c, g, or t
  modified_base (303)..(303): a, c, t, g, unknown or other
  misc_feature (303)..(303): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacggttggggtatgactatgtctctgtaccagcaatatccaggcacacgacccccaaatcatcatttangagtcagtaactccggccctcgtaggggtttactaagtcgtacttctctggtcctaccgaagttcgtacggaccaaccgtaccggtccccttacccgtacgaaccctacttccgtaccgtcgggtccctacccggaaggtccgtaggaacgggaccggtaggtacctaggtaatttacgttacgtgtacagtcttactagtttcgactaactcgtagtggacggttcttagtcgttacggttacgggtaaggtcgggtaaccgtaggtctacgttccgtaccgtacggtccaccggaccccgtaaacccgg

SEQ ID NO: 233489 - DNA, 592 bp, Homo sapiens
  misc_feature: GYAE6OF01BQ0V4.39.86.H09.1.454.CMB.1.raw
  modified_base (307)..(307): a, c, t, g, unknown or other
  misc_feature (307)..(307): n is a, c, g, or t
  modified_base (408)..(408): a, c, t, g, unknown or other
  misc_feature (408)..(408): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtcctcctggtaccagcaatatccaggccacacgcccccaaatcatcatttangagtcaagtactccggcctgtagggtttacaagtcgtcttctcgtggctcaagtcgtgacaacgcgcctccgtcgacctactcttcgtcgggtcctaccgnggtcctaggaacgggacggacgggtccttaggtaacttttacgttaccgtgacgtacgtcttacgtagttttcgacctaagtcgtaggtgtaacgttctttagtcggttacgttacgggtaagggtcgggaaaccctagggtcctacgttcggtacccgttagggcccacggaccccgtaaccg

SEQ ID NO: 233490 - DNA, 531 bp, Homo sapiens
  misc_feature: GYAE6OF01C3BEV.39.86.H09.1.454.CMB.1.raw
  modified_base (244)..(244): a, c, t, g, unknown or other
  misc_feature (244)..(244): n is a, c, g, or t
  modified_base (303)..(303): a, c, t, g, unknown or other
  misc_feature (303)..(303): n is a, c, g, or t
  modified_base (440)..(440): a, c, t, g, unknown or other
  misc_feature (440)..(440): n is a, c, g, or t
  modified_base (460)..(460): a, c, t, g, unknown or other
  misc_feature (460)..(460): n is a, c, g, or t
tcagtcgcactagtcacgaccggtgctcgatttagtgctatagacttggggggggggtctcaggaggcagcgctctcaggacatctccaccatggcctgggctctgctgctcctcaccctcctcactcagggcacagggtcctgggcccagtctgccctgactcaggctgcctcgtgtctgggtctctaggacagtcgatcaccatctcctgcactggaaccagcagtgacggttgggggttangactatgtctcctggtaccagcaatatccaggcacacgcccccaaaatcatcaatttangagtcaagtaatccggccctcgtagggtttactaagtcgtctttctctggcctccaagtctggacaacgcggccctcctgaccatcctcgtgggcctccgaggctaggaggacgaggctgatttattactgcagctntattgactaatcagtgagtnttagtgttacgtacgggtaagtgggaactaaggtctagtccgtacttaggccacggcccgaaggtaccccc

SEQ ID NO: 233491 - DNA, 546 bp, Homo sapiens
  misc_feature: GYAE6OF01CC148.39.86.H09.1.454.CMB.1.raw
  modified_base (310)..(310): a, c, t, g, unknown or other
  misc_feature (310)..(310): n is a, c, g, or t
  modified_base (383)..(383): a, c, t, g, unknown or other
  misc_feature (383)..(383): n is a, c, g, or t
tcagtcgcactagtcacgaccggtgctcgatttagtgctatagacttggggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctctggtaccagcaatatccaggcaacacgacccccaaactcatcatttangagtcagtaatcgccctgtaggggtttctaatcgtcttctctcggctacaagtctggacaacgccgccctccncgaccactctcgtcgggcctccgaggctggaggacgaggtctagtacttattctgcacgtctctatttcgactaatcagtcgagttctagtgttcgttaggaggtacgggacgtaaggtcctacgttccggttaccgtacggtcaccggacccgtaaacccgg

SEQ ID NO: 233492 - DNA, 624 bp, Homo sapiens
  misc_feature: GYAE6OF01BOR22.39.86.H09.1.454.CMB.1.raw
  modified_base (305)..(305): a, c, t, g, unknown or other
  misc_feature (305)..(305): n is a, c, g, or t
  modified_base (345)..(345): a, c, t, g, unknown or other
  misc_feature (345)..(345): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacgagggtcctgggcccagtctgccctgactcaggctgcctccgtgtctggtctcgtaggacagtcgatcaccatctctgcactggaaccagcagtggtacggttggggtatgactatgtctcgtgtaccagcaatactcgagcacaccgaccccaactcatctattngtagtcagtacgtccgccgtgtacggttcaactcgtcttnctcgctacgatcgtacgactacgccgtcctccgtcgactacgtccgtcgttcggtcctaccgacggtcgtacggacgggtacgaggttactagttacgttactttaccgtagcctaacggttccttacgttacgtttacgacgttaagtaccggtaggtacgttacgggttactttacggtccgggtttaacgttaccgggtaagggtacgggtaaaccgtacggtactaagtttccccggtaacgtacggtaccgaacccggtacccgtaaaccccgg

SEQ ID NO: 233493 - DNA, 251 bp, Homo sapiens; identical to SEQ ID NO: 233377
  misc_feature: GYAE6OF01ANLR8.39.86.H09.1.454.CMB.1.raw
  modified_base (246)..(251): a, c, t, g, unknown or other
  misc_feature (246)..(251): n is a, c, g, or t

SEQ ID NO: 233494 - DNA, 647 bp, Homo sapiens
  misc_feature: GYAE6OF01A051M.39.86.H09.1.454.CMB.1.raw
  modified_base (225)..(225): a, c, t, g, unknown or other
  misc_feature (225)..(225): n is a, c, g, or t
  modified_base (316)..(316): a, c, t, g, unknown or other
  misc_feature (316)..(316): n is a, c, g, or t
  modified_base (329)..(329): a, c, t, g, unknown or other
  misc_feature (329)..(329): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcacgtggaaccngacagtgacggttggggtatgactagtcgtacctcgtacggtaccagcaatactaccgaggccaaccacgacccccaaatcatctaattangaggtacagtacnccgcctgtaggtttacagtcncttcnctggcctacgaagtcgtacggacctaaccgaccgtccctaccacggtaccctattaccgtcgtcggtacctacgaggtcgtacggaggtacggacgtcgttagtaacttacgttacgcggtactaacgtccgttactacgtttacgaccttaacgtaccgaggttacggaccggttacctttacggttacggtttacccggttacgggtaacggtacccgggtaccgtaacggttaccgtacgttacccggtaccgttaacggttacccgaaccgtaacccccggaacccgg

SEQ ID NO: 233495 - DNA, 537 bp, Homo sapiens
  misc_feature: GYAE6OF01A8A65.39.86.H09.1.454.CMB.1.raw
  modified_base (302)..(302): a, c, t, g, unknown or other
  misc_feature (302)..(302): n is a, c, g, or t
  modified_base (338)..(338): a, c, t, g, unknown or other
  misc_feature (338)..(338): n is a, c, g, or t
  modified_base (360)..(360): a, c, t, g, unknown or other
  misc_feature (360)..(360): n is a, c, g, or t
  modified_base (387)..(387): a, c, t, g, unknown or other
  misc_feature (387)..(387): n is a, c, g, or t
  modified_base (398)..(398): a, c, t, g, unknown or other
  misc_feature (398)..(398): n is a, c, g, or t
  modified_base (416)..(416): a, c, t, g, unknown or other
  misc_feature (416)..(416): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtggacgttgggggttatgactatgtctcctggtaccagcaatatccaggcacacgcccccaaatcatcatttangaggtcagtaatcgccctcgaggggtttactatcgnttctctgctcaagtctgcaacncggcctcctcacatctcgtggctccgngctgaggacgnggctgtatttattctgcngctctatttgactatcgtagtgacggtcttagtcgttccgttagggaggttacggggaacccgtaagggtcctacgttccggtaccgttagggttccaccggtacccccggtaaacccggg

SEQ ID NO: 233496 - DNA, 668 bp, Homo sapiens
  misc_feature: GYAE6OF01A445N.39.86.H09.1.454.CMB.1.raw
  modified_base (304)..(304): a, c, t, g, unknown or other
  misc_feature (304)..(304): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacgagggtcctgggcccagtctgccctgactcaggctgcctccgtgtctggtctctaggacagtcgatcaccatctcctgcacgtggaaccagcagtgacggttggggttatgactatgtctcctggtaccagcaatactccaggccacacgaccccaaatcatcatttangaggtctaagtaactccggccttcgtaggggtttactaagttccgtactttccgtcgtacggtccttaccgaaggttcccgtagggtacccaaaaccgtcccgggtacccttacccgtacgaccctaacttccgtacgttcgggtcccttaccggacggtcgttacggaacggtaacggaggtccgttaggtaacttttaacgtttaccgtagtaccgtaacgtccgttacgttacgtttacgaacttaacgtcgtaacggtcgtaacggttctttaaacggtcggtttaccgttacgggtaaggtacgggtaaaccgtaacggttactacgtcgtacgtacgtacgccgtaaccgaaaccccg

SEQ ID NO: 233497 - DNA, 460 bp, Homo sapiens
  misc_feature: GYAE6OF01BW0TV.39.86.H09.1.454.CMB.1.raw
  modified_base (422)..(422): a, c, t, g, unknown or other
  misc_feature (422)..(422): n is a, c, g, or t
  modified_base (442)..(460): a, c, t, g, unknown or other
  misc_feature (442)..(460): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacagcccccaaactcatcatttatgaggtcagtaatcggccctcaggggtttctaatcgcttctctggctccaagtctggcaacacggcctccctgaccatctctgggctccaggctgaggacgaggctgaattattactgcagctcatttgacaatcagtgagctttatgtcttcggaagtgggaccaaggtcaagtcgtacctaggtcacgcccaaggccccaacccactcgcctacttcctcgttccccgcccttcctcactagtcgcgactggaggccgggntggaccaaggcactagtagnnnnnnnnnnnnnnnnnnn

SEQ ID NO: 233498 - DNA, 644 bp, Homo sapiens
  misc_feature: GYAE6OF01D6TSV.39.86.H09.1.454.CMB.1.raw
  modified_base (307)..(307): a, c, t, g, unknown or other
  misc_feature (307)..(307): n is a, c, g, or t
  modified_base (458)..(458): a, c, t, g, unknown or other
  misc_feature (458)..(458): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatgactatgtctccgtggtaccagcaatactccaggcacacgaccccctaaatcatctatttagngaggtacagtaatccggtcctgtacggggtttctaacttcgtctttctcgtcggtacctaccgaagttcgtacggacctaaccgacccggtccctacccgtagaaccctagttccgtcgtacggggccctccgacggctacgggaggacgnggtactaggtatttacgtactgacagtcctacttaatttcgaactagtacgtacgttaggtacgttactttacgttcggttaccggtttaacggggtaaggtttaccggggaaacccgttaacgggttctaaccgtttcccgggttaacccgtacgggtaacccaccggaaccccgtaaacccggg

SEQ ID NO: 233499 - DNA, 788 bp, Homo sapiens
  misc_feature: GYAE6OF01E5T98.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcgagggcacgagggtcctgggcccagtctcgccctgactcaggctcgcctccgtgtctgggtctcgtacggacagtcgactccaccatcctcctgcactacggaaccagcgaggtggtacggttggggttatagactagtcgtcctaccgtcgtaaccagtacaatacctccgaacgaccaaccgacccgaacccctaaactctacgttacttaattttacgacggtacgtaccgtaacggttaaccgtcccgggtacccgttacgggtttaacggggttttacctaaccgttccgttacctttaccgtcggtaccggtacccttaaccgtaacgtcccgtacggtaaccctaaaccccggtcccggtacccccttacccggtacgtaaccccctacgttcccgtaccggtcggggtaccctaccgggacgggtcggtaacgggacgggtaccgtacggtacttaacgttacttaacgttacgcgtaacgtacgttccgtactttacgttacgaacgttaacgtaggtacggttaggtacgttacgttttaacggaccggttaacgggttacgggaaggggttacccggtaaaaccggtccgttaaccgtaccgtccggttaacggtacccgaccccgaacccgtaaccccggtaaccccg

SEQ ID NO: 233500 - DNA, 434 bp, Homo sapiens
  misc_feature: GYAE6OF01CCP9Q.39.86.H09.1.454.CMB.1.raw
  modified_base (419)..(434): a, c, t, g, unknown or other
  misc_feature (419)..(434): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacagcccccaaactcatcatttatgaggtcagtaatcggccctcaggggtttctaatcgcttctctggctccaagtctggcaacacggcctccctgaccatctctgggctccaggctgaggacgaggctgattattactgcagctcatttgcaatcagtgaggcttatgtcttcggaagtgggaccaaggtcatcgtctaggtcagcccaaggcccaacccatgcactctcgtccccacctcctcactagtgcgactgaggcgggctggcaaggcgacatagnnnnnnnnnnnnnnnn

SEQ ID NO: 233501 - DNA, 745 bp, Homo sapiens
  misc_feature: GYAE6OF01CRRF1.39.86.H09.1.454.CMB.1.raw
  modified_base (632)..(632): a, c, t, g, unknown or other
  misc_feature (632)..(632): n is a, c, g, or t
  modified_base (648)..(648): a, c, t, g, unknown or other
  misc_feature (648)..(648): n is a, c, g, or t
  modified_base (717)..(717): a, c, t, g, unknown or other
  misc_feature (717)..(717): n is a, c, g, or t
  modified_base (729)..(729): a, c, t, g, unknown or other
  misc_feature (729)..(729): n is a, c, g, or t
  modified_base (737)..(737): a, c, t, g, unknown or other
  misc_feature (737)..(737): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcaggcacgaggtcctcgggcccagtctcgccctgactcaggctcgcctccgtgtcgtgggtctcgtaggacagtcgatcaccatcctcctgacacgtcggaaccagctaggtggtacggttggggtaatgtaacttgtcgtacttccgtaggtaccagactaaactctaccgaggaccaaccgacccgaccccctaaaagtcctaacttccttaattttagtacggtaacggttactaaacggttaaccgtcccgggtacccgttacgggttaacggggttttaacctaaacggttccggtttaccttaccgttccgtaccgggtacctttaccggtaaacggtttctaccgggaacctaacccgtacccggtcccctacccgtccgaaaccttcttccgtccggtccgggtccttaccggtacggcgtaacgggaacgggtaccggtaacgttcgttaagttaactttacgttacgtcgtactacggtacttacgtaaccttanaaccgtaacacgtacnccggtaactacacgtttcggtaggttaccgggtacggtacgggaccgggacggaaccacgtccggtacncccgggttaacnccggtaanaccccggg

SEQ ID NO: 233502 - DNA, 767 bp, Homo sapiens
  misc_feature: GYAE6OF01BYP2O.39.86.H09.1.454.CMB.1.raw
  modified_base (213)..(213): a, c, t, g, unknown or other
  misc_feature (213)..(213): n is a, c, g, or t
  modified_base (225)..(225): a, c, t, g, unknown or other
  misc_feature (225)..(225): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtcgtgggtctctaggacagtcgatcaccatctctncacgtggaaccngcagtgacggttggggtatgactatcgtcctccgtaggtaccagacaatactcaggccacacgacccccaaatcatactatttagagagtacaagtaacgtccgtccgttacgtacggggtttactaacgtccgtacttcgtactcggaccttaccgtaacgttcgtacgggacctaaacccgacccggtcccttacccgtacgtaaccctacgttccgtccgtacgggtccctaccggacgggtaccgtagggaacgggtaacgtacggtacgttacggttaaacgttttaacgttaacgtcggaacgtaccgttaccgttacgttaacgttttacgaaccttaaacgttaccggtaaggttacgggttaaccggttaccgtttttaagtttaccgggtttaaccggtttaaacgggggttaaaccgggttaaccgggggtaaacccgtaaacgggtttaccgtaaaccgggtttaccccggttaacccgggttaaccgggtacccggtaaaccccgggtacccccggtaaaaacccccgg

SEQ ID NO: 233503 - DNA, 790 bp, Homo sapiens
  misc_feature: GYAE6OF01C8DVJ.39.86.H09.1.454.CMB.1.raw
  modified_base (279)..(279): a, c, t, g, unknown or other
  misc_feature (279)..(279): n is a, c, g, or t
  modified_base (308)..(308): a, c, t, g, unknown or other
  misc_feature (308)..(308): n is a, c, g, or t
tcagtcgcactagtcacgaccggtgctcgatttagtgctatagacttggggtttgggggggggtctcaggaggcagcgctctcaggacatctccaccatggcctgggctctgctgctcctcaccctcctcactcagggcacaggtcctgggcccagtctgccctgactcaggctgcctccgtgtctgggtctctaggacagtcgatcaccatcctcctgcactggaaccagcagtggtacggttgggggttatgactatgtctcctggtacagcaatanccaggcacacgaccccaatcatcatttangaggtcagtactcggccctgtagggtttcaagttcgcttctcgtcggtcctaccgtaacgtcgtacgggtaccaaaccgtcccggtccccttcccgtacggtaacccctaacgtttccgttccggttcggggtcccctttacccggaagggtaccgttaggggaacggggtaacggaacgggttacccgttagggtaaacttttttaacgttaaccggtcgtaccgtaaccgggttacctttaccgttaagtttttacggaacccttaaagtttaccggtacggggtttaggaaccgggtttaccgtttacggtttccgggtttaaccggtttaaaccgggggtaaacggggtttaccccgggggtaaaaacccggttaacgggtttaccccggttaaacggtttcccccggggtttaaccggttaacggggtttaaacccccgaccggggtaaacccccccgggtaaaaacccccccgggg

SEQ ID NO: 233504 - DNA, 521 bp, Homo sapiens
  misc_feature: GYAE6OF01A34AP.39.86.H09.1.454.CMB.1.raw
  modified_base (409)..(409): a, c, t, g, unknown or other
  misc_feature (409)..(409): n is a, c, g, or t
  modified_base (445)..(445): a, c, t, g, unknown or other
  misc_feature (445)..(445): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttatgagtcagtaactcggccctcgtaggggtttctaatcgctttctcgtgcctccaagtctggcaaccacggcctccctgaccatctcgtggctccaggctgacggacgngctagattatactgcagtctcatttcgactaacgtnagtgtaggtcttagtgtcgttcgggaaggtgggacctaaggtcagttcgttacctaggtcaccgcccgtaaaccgg

SEQ ID NO: 233505 - DNA, 703 bp, Homo sapiens
  misc_feature: GYAE6OF01AOKMF.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctccgtggtaccagcaatatccaggcacacgacccccaaactcaatctatttatgaggtcagtaacgtcggcccttacgaggggtttactaagtccgtcttcgtctggtctcaaggtctaggaccaacgaccgtcctcccgtacgacctactccgtcgtacggggtcctaccgagggtcctagggaacgggtacggaacgggtcccttaggtaacttttaacgttacgtacggaccgtaacgggtccttaacggttacgttttacgaaccttaaacgttacgtaacgggttacggttaacgggttccttttaaaggttcgggtttaccccggtttaaggggaaaccgggttttaccggggaaacccggttaaaccgggttccttaaccgttcccgggtttaacccgttaaggggtaccccgtacgggtaacccccgtaaacccggg

SEQ ID NO: 233506 - DNA, 253 bp, Homo sapiens
  misc_feature: GYAE6OF01DHW6V.39.86.H09.1.454.CMB.1.raw
  modified_base (248)..(253): a, c, t, g, unknown or other
  misc_feature (248)..(253): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggcccaaccccactgtcactctcgttcccgccctcctcactagtgcgactgagcggctggcaaggcgcatagnnnnnn

SEQ ID NO: 233507 - DNA, 668 bp, Homo sapiens
  misc_feature: GYAE6OF01BI3RW.39.86.H09.1.454.CMB.1.raw
  modified_base (308)..(308): a, c, t, g, unknown or other
  misc_feature (308)..(308): n is a, c, g, or t
  modified_base (384)..(384): a, c, t, g, unknown or other
  misc_feature (384)..(384): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggtatgactatgtctcctggtaccaacaaccaccccggacaaacgcccccgaagtcatgtatttangacgtcactaagtccgccctcgagggtctactaactcgtcttctcgtgctactagtctggcaacgcggcctccgtnaccatctcgtcgggcctcgacggtctaggaggacgaggtctagtaatttactacgtcgactacggtccttacgtagtttacggactaaacgttcgtaacggttaggtaacggttactttaagttcggtttaccgtttaaccggggtaaacgggttacggggtaacccgttaaagggttacccgttaaccggtttacccgggttaaccccggtttaacgggtacccgtaacccgggtaaccccccgtaaacggggaaccccccctaaacccccggttaaacccgg

SEQ ID NO: 233508 - DNA, 590 bp, Homo sapiens
  misc_feature: GYAE6OF01D4I6V.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctctcggtaccagacaatatccaggcaacacgccccaaaactcatactattaatgagtcaagtatcgaccctgtacgggttctaatcgtcttcgtcgtggtactccgaagtccgtaggaccaaacgacggtaccctccctagacctatctcgtacgggctccgaaggctaggacggacggtaagctgaactttagtttaccagtcaagtcctatacgttagactaaactgagttcgaggtacttatcgttaccgttacgggtaaggtcgggtaactaacgggtcgtaacgttccggttaccgttacggttaccaccggtaaccccgaaaacccgg

SEQ ID NO: 233509 - DNA, 871 bp, Homo sapiens
  misc_feature: GYAE6OF01EVU6F.39.86.H09.1.454.CMB.1.raw
  modified_base (163)..(163): a, c, t, g, unknown or other
  misc_feature (163)..(163): n is a, c, g, or t
tcagtcgcactagtcacgaccggtgctcgatttagtgctatagacttgggttgggggtctcaggaggcagcgcctactcaggtacatctcctaccatcggcctggggctctgcttgctcctcacctctcgactcgagggcacgagggtcctgggccctagtcncgccctggactcgaggctggcctcgtgtcgtggtctcgtaggactagtcgattccaccattcctaccgtgacctacgtacgaaccgagcgtaggtcggtacgttggtacgttacttaattagtactcgtcctccgtggttaccaacgcgtcgtacttacgacggtccgaccggacccgtaccccgtaaacttcgtttaaagttacgcgggttacgttttcggttccgtaccgggttcccgttacgggttacggggtttaccgtacgttccggtacgttttcccgacccgggtaccttaaccggtaacgttcgtacggtaaccaaaccggtcccggtcccctacctacgaacccttagttaccaccgttaacgacctaccgggtaggtaccctcgggggaaacgggaccttacgggacgttaacggttaacttacgtttacggtaccgaacgttaccggtacgtaacttaaagtaaccgttaaccgggtagtaaacggtttacctaaagggttttaccgggtaacccttccgggtaccgggtttacgggttcccggggttaaccgggttacccgggggggaacggttaacccgggttaaaaccggtttacccggggttacccccggggggttaccttaaacccgggtttcggtaaaacccgggtacccgttaacccccgggtacgggttaccccgttaacccccccggg

SEQ ID NO: 233510 - DNA, 538 bp, Homo sapiens
  misc_feature: GYAE6OF01D03F0.39.86.H09.1.454.CMB.1.raw
  modified_base (244)..(244): a, c, t, g, unknown or other
  misc_feature (244)..(244): n is a, c, g, or t
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
  modified_base (301)..(301): a, c, t, g, unknown or other
  misc_feature (301)..(301): n is a, c, g, or t
  modified_base (311)..(311): a, c, t, g, unknown or other
  misc_feature (311)..(311): n is a, c, g, or t
  modified_base (333)..(334): a, c, t, g, unknown or other
  misc_feature (333)..(334): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttacngactatgtctccnggtaccagcaatntccaggcacgacgccccaaatcatcatttangagtcagtancgcctgagggttcatcgcttcnnggctcagtcngcaacncgcctcctgaccatctctcgggcctccgaggctggaggacgaggctgtatttatactgcagtcctatatttgctaatcgaaggtcgtaaggtcttaagtcgttacgttcgggaacggttgggaaccttaacgggtctaacgttcccgttaccgttaacggtccaaacggccccgaaacggaacccccc

SEQ ID NO: 233511 - DNA, 678 bp, Homo sapiens
  misc_feature: GYAE6OF01ELMMI.39.86.H09.1.454.CMB.1.raw
  modified_base (320)..(320): a, c, t, g, unknown or other
  misc_feature (320)..(320): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctggtctctaggacagtcgatcaccatctcctgcactacggaaccagcagtggtacggttggggttatgactatcgtctcctgtaccagacaatactaccgaggcaccaccgaccccctaaactctactcctattttacgngtagtactaagttaacgtccggtacccttacggtagggtttactaacgtcgtcttccgtcgtcggtacctaccgtaacgtcgtacggaccaaaccgtcccggtaccccttacccgtacgaccctacgttccgtaccgtcggggtccctaccggacggtcgtacggaacggtacggacggtcttagtactttacgttacgcgcgtacttcgttactacgtttacgacttaacgtagtacggttaggtaccgttagtttacgttcggtttcggttaacggggtaaggtaccggggtaactaacggttcctacgttcccgggtacgtaccggtaacccgacccggtacccgtaaaccccgg

SEQ ID NO: 233512 - DNA, 573 bp, Homo sapiens
  misc_feature: GYAE6OF01AGHUF.39.86.H09.1.454.CMB.1.raw
  modified_base (303)..(303): a, c, t, g, unknown or other
  misc_feature (303)..(303): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatatccaggcacacgcccccaaactcatcatttangagtcagtaatcggccctcgtaggggtttctaagtcgtcttctctggcctcaagtctggacaacgacggccctccctagacccacttcctcgtcggggtccctccgagggtccgtggacgggacggaggtcctaggtatttacttacgtcgctagtcctctagttttcgactaatcgtagtcggtaggtctttagtcgttcgttacgggtaaggttacgggaacctaagggtcacgttccgtaccgtaggtccacgccccgtaaacccgg

SEQ ID NO: 233513 - DNA, 562 bp, Homo sapiens
  misc_feature: GYAE6OF01EVZ5D.39.86.H09.1.454.CMB.1.raw
  modified_base (300)..(300): a, c, t, g, unknown or other
  misc_feature (300)..(300): n is a, c, g, or t
  modified_base (429)..(429): a, c, t, g, unknown or other
  misc_feature (429)..(429): n is a, c, g, or t
  modified_base (476)..(476): a, c, t, g, unknown or other
  misc_feature (476)..(476): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacacgccccaaatcatcatttangagtcagtaatcggcctcgagggtttcaatcgcttctctggctccgaagtctggacaacgacggtcctccctgaccctatctcgtgggcctccgaggctaggacggacgacggctgtaatttacttacngacagtctacgtatttgacctaagtcgaggttaggaggtactttagngtttacgttacgggaaggttccgggaacctaacgggttccacgttaccggtaccgttaaggtccgaacggtaccccgtaaacccgg

SEQ ID NO: 233514 - DNA, 693 bp, Homo sapiens
  misc_feature: GYAE6OF01CTOP1.39.86.H09.1.454.CMB.1.raw
  modified_base (229)..(229): a, c, t, g, unknown or other
  misc_feature (229)..(229): n is a, c, g, or t
  modified_base (340)..(340): a, c, t, g, unknown or other
  misc_feature (340)..(340): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacgagggtcctgggcccagtctgccctgactcaggctgcctcgtgtctgggtctcgtaggacagtcgatcaccatcctcctgcacgtacggaaccngctaggtcggtacgggttttgggggttatggtacttagtcgttctccgtggtaaccagtacaatactaccgaggccaacgaccgacccccaaatcacttactacttttagnggagtacaagttacgtcccggtcccttaggttacgggttactaagttccgttcttcgttcgtcggtaccttaccgtaggttcctacgggaacctaaccgtcccggtcccctacccgtacgaccgttactcccgtacggtccgggtcctacccggtaggtaccgtgggaacggtacgggacggtcgttaaggttaacttttacgtacgtccgacgtaccgtcttacgttagttacgacgtaattcggtagtcgggacttcgttacgttcggttacggtacgggaagggttaccgtacgttacgggtacctacggtttcgtaacccgtaggtccaaccgtacccggtaaaccccg

SEQ ID NO: 233515 - DNA, 630 bp, Homo sapiens
  misc_feature: GYAE6OF01ES2HV.39.86.H09.1.454.CMB.1.raw
  modified_base (303)..(303): a, c, t, g, unknown or other
  misc_feature (303)..(303): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctggcccagtctgccctgactcaggctgcctccgtgtctgggtctctaggacagtcgatcaccatcctcctgcactggaaccagcagtgtacggttggggttatgactatgtctcctggtaccagcaatatccaggtcacacgaccccaatcatctatttangtagtactagtaactccggacctgtacggggtttactaagtccgcttacgtcgtggccttaccgaaggttcctaggtaccaaccgtaccggtccctacccgtcgaccctagtcctacgtcggctaccgtaggcgtacggacggtacggacgtcgtagtaatttacttaactcgacgtaacgtcttaccgtattttacgactaacgttcgtaacggttgacggttactttagtcggtttaccggtaggtaacggttcgggtaaaccgaggttacctaaccggtttcgtaccgttaacggggtctaacccggtcccgtaaaaccccggg

SEQ ID NO: 233516 - DNA, 755 bp, Homo sapiens
  misc_feature: GYAE6OF01DFSO8.39.86.H09.1.454.CMB.1.raw
tcagtcgcactagtcacgaccggtgctcgatttagtgctatagacttggggtttgggggggggtctcaggaggcagcgctctcaggacatctccaccatggcctgggctctgctgctcctccaccctcctcactcgagggcacgacgggtccgtcgggcccagtctcgccctgactcgaggctcgcctccgtgtcgtggtctcgtaggacagtcgactccacctattcctcctcgacctacgtacggaaccagacgtaggttgggtacgggtttaggggttatcgtacttgttcgtcctccgtcggtaccagtactaatactaccgacggaccaccgaccgaacccctaaactctacttacttatttagtaggtacgtacgtaacgtaccgtccggtaccgttacggttacgggtttactacgttcgtcttcgtcgtcgtacctacgtacgtcgtacggacaaccgtcccgtccctcctacgtacctactcgtcgtcggtccgtaccgtacggtacggtacgggacgggtacggtacggtacgttagttagtttacgttacgtcgtacgtacgtacttacgttacgttacgtactaacgtacgtacggtacggtacgttacgttacgttacggttacggttacgggtaacgggtacgggtaacggtaacggttacgtccgttaaaaaaaaaaaaaaaaaaaaaaaaaaaaaaaccgttccggtaaccggtaccggtacccggacccggtaacccg

SEQ ID NO: 233517 - DNA, 776 bp, Homo sapiens
  misc_feature: GYAE6OF01A5LNN.39.86.H09.1.454.CMB.1.raw
tcagtcgcactagtcacgaccggtgctcgatttagtgctatagacttgggtttggggggggtctcaggaggcagcgctcgtcaggacatctccaccatggcctgggctctgcttgctcctcaccctcctcactcagggcacagggtccgtgggcccagtctgccctgactcaggctgcctccgtgtctgggtctcgtaggacagtcgatcaccatctcctgcactcggaaccagctagtgtacggttgggggttatagactaatgttactccgtggtaccagactaatactaccgaggaccaccgaccgaccccctaaaactccaattccattttaagtcggaggtactagtaacgtccgggacccttacggtacggggtttactaacgtcgtacttccgtcgtcgggtcctaccgtaacggtccgtaggacctaaaccgtacccgggtccccttacccgtacggtaacccttacgttccgttccggttcgggggtaccctacccgtagggtccgttaacgggaacggggtaaccgggtacggtcccgttaggtaacttttaacgtttaaccgtcgggtacctaacggtaccttacttaacgttttacgtaaccttaaacgttcccggtaaggttaccggtacggttaccgttacggttacggttaccgggtttaacggggtaagggttaacggggtaacccgtaaacgggttaccgtacggtttcccggttaccggttaaccggtccggtaacccggtaccccgtaaaccccggg

SEQ ID NO: 233518 - DNA, 588 bp, Homo sapiens
  misc_feature: GYAE6OF01BH75I.39.86.H09.1.454.CMB.1.raw
  modified_base (210)..(210): a, c, t, g, unknown or other
  misc_feature (210)..(210): n is a, c, g, or t
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
  modified_base (253)..(253): a, c, t, g, unknown or other
  misc_feature (253)..(253): n is a, c, g, or t
  modified_base (404)..(404): a, c, t, g, unknown or other
  misc_feature (404)..(404): n is a, c, g, or t
tcagtcgcactagtcacgaccggtgctcgatttagtgctatagacttggggtttggggggggtctcaggaggcagcgctctcaggacatctccaccatggcctgggctctgctgctcctcaccctcctcactcagggcacagggtcctgggcccagtctggcctgacacagcctgcctccgtgtctgagctcctggacagtcgatcaccntctctgcactggaaccngcagtgacgttggtntcttatattantctctggtaccagactaagtactcaggcaccacgaccccaactcactctatttagtgacgtactagtaacgtccgtacctcggtagggtttctaatccgtcttctcgtcgtcctacgagtcagacacctaccggtccctccgtacgacctntcgtcgtcggcctacgcgcgtaggacgacgtacggtactagtattacgtacgtgacgtacgtcgttactagtttacgactactacgtagtcggtagttacgttagttcggttacggttaacgggtaacggttcgggaaaccgtaaggttcaacggtttcggtaccgttaggtccgtaaacccgg

SEQ ID NO: 233519 - DNA, 599 bp, Homo sapiens
  misc_feature: GYAE6OF01CH31D.39.86.H09.1.454.CMB.1.raw
  modified_base (310)..(310): a, c, t, g, unknown or other
  misc_feature (310)..(310): n is a, c, g, or t
  modified_base (447)..(447): a, c, t, g, unknown or other
  misc_feature (447)..(447): n is a, c, g, or t
  modified_base (506)..(506): a, c, t, g, unknown or other
  misc_feature (506)..(506): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtggacggttgggggtatggactatcgtctccgtggtaccagcaatactccaggcacaccgaccccaactcactctatttagngtagtcaagtactccggccctagtacggggtttctaagtcgtcttctcgtggtacctcgtaagtctaggaccaaccgccggccctccctagaccctattcctcggtcgggccttccgaggtccgtggacggtacggnggtctagtatttactcgtgtacagtctactagtttcgactaattcgagttaggacgttnttaagttcggttacgttacgggtaaggttacgggaaacccttagggtacttacgttccgtaaccgtacggaccaccggacccgtaaaccccgg

SEQ ID NO: 233520 - DNA, 752 bp, Homo sapiens
  misc_feature: GYAE6OF01B94XV.39.86.H09.1.454.CMB.1.raw
tcagtcgcactagtcacgaccggtgctcgatttagtgctatagacttggggtttgggggggggtctcaggaggcagcgctctcaggacatctccaccatggcctgggctctgctgctcctcaccctcctcactcagggcacgagggtcctgggcccagtctgccctgactcaggctgcctcgtgtctgggtctctaggacagtcgactcacatcctcctgcactaggaaccagctaggtcggtacggtttagggggttatggtacttagttcgtcctccgttacggtaaccagactaaatactaccgacggcaaccaccgaaccccctaaactcatactatttactaggtagtacaagttaacgccggtaccctacggtacggggtttactaacgtcgttacctcttcgtacggtcctaccgtaagtccgtacggacgaaccgacccggtccctaccgtacgtaccctactccgtcggtacgggtccctaccggacggtacgtacgggaacggtaacggtacggtacgttaacgttaacgttttaacgtttaccgtacggtacgtacgtccgttacgttagtttacgaaccttaagtaccgtaggtacggtaacggtttactttaacgggttacgttaccggttaacggggttaacgggttaccggggtaaacccttaacgggtaccgttaacgggttacccggttacggtaaccggttaacccgaacccggtaccccgtaaaacccccggg

SEQ ID NO: 233521 - DNA, 664 bp, Homo sapiens
  misc_feature: GYAE6OF01BNIO5.39.86.H09.1.454.CMB.1.raw
  modified_base (229)..(229): a, c, t, g, unknown or other
  misc_feature (229)..(229): n is a, c, g, or t
  modified_base (282)..(282): a, c, t, g, unknown or other
  misc_feature (282)..(282): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtggacggttgggggttatgactatcgtctccgtggtaccagacaatacnccaggccacaccgacccccaaactcatctatttagtgagtcaagtactccggtacctcgtaggggtttactaagtcgtcttctcgtcgtcctacaagtcgtacgaccaaccgaccggtcctaccgtcacctactccgtcgtcggacctccgacggtcgtacggacggacggacggtcgttagtacgtttaacttacgttcgacgtagtccgttacttaacgtttacgaacttaacgtcggtaggttacggtacggttacgtttagttaccgggtttacggttaaccggggtaagggttaccgggtaaccggttaacgggtacgtaaccggttccggttaaccggttacgggtacccgaacccggtaccccgtaaaccccggg

SEQ ID NO: 233522 - DNA, 584 bp, Homo sapiens
  misc_feature: GYAE6OF01EEU5M.39.86.H09.1.454.CMB.1.raw
  modified_base (304)..(304): a, c, t, g, unknown or other
  misc_feature (304)..(304): n is a, c, g, or t
  modified_base (441)..(441): a, c, t, g, unknown or other
  misc_feature (441)..(441): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatatccaggcacacgacccccaaatccatcatttangagtcagtaactcggcctgtagggttctaagtcgtcttctctggctccgaagtctggaccaacgaccgtcctacccgtgtaccctatcctcgtcgggcctccaggtctggaggacggaggtctagtatttacttacncgagtacgtcttacgtagtttcgactaagtctacggtagtacggtactttagtacggtttacggttaccgggtaaggttcgggaaacctaacgggttcctaacgttccggttaccgtaagggtccaccggcccgtaaacccgg

SEQ ID NO: 233523 - DNA, 674 bp, Homo sapiens
  misc_feature: GYAE6OF01DAI7N.39.86.H09.1.454.CMB.1.raw
  modified_base (335)..(335): a, c, t, g, unknown or other
  misc_feature (335)..(335): n is a, c, g, or t
  modified_base (473)..(473): a, c, t, g, unknown or other
  misc_feature (473)..(473): n is a, c, g, or t
  modified_base (517)..(517): a, c, t, g, unknown or other
  misc_feature (517)..(517): n is a, c, g, or t
tcagtcgcactagtcacgaccggtgctcgatttagtgctatagacttgggctggggtctcaggaggcagcgctctcaggacatctccaccatggcctgggctctgctgctcctcaccctctcactcagggcacgagggtcctgggcccagtctcgccctgactcgaggctgcctcgtgtcgtgggtctcgtaggcagtcgatcacctatcctcgtcacaaccgtaggaaccagcgtaggtggtacgggtttggggtataggtactagtcgtctcgtaggtaccagactaatactcgaggacactaaccgaccccctaaatcaagtactaatttanggagtacgtaagtaacgcccggtacccgttaggtaacgggttacttaacgtccggtcttcgtccgtcggtaccacgtaaggtccgtacggacctaaaccgccggtccctaccgtcgacctatcgtcgtcggcctacgnggtacgtaggacggtagacggtctaagtatttaacgtacacgtntaccggattccggttattacgacttaacgtggtaaagtcggtaagttacgtttacggtcggttacggttaaccggggaaggttaccggggaaaccgttaaacggttcgtaaaccggttacgttaccggtaccgttacggaacccgggtaaaccccgg

SEQ ID NO: 233524 - DNA, 606 bp, Homo sapiens
  misc_feature: GYAE6OF01CNNTK.39.86.H09.1.454.CMB.1.raw
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatatccaggcacacgacccccaaatcatctattatgagtcagtaactccggcctacgtaggggtttactaagtcgtcttctcgtggcctactaacgtctggaccaacgaccgcccttcccgtacgacctactccgtcgtcgggtccctccgaacggtctagggaggacggacggtactagttaactttaattactcgtcgaacgtccttactagtttacgacaaactttcggagtaggtaacggttacttagttgtaccggttaggtaacggacgggtaaccgaacgggtctaacgttccggtacgttaggacctaccggtacccgaaaccgg

SEQ ID NO: 233525 - DNA, 676 bp, Homo sapiens
  misc_feature: GYAE6OF01ETW57.39.86.H09.1.454.CMB.1.raw
  modified_base (93)..(93): a, c, t, g, unknown or other
  misc_feature (93)..(93): n is a, c, g, or t
  modified_base (220)..(220): a, c, t, g, unknown or other
  misc_feature (220)..(220): n is a, c, g, or t
  modified_base (231)..(231): a, c, t, g, unknown or other
  misc_feature (231)..(231): n is a, c, g, or t
  modified_base (447)..(447): a, c, t, g, unknown or other
  misc_feature (447)..(447): n is a, c, g, or t
  modified_base (530)..(530): a, c, t, g, unknown or other
  misc_feature (530)..(530): n is a, c, g, or t
tcagtcgcactagtcacgaccggtgctcgatttagtgctatagacttgggtttgggggctggggtctcaggaggcagcgctctcaggacatcnccaccatggcctgggctctgctgctcctcaccctcctcactcagggcacagggtcctgggcccagtctgccctgactcaggctgcctcgtgtctgggtctctaggcagtcgatcaccatctctgacnctacggaaccngctaggtgtacggttgggtaatgactactgtcctacgtaggaaccagtacccttaacaaccctaggaccaactgacggtacccccaaacatttcaagttacgtagttttacgacgacgtaacggtttactaacgggttacctccggtaccgtttacggttaacggtttacctacgttcctaccgttacgtccgtaccggtacctaccgtaccggtnaccctaaccgtaccggtacccgtacccggtaccgtaccccgtacggtacccgtaccgttacgggtaccgtaccggtacggtancggtacggtacggtacggtacggtacgtacgtaacttacgtacgttacgtacttacgtactacgtacgttacgtacttacgtacgtacgtcgtaggtacggtacgttcgtacgttacggtacgtacggacgtacggtcgtacgtcg

SEQ ID NO: 233526 - DNA, 566 bp, Homo sapiens
  misc_feature: GYAE6OF01B6XZK.39.86.H09.1.454.CMB.1.raw
  modified_base (310)..(310): a, c, t, g, unknown or other
  misc_feature (310)..(310): n is a, c, g, or t
  modified_base (422)..(422): a, c, t, g, unknown or other
  misc_feature (422)..(422): n is a, c, g, or t
tcagtcgcactagtcacgaccggtgctcgatttagtgctatagacttgggtttgggggtctcaggaggcagcgctctcagaacatctccaccatggcctgggctctgctgctcctcaccctcctcactcagggcacagggtcctgggcccagtctgccctgactcaggctgcctccgtgtctgggtctctaggacagtcgatcaccatctctgcactggaacagcagtgacgttggggtatgactatgtctctggtaccagcaatatccaggccacacgccccaaactcatcatttatcgagtcagtaancgacctcgtaggttctaagcgtcttctctggcctctaacgtctacggactaacgacgcctcctcgacctatctctgggctcgagctggagacgtaggctgattattacagtnagtctctatttcgactaattacgagtacggaggtctttacgttaggtcgttaacgggtaagggtttacgggaaacccgttaagggtacctacgtttacccgtaccgttaacgggtacctaaccgggaaccccctaaacccgggg

SEQ ID NO: 233527 - DNA, 657 bp, Homo sapiens
  misc_feature: GYAE6OF01BCVPI.39.86.H09.1.454.CMB.1.raw
  modified_base (232)..(232): a, c, t, g, unknown or other
  misc_feature (232)..(232): n is a, c, g, or t
  modified_base (286)..(286): a, c, t, g, unknown or other
  misc_feature (286)..(286): n is a, c, g, or t
  modified_base (321)..(321): a, c, t, g, unknown or other
  misc_feature (321)..(321): n is a, c, g, or t
tcagtcgcactagtcacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcaggctgcctcgtgtctgggtctcgtaggacagtcgatcaccatcctctgcacgtggaaccngcagtggtacggttggggttatgactatcgtcctcgtcggtaccagacaatacnccgagccaccaccgacccccaatcatactattagngagtcagtacgtccgtcctacgtagggttactacgtcgtcttcgtcgtcgtctaccgtacgttcgtacggtaccgaaccgccggtccctcccgtacgtaccctacttccgttacccggtcggtcctaccggtcgggtacgtagggaacgggacgtcggtacttacggtaacttttagttaccgtaggtccgtagttacccttacgttaagtttcaaccttaacgttacggtaggttaggtacggtttactttaacggttcgttacggttaccgggtaaggtaccgggtaacgtaacggttacacggttacccgtacggtacggtcccgtaacccgg

SEQ ID NO: 233528 - DNA, 765 bp, Homo sapiens
  misc_feature: GYAE6OF01C7G5T.39.86.H09.1.454.CMB.1.raw
  modified_base (230)..(230): a, c, t, g, unknown or other
  misc_feature (230)..(230): n is a, c, g, or t
tcagtcgcactagtcacgaccggtgctcgatttagtgctatagacttgggggggggttctcaggaggcagcgctctcaggacatctccaccatggcctgggctctgctgctcctcaccctcctcactcagggcacagggtcctgggcccagtctgccctgactcaggctgcctccgtgtctgggtctcgtaggactagtcgatcaccatcctcctgacacgtcggaaccngcaggtgtacggtttggggtatgactatgtctacgtcggtacagacaatactcgaaggcaaccaaccgaccccctaaaactcctaacttacctaagttttacgtacggtaacggttactaaacgttaacgtcccggtacccgttacggtaacggggttttactaaaccgttccggttcctttccgttcggttacggtaccgttaaccgtaaagttccggtacggtacccaaccggtaccccgtcccttacccgtacgtaaccctacgttccgtaccggtacggtcccgtaccgtacggtccgtaacgggaacgggtaccgtacggtactaacgtttaacgtttaaccgttacgtacggtacctacggttacttaccgttagtttaaccgaacttacgtacggttaagtagggttacgttacgttagttaccgggttacgtaacgggtaacgggttaccggaacgtaccggtttacgtacgtttacccggtaccggttaacgacccgtaaccggaaccccgtaacggtaacccccg

SEQ ID NO: 233529 - DNA, 473 bp, Homo sapiens
  misc_feature: GYAE6OF01C1U2L.39.86.H09.1.454.CMB.1.raw
  modified_base (128)..(128): a, c, t, g, unknown or other
  misc_feature (128)..(128): n is a, c, g, or t
  modified_base (346)..(346): a, c, t, g, unknown or other
  misc_feature (346)..(346): n is a, c, g, or t
  modified_base (448)..(448): a, c, t, g, unknown or other
  misc_feature (448)..(448): n is a, c, g, or t
  modified_base (454)..(473): a, c, t, g, unknown or other
  misc_feature (454)..(473): n is a, c, g, or t
tcagtcgcactagtcacgaccggtgctcgatttagtgctatagacttggccttgagtggatgggatggatcagcggcgccaacggtaagacattgtattcagagaacttccaggacagagtctccctnaccagtgacacatccgcgaacacagtctacatggaaaatggaggagcctcaacatactaaagacaacggctctatattactgcgcgagacacggttatgtcctgagactggctgcgacggcggctcggttccacccgtgggggcccacgggaaccctggtaccaccgtcgtcccccagccctccaccgaacggcccatccggtcctccccctggcccnccctgcctccgagacgccacctccgagacgcaacacgccggccctgggcctggccctggacaacgactactccactagtgcgactgaggcggctggcaggcncatagnnnnnnnnnnnnnnnnnnnn

SEQ ID NO: 233530 - DNA, 526 bp, Homo sapiens
  misc_feature: GYAE6OF01EIOJB.39.86.H09.1.454.CMB.1.raw
  modified_base (225)..(225): a, c, t, g, unknown or other
  misc_feature (225)..(225): n is a, c, g, or t
  modified_base (302)..(302): a, c, t, g, unknown or other
  misc_feature (302)..(302): n is a, c, g, or t
  modified_base (365)..(365): a, c, t, g, unknown or other
  misc_feature (365)..(365): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacgttggggttatgactatgtctcctggtaccagcaatatcaggccacacgcccccaaatcatctatttangagtacagtaactcggccctcgtaggggtttcaagtcgcttctctgctccaagtctggcaacncggccctccgtgaccatctcgtgggcctcgagtctggaggacgagctagtattattactgcagtctctatttgactaatcgagtgagtcttaatgtcgttacgggaggtcggaaccgtaaggtcacgttccgtacgtaggtccaccggcccgtaaacccgg

SEQ ID NO: 233531 - DNA, 726 bp, Homo sapiens
  misc_feature: GYAE6OF01BR25K.39.86.H09.1.454.CMB.1.raw
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctggcccagtctgccctgactcaggctgcctccgtgtcgtgggtctctaggacagtcgatcaccatcctcctgcactcggaaccagcaggtgtacggtttgggggttatggtactatcgtctccgtggtaccagacaatactccaggccacaccgacccccaaatcaatctatttataggagtacaaggtaacgtccggtacccttacggtacggggttttactaacgttcgtccctttcgttcgtcgtaccctacgaacgttccgtacgggaaccaacccggtacccggtcccttaccccgtagacccttaactcccgttccgggtcgggtcccctaccgacgggtccgtaacgggacggggtaaccggacggttacgttacggttaaacttttactttaacggtccggactaccggttcttacgttacgtttacttaacctaacggttagtaacggttcggtaacggtttctttaggttccggtttacggtaacgggtaacgggtaccggtaacggttaaccgtacgtaccggttcgttacccgtacggttaccacccgggaacccgtaaaccccggg

SEQ ID NO: 233532 - DNA, 252 bp, Homo sapiens
  misc_feature: GYAE6OF01CAMSJ.39.86.H09.1.454.CMB.1.raw
  modified_base (242)..(242): a, c, t, g, unknown or other
  misc_feature (242)..(242): n is a, c, g, or t
  modified_base (246)..(252): a, c, t, g, unknown or other
  misc_feature (246)..(252): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggcccaaccccatgtcactctcgttcccaccctcctcactagtcgcgactgagcggctggcaaggcnatgnnnnnnn

SEQ ID NO: 233533 - DNA, 831 bp, Homo sapiens
  misc_feature: GYAE6OF01BV9CH.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcgagggcacgagggtcctgggcccagtctgccctgactcaggctcgcctcgtgtcgtgggtctcgtaggacagtcgatccactactcctcctgctacgtacggaaccagctaaggtggtacggtttagggggttataggtaacttgtcgttcctccgttacggtaaccagtaactaatacgtaccgaggaccaacctaacccgaaccccctaaaactcctacttaaccttaattttacgtaggtaacggttaacctaagggttaaaccgtccggtaccccgtttagggttaaccggggttttaaccttaagttcccgttcctttcgtccgttacggtaccttaccgaacgttccgtacggacccgtaaacccgtcccggtaccctccccgtaagacccttagttcccgttaccggtacgggtccccttaacgggaccgtacggtacgggaacgggtaacggtcggtaactacgtttaagtttaccgttcgtacggtactaacggttccttacgttaacgtttaccgaacttaacgaccggttaggtaccggttaaggttacccttttaggttacccgggttacgtttaaaccgggggtaaacggttacggggtaaacccgttaggggttaaaccctaccgggttacccgttaacccgggttaaccgggtacccgaaacccgggtacccccgtaaaacccccggg

SEQ ID NO: 233534 - DNA, 665 bp, Homo sapiens
  misc_feature: GYAE6OF01CYS4Q.39.86.H09.1.454.CMB.1.raw
  modified_base (340)..(340): a, c, t, g, unknown or other
  misc_feature (340)..(340): n is a, c, g, or t
  modified_base (422)..(422): a, c, t, g, unknown or other
  misc_feature (422)..(422): n is a, c, g, or t
tcagtcgcactagtcacgaccggtgctcgatttagtgctatagacttgggtttgggggctggggtctcagggaggcagcgctctcaggacatctccaccatggcctgggctctgctgctcctcaccctcctcactcagggcacgagggtcctgggcccagtctcgccctgactcaggctgcctccgtgtctgggtctcgtaggacagtcgatcacctatcctcctgcacgtggaaccagctagtggacggttgggggttatgactatgtcctccgtaggtaccagacaatactccgaggccacaccgacccccaaatcattctattatgagtcaagtacncggtacctgtagggttactaactcgtcttctcgtcggtctaccgtaagtccgtcggaacaaccgtccggtaccccttaccgngtaaccctacgttctccggtcggtccttaacccggaggtccgtagggaacgggtaccgagggtcttacggtaacttttagtacgtcgtacgtacgtcttcgtatttacgacttacgtgtaagggttacgacggttactttaggttcggtttacggttaacgggtaacgggttaccgggtaaaccgtaacgggttacccgttaacggttccccggttaaacgtacgggtacccggtaaacccgg

SEQ ID NO: 233535 - DNA, 548 bp, Homo sapiens
  misc_feature: GYAE6OF01AUM6D.39.86.H09.1.454.CMB.1.raw
  modified_base (306)..(306): a, c, t, g, unknown or other
  misc_feature (306)..(306): n is a, c, g, or t
  modified_base (366)..(366): a, c, t, g, unknown or other
  misc_feature (366)..(366): n is a, c, g, or t
  modified_base (393)..(393): a, c, t, g, unknown or other
  misc_feature (393)..(393): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttangaggtcagtaatcggccctcgtaggggtttctaatcgtcttctctggctcagtctgcacncgcctcctgaccatctctgggctccgnggctgagggacgaggctgtatttacttactgctagcttctatttgactaacttctagtgtaggtctttagtgttacgttcgggaaggttacggggaaccctaagggtcctacgttccggttacccgttagggtccaacggtccccgaaacccggg

SEQ ID NO: 233536 - DNA, 767 bp, Homo sapiens
  misc_feature: GYAE6OF01DT5GE.39.86.H09.1.454.CMB.1.raw
tcagtcgcactagtcacgaccggtgctcgatttagtgctatagacttggggtttgggggtctcaggaggcagcgctctcaggacatctccaccatggcctgggctctgctgctcctccaccctcctcactcagggcacgagggtcctgggcccagtctcgccctgactcaggctcgcctcgtgtcgtgggtctactaggacagtcgatcaccatcctcctgacacgtacggaaccagcaggtcggtacggttggggtatggactatcgtctccgtacgtaccagactaatactccgaggaccaaccgaccgacccctaaactcaattactatttagtacggtagtactaacgttacgtccggtacccgttagttacggggtttactaactccgttacttcgtcgttcggtactaccgtaaggtccttaacggaccgaaaccgtcccggtacccttacctacgtaccctactccgtacggttaccgggtccctaccggaggtaccgtagggaacgggtacgggtaacggtcttaagggttactttaacgttacgtacgtaacgtacgttacgttacgttacgtttaccggtaacttaacgtaacgttaacggtagggttaacggttaactttaggttaccgggtttaaccgggttaacgggggttaaaccggttacggggaaacccgtttaaacgggtaccgttaccggttaaccgtttacccgggtaaacggtccccgtaaacccggaacccgggtaaaacccccgg

SEQ ID NO: 233537 - DNA, 619 bp, Homo sapiens
  misc_feature: GYAE6OF01CHCO7.39.86.H09.1.454.CMB.1.raw
  modified_base (230)..(230): a, c, t, g, unknown or other
  misc_feature (230)..(230): n is a, c, g, or t
tcagtcgcactagtcacgaccggtgctcgatttagtgctatagacttgggtttgggggctggggtctcaggaggcagcgctctcaggacatctccaccatggcctgggctctgctgctcctcacctcctcactcagggcacagggtcctgggcccagtctgccctgactcaggctgcctccgtgtctgggtctctaggacagtcgatcaccatctcctgcactggaaccngcagtgacgttggggtatgactatgtctctggtaccagcaatatccaggcacacgaccccaaatcatctatttatgagtcagtaacgtcgcctgtagggtttctaatcgtcttctcgtcggcctacgtagtctcggaccaaccgaccggtccctcccgtacgacctacgttccgtacgtcgggcctaccgacgggtcgtacggaacggaccggtaggtcttaggtaatttaacgttacgtcgacctacggtcttacgtaagtttcgacttaagtcgtaggttagtacggttacctttaggttccggttacggttaacgggtaacgggtaccgggtaaaccgtaagggttacctacggttaccggttacccgtaggtacccgtaacccgg

SEQ ID NO: 233538 - DNA, 663 bp, Homo sapiens
  misc_feature: GYAE6OF01CJAGN.39.86.H09.1.454.CMB.1.raw
  modified_base (273)..(273): a, c, t, g, unknown or other
  misc_feature (273)..(273): n is a, c, g, or t
  modified_base (285)..(285): a, c, t, g, unknown or other
  misc_feature (285)..(285): n is a, c, g, or t
  modified_base (310)..(310): a, c, t, g, unknown or other
  misc_feature (310)..(310): n is a, c, g, or t
  modified_base (357)..(357): a, c, t, g, unknown or other
  misc_feature (357)..(357): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtcgtgggtctctaggcagtcgatcaccatcctcctgcactgaaccagcagtggacggttgggggttatgactatgtctccgtggtaccagcaatntccgaggcaacnccgacccccaaactcatctatttangtagtcaagtaactccggccttgtagggtttactaagtcgtacttcncgtacggtcctacgtaagtccgtacggacaacccgtcccggtcccttacccgtacgtaaccctacgttcccgttcggttccggggtcccttccggtaacgggtcgttacgggaacgggacgggtacggtaccgttagtaactttattaccgtcgacgtacgtccttacgtagtttcgactaactcgtaggtaggtagtactttacgttaggttaccggtacgggtaaagggtacgggtaacgtacggttaccgttaccgttacggtttacccgtaggtacccgtaccggccccgtaaaaccccggg

SEQ ID NO: 233539 - DNA, 652 bp, Homo sapiens
  misc_feature: GYAE6OF01EKN4I.39.86.H09.1.454.CMB.1.raw
  modified_base (313)..(313): a, c, t, g, unknown or other
  misc_feature (313)..(313): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacgagggtcctgggcccagtctgccctgactcaggctgcctccgtgtctgggtctctaggacagtcgatcaccatcctcctgcactcggaaccagcaggtggacggttgggggttatgactatgtctccgtggtaccagcaatactccaggccacaccgacccccaaatcatctatttangagtcagtatccgcctgagggtttactaatcgtcttctcgtcggcctaccgaagttccgtacgggaccaaccgtacccggtccccttacccgtacgaaccctacttccgttccggtacggggtcccttacccggacgggtcgtacgggacgggtaaccggacggtccttaggttaactttagtttaccgtgacgtacgtccttacgttagtttcgaactaacgttacgtaggttacggtaggttactttaggttcgttacggttacgggtaacggttacgggaaccgtaggtactacggttcccgttacgtaacgtcgtacccgacccgtaaaccccgg

SEQ ID NO: 233540 - DNA, 776 bp, Homo sapiens
  misc_feature: GYAE6OF01DVS6R.39.86.H09.1.454.CMB.1.raw
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcacgtggaaccagcagtggtacggtttgggggttatgactagtgtcctcgtaggtaccagcaatacgtaccgaggaccaaccgaaccgaccccccaaaattccaacttcttaattttacgtaggtaacggttactaaaggttaactcccgggtacccttacgggttaacgggggttttacctaacgttaccgttcctttcgtcgttacggtccttaccgtaaacggttcgtacgggacctaaacccgtacccggtccccttaccctaccggaaccctacgttcccgttacgtcggggtacccttaccgacggtccgtacggacggggacggtaggtaccttaggttaactttaacgtttacgtcgtacgtacggttcccttacgttaacgtttcgaacttaaacgttacggtaaggggttacggttaacggtttcctttaaggttaccgggttttaccggttacgggggtaaacgggttacggggaacccgttaaagggtccctaacgtttcccggttaccgttaaccgggtcccgtaaccggtacccccggtaaaccccgg

SEQ ID NO: 233541 - DNA, 715 bp, Homo sapiens
  misc_feature: GYAE6OF01DEHZ5.39.86.H09.1.454.CMB.1.raw
  modified_base (285)..(285): a, c, t, g, unknown or other
  misc_feature (285)..(285): n is a, c, g, or t
  modified_base (313)..(313): a, c, t, g, unknown or other
  misc_feature (313)..(313): n is a, c, g, or t
tcagtcgcactagtcacgaccggtgctcgatttagtgctatagacttgggtttgggggggggtctcaggaggcagcgctctcaggacatctccaccatggcctgggctctgctgcctcctcaccctcctcactcagggcacagggtcctgggcccagtctcgccctgactcgaggctgccctccgtgtcgtggtctcgtaggacagtcgatcaccatcctctgcacgtcggaacagcaggtggacggtttggggtatgtactatgtctcgtggtaccagcaatcncgagcacaccacccaatcatactattangagtcaacgtacgtcgcctaggtacggttactagtcgtctctgtcgctacgagtcgtagaccaacgccgtccctcgtacgacctacttcgtccggtacgggtacctaccggtagggtaccgtagggaaccgggtacggtaaccggtacgttaacgttaacctttacggtttaacctacggtaccgtaccggtaccttacccgtttaggtttaaccgaccgtaaacgtttaccgtaggggtaccgttaacggtttacgtttacccgtttaggttaccggggtttaacggtaaaccggggttacgggtaaaccggttaaccgggtttaaccgttaaccggtttacccggtaacccgttaccgggtacccggtaaaccccggtaacccccgggtaaaacccccgg

SEQ ID NO: 233542 - DNA, 503 bp, Homo sapiens
  misc_feature: GYAE6OF01DGAHT.39.86.H09.1.454.CMB.1.raw
  modified_base (303)..(303): a, c, t, g, unknown or other
  misc_feature (303)..(303): n is a, c, g, or t
  modified_base (321)..(321): a, c, t, g, unknown or other
  misc_feature (321)..(321): n is a, c, g, or t
  modified_base (453)..(453): a, c, t, g, unknown or other
  misc_feature (453)..(453): n is a, c, g, or t
  modified_base (493)..(493): a, c, t, g, unknown or other
  misc_feature (493)..(493): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggtatgactatgtctcctggtaccagcaatatccaggcacacgccccaaactcatcatttangagtcagtaatcggcctntaggggttctaatcgtcttctctggctcaagtctggacaacacggtcctccctcgaccactctcgtgggctccaggtctggacggacgaggctaggatttatactgcaagtctctattgacatcagtgagtntatgtcgttcggaagtggaccaggtcagtcgtactaggcncgcccgaacg

SEQ ID NO: 233543 - DNA, 255 bp, Homo sapiens
  misc_feature: GYAE6OF01AG9OV.39.86.H09.1.454.CMB.1.raw
  modified_base (245)..(255): a, c, t, g, unknown or other
  misc_feature (245)..(255): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggccaaccccatgtcactctgttcccacctcctcactagtgcgactgagcgggctggcaaggcgcatagnnnnnnnnnnn

SEQ ID NO: 233544 - DNA, 684 bp, Homo sapiens
  misc_feature: GYAE6OF01BNU44.39.86.H09.1.454.CMB.1.raw
  modified_base (226)..(226): a, c, t, g, unknown or other
  misc_feature (226)..(226): n is a, c, g, or t
  modified_base (318)..(318): a, c, t, g, unknown or other
  misc_feature (318)..(318): n is a, c, g, or t
  modified_base (497)..(497): a, c, t, g, unknown or other
  misc_feature (497)..(497): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcacgtggaaccngcaggtggacggttgggggttatgtactatcgtctccgtggtaccagcaatactccgaggccacgaccgaccccctaaactcatctatttangagtcagtactccggccctacgtaggggtttactaacgtcgtcttcgtctcggtcctaccgtaagttccgtacggacctaaccgcccggtccctcccgtacgaccctacgttccgtcgtcgggccctaccgacggtcgtagggacgggacggtcggtacgttagttactttacgttacncggtactacgtaccttcgttacgtttacgacttaacgttcgtacggttacggtacggttacttaacggttcggttacgggtttaaccgggaagggttaccggggaaccgttaaacgggttcccgtaacggtttcccggttacccggttaacgggtacccgtaaccccgggaccccgtaaacccccgg

SEQ ID NO: 233545 - DNA, 252 bp, Homo sapiens
  misc_feature: GYAE6OF01AFFTR.39.86.H09.1.454.CMB.1.raw
  modified_base (247)..(252): a, c, t, g, unknown or other
  misc_feature (247)..(252): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccaccctcctcactagtgcgactgagcgggctggcaaggcgcatagnnnnnn

SEQ ID NO: 233546 - DNA, 744 bp, Homo sapiens
  misc_feature: GYAE6OF01AW26G.39.86.H09.1.454.CMB.1.raw
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcaggtggtacggttgggggttatgactatgtctcctggtaccagcaatatccaggcacacgacccccaaactcatctatttatgagtcagtaactccggcctcgtagggttttactaacgttcgtacctttcttcgtcgggtcccttaccgtaaggttccgttacgggacccaaacccgtaacccgggtccccttaccccgttacggtaacccctaacgtttcccgttaccgttccggggtacccttccccggaacgggtccgttacgggaaaccggggaccgggtaacgggtccgttacggtaaattttaaccgtttaacggttacgaccgtacgttaccgttacgttacgttttagacctaaacgttcgtacggttacggtaacggttcgtttacgttcggtttaaccggtttacggggtaacgggttaccggggtaaaccggtacggttaccgtaacgttccgttaaccggttacggtaacccgtaaccggaccccggtaaaccggtaaaccccccg

SEQ ID NO: 233547 - DNA, 628 bp, Homo sapiens
  misc_feature: GYAE6OF01B1I1P.39.86.H09.1.454.CMB.1.raw
  modified_base (233)..(233): a, c, t, g, unknown or other
  misc_feature (233)..(233): n is a, c, g, or t
  modified_base (321)..(321): a, c, t, g, unknown or other
  misc_feature (321)..(321): n is a, c, g, or t
  modified_base (333)..(333): a, c, t, g, unknown or other
  misc_feature (333)..(333): n is a, c, g, or t
  modified_base (380)..(380): a, c, t, g, unknown or other
  misc_feature (380)..(380): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcggactcagggcacgagggtcctgggcccagtctgccctgactcaggctgcctccgtgtctgggtctctaggacagtcgatcaccatcctcctgcacgtggaaccngcaggtggtacggttgggggttatgactatgtcctccgtaggtaccagcaatactccaggcacaccgacccccaaatcatctatttanagagtacagtanccgcctcgtagggtttactaagtctacttctcgtcgtctaccagtcngacaccgacggtccctcctagaccctagttccgtcggtcgggcctccgacggtcgtacgggacgggtaccggtacggtcgtacgtaattttacgttaaccgtggtaccaacgttcttaaccgttagtttaccgactaacgttcgaaggttcgacggttcttagttacggttacggttacgggtaaggtacgggtaactagggtacctacgttccggtaccgtaggtcccaccgacccgtaaaccccgg

SEQ ID NO: 233548 - DNA, 678 bp, Homo sapiens
  misc_feature: GYAE6OF01EU27F.39.86.H09.1.454.CMB.1.raw
  modified_base (301)..(301): a, c, t, g, unknown or other
  misc_feature (301)..(301): n is a, c, g, or t
tcagtcgcactagtcacgaccggtgctcgatttagtgctatagacttggggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactcggaaccagcagtgacgttggggtatgactatgtctctggtaccagcaatatccaggcacacgacccccaaatcatcatttangagtcagtaatccggcctagtaggggtttctaagtcgtcttcgtcgtcggtacctaccgtaagttccgtacggtaccaaccgtaccggtcccctaccctcgaaccccttacgtccgttccgtccggggtcccttaccgacgggtcgtacgggaagggaccggtaaggtccgttacgtaagttttacttaacgtccgtacgtaacgtccgttaccgttaacgtttcgaaccgttaactaccggtaggtacggtaacgggttacctttaaacgtcggtttaccggttacggggtaagggttaccgggtaaacccgtaaagggtccttaaacggttcccgttaacgttaacgggtcaacccggtaccccgtaaaccccgg

SEQ ID NO: 233549 - DNA, 777 bp, Homo sapiens
  misc_feature: GYAE6OF01E05H8.39.86.H09.1.454.CMB.1.raw
  modified_base (317)..(317): a, c, t, g, unknown or other
  misc_feature (317)..(317): n is a, c, g, or t
  modified_base (600)..(600): a, c, t, g, unknown or other
  misc_feature (600)..(600): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacgagggtcctgggcccagtctcgccctgactcaggtcttccgtccgtgtctgggtctcgtaggacagtcgactccaccatcctcctgcctacgtacggaaccagccgtaggtcggtacgggtttgggggttatacgtacgtagttcgttccttaccgtcggtaccagtactaagttacncccgaggaccaacccgtaccgaacccccgtaactactacttacttaagtttagtcggaagttcgtaagttaccgtcccgggtacctacgggtacgggttttctaacgtccgttccgtttcgtcgtacggtacctaccggtaacgtcggtacgaaccgtaaccgtcccgtccgttacccgtacgtacccttacggttcccgtaccgggtaccgggtcccttaccggtacgggccgttaagggaccgggtaacgtccggttagttaccgttaagttttacgtacncggtacgtaccgttcttacgttaacttacgggtaactaaaccgttcggaacgggttacgtacgtttacgtttaccgtagggtttaccggtaaacgggtcgaaccgggttaacgtacgttaccgacctttacccgggtactaggttaccccgactaaccccggtacccgtaacccccg

SEQ ID NO: 233550 - DNA, 573 bp, Homo sapiens
  misc_feature: GYAE6OF01CCYZB.39.86.H09.1.454.CMB.1.raw
  modified_base (225)..(225): a, c, t, g, unknown or other
  misc_feature (225)..(225): n is a, c, g, or t
  modified_base (307)..(307): a, c, t, g, unknown or other
  misc_feature (307)..(307): n is a, c, g, or t
  modified_base (408)..(408): a, c, t, g, unknown or other
  misc_feature (408)..(408): n is a, c, g, or t
  modified_base (427)..(427): a, c, t, g, unknown or other
  misc_feature (427)..(427): n is a, c, g, or t
  modified_base (444)..(444): a, c, t, g, unknown or other
  misc_feature (444)..(444): n is a, c, g, or t
  modified_base (450)..(450): a, c, t, g, unknown or other
  misc_feature (450)..(450): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccaatctgccctgactcaggctgcctccgtgtctgggtctctaggcagtcgatcacatctcctgcatggaaccngcagtgacggttggggtatgactatgtctcctggtaccagcaatatccaggccacaccgacccccaaatcactctatttacnggacgtcagtaactcggccctgtacgggttctaatcgtcttctactcggctacaagtctcgacaacgacgccctaccgtcacctatccgtcgtcggtcccncgtaggcctaggacgacgnggtctgtattacttacnggtacncgtctacgttattcactagtcgtacggtgtacgttacttcgttcggttacggttcggtaaggtaccgggtacgaacggttctacgttccgtacggttaagtccgacggtaacccgaaacccgg

SEQ ID NO: 233551 - DNA, 614 bp, Homo sapiens
  misc_feature: GYAE6OF01CEMPF.39.86.H09.1.454.CMB.1.raw
  modified_base (306)..(306): a, c, t, g, unknown or other
  misc_feature (306)..(306): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatactccaggcacacgacccccaaactcatctatttangaggtcagtaactccggaccctgaggggtttctaatcgtcttctctcgctacaagtctaggcaacacggccctccagacctatcctcgtcgggtcctccgaggtcgtggacgggacgaggtctagtactttagttacgtggtacaggtcctacgttagtttcgacctaagtcgtaggtacggtacgttacgtttacgttacggttaccggttacgggtaaagggttaccggggtaaacccgtaagggttccctaacgttcccggttaaccgttaagggtccctaaccgggtaccccgtaaaccccggg

SEQ ID NO: 233552 - DNA, 682 bp, Homo sapiens
  misc_feature: GYAE6OF01B8E2I.39.86.H09.1.454.CMB.1.raw
  modified_base (318)..(318): a, c, t, g, unknown or other
  misc_feature (318)..(318): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctcctgcacgtacggaaccagcagtggtacggttgggggttatgactatgtctccgtggtaccagacaatactccgaggacacaccgaccccctaaatcatctatttagngtagtcaagttacgtccggcccttaggtacggggtttactaacgtccgtacttcgtcgtcggaccttaccgtaagttcgtacggaccaaccgtcccggtaccctacccgtacgaccctacttcctacgtacgtacctaccgacggacgtacgggaggtaccggacggtaccgtacgtaacttaagtttacgttcgacgtacgtacctactaacgttaacttacgtaacggtaacgttaacgtaacgttcggttaactccgtaacggttcggtcggttacgggtaccggggtacggtaaccgggttaaccgtacgggtttacccggaccggtttaccggtaacggtaccgtaaccgggtacccgg

SEQ ID NO: 233553 - DNA, 703 bp, Homo sapiens
  misc_feature: GYAE6OF01C91T0.39.86.H09.1.454.CMB.1.raw
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctcctgcactggaaccagcagtgacggttgggggttatgactatgtctcctggtaccagcaatatccaggcacacgaccccaactcatctatttatgaggtcaagtactccggtccctgtaggggtttctaagtcgtacttctcgtggtcctaccgaagttcctacggaccaaccgtacccgggtccccttaccccgtcgaacccctacgttcccgttcgtacggggtcccttacccgacgggtaccgtacgggaacgggtaaccggtacgggtaccgttacggttaacgttttaacgtttaaccgttcgtaccgtaacggtacctttacccgttaagttttccggaacttaacgttaccgtaaggttaggtaacgggttacttacgtttcggttaccggtttacggggtaacggttacggggtaacccgtaagggttacctacggttacccggttaccgtaggttacccgacggtacccccgtaaaccccggg

SEQ ID NO: 233554 - DNA, 480 bp, Homo sapiens
  misc_feature: GYAE6OF01A72PT.39.86.H09.1.454.CMB.1.raw
  modified_base (299)..(299): a, c, t, g, unknown or other
  misc_feature (299)..(299): n is a, c, g, or t
  modified_base (336)..(336): a, c, t, g, unknown or other
  misc_feature (336)..(336): n is a, c, g, or t
  modified_base (356)..(356): a, c, t, g, unknown or other
  misc_feature (356)..(356): n is a, c, g, or t
  modified_base (396)..(396): a, c, t, g, unknown or other
  misc_feature (396)..(396): n is a, c, g, or t
  modified_base (408)..(408): a, c, t, g, unknown or other
  misc_feature (408)..(408): n is a, c, g, or t
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaatcatcatttangagtcagtaatcggcctcagggtttctaatcgcttcnctggctcaagtctggcaacncggccctcctgaccatcctctggctccaggctggagacgngctgattatacngcagctcattgacatcagtgagtcttatgtcgttaggagtggacagtcatccgtcagtcacgcccaggcccc

SEQ ID NO: 233555 - DNA, 687 bp, Homo sapiens
  misc_feature: GYAE6OF01APIJX.39.86.H09.1.454.CMB.1.raw
  modified_base (238)..(238): a, c, t, g, unknown or other
  misc_feature (238)..(238): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcgagggcacgagggtcctcgggcccagtctcgcccctgactcaggctcgcctccgtgtcgtgggtctcgtacggacagtcgatccacatctcctgcacgtagaaccngcagtggtacggttggggtatgacttagtcgttacctcgtacggtaccagaccgtaatacgtaccgaggacccaccgaacccgtaacccccaaacttcaacttactaatttacgtggtaacgtacgaaagttaacgtcccgggtaccctacggttacggggtttacaacgttccgtcctttcgtacgtcgaccgttaccgtacggtcgtacggtaccgaaaccgtcccggtccctacccgtacgtacctacgttcgtccggtcggacccttcggacggtcgtacggacggtacggtagtacgttagttactttaacgttcgccggtactacgtccttacgtagtttacgaataccgtgtagtacggtacttacgttacgttgttacggtacgggtaggtacgtaccggtaagtctacggtctacgtagaacctccggaaccgtaacccg

SEQ ID NO: 233556 - DNA, 269 bp, Homo sapiens
  misc_feature: GYAE6OF01CN5HT.39.86.H09.1.454.CMB.1.raw
  modified_base (255)..(269): a, c, t, g, unknown or other
  misc_feature (255)..(269): n is a, c, g, or t
tcagtcgcactagtcacgaccggtgctcgatttagtgctatagacttggggtttgggggggtttggtggtctccactcccgccttgacgaggctgattattactgcagctcatttgcaatcagtgaggcttatgtcttcggaagtgggaccaaggtcatcgtcctaggtcagcccaaggcccaaccccactgtccactctcgttcccgcctcctcactagtcgcgactggaggcgggctggacaaggcgcatagnnnnnnnnnnnnnnn

SEQ ID NO: 233557 - DNA, 604 bp, Homo sapiens
  misc_feature: GYAE6OF01A77T9.39.86.H09.1.454.CMB.1.raw
  modified_base (277)..(277): a, c, t, g, unknown or other
  misc_feature (277)..(277): n is a, c, g, or t
  modified_base (306)..(306): a, c, t, g, unknown or other
  misc_feature (306)..(306): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctcgtgtctgggtctctaggacagtcgatcaccatctcctgcacgtcggaaccagcaggtggtacggttgggggttatgactatcgtctccgtggtaccagcaatntccaggccacacgccccaatcatcatttngtagtcagtaactccggcctcggtacggttctaacgtcgtcttcgtctcggacctacgaacgttcacggaccaacgcccgtacccttacctcgacctactccgtcgtcggtcctacgacggtcgtaggtacggactacggtctagtactttacgtactcgcgtacgtcttactacgtttacgacttaacgtacgtaggtcggtacgtacgtttagtcgtttacgtacgggtaacggtacgggtaaccgtacggtcgtacgttaccgtacggttaggtcccaccggcccgtaaacccgg

SEQ ID NO: 233558 - DNA, 550 bp, Homo sapiens
  misc_feature: GYAE6OF01CJGV2.39.86.H09.1.454.CMB.1.raw
  modified_base (306)..(306): a, c, t, g, unknown or other
  misc_feature (306)..(306): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
  modified_base (411)..(411): a, c, t, g, unknown or other
  misc_feature (411)..(411): n is a, c, g, or t
  modified_base (428)..(428): a, c, t, g, unknown or other
  misc_feature (428)..(428): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggtatgactatgtctcctggtaccagcaatatccaggcacacgacccccaaatcatctatttangaggtcaagtaatcggccctgtaggggtttcaagtcgtcttctctggctcaagtctaggcaacncggcctccnaccntctcgtcggctcgaggctggacggacgngactgtatttacttacngacgtacgtctgtatttcgactaatcgtagtgtacgtcttagttcgttacgttacgggaaggttcgggtaaccagggtacctacgttccgtaccgtaggtccaaccggcccgtaaaccccgg

SEQ ID NO: 233559 - DNA, 732 bp, Homo sapiens
  misc_feature: GYAE6OF01CC5UX.39.86.H09.1.454.CMB.1.raw
  modified_base (315)..(315): a, c, t, g, unknown or other
  misc_feature (315)..(315): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactacggaaccagcagtggtacggtttggggttatggacttatgtctccgtggtaccagcaatctccaggcacaccgaccccaactcatctatttangagtcaagtaacgtccggccctacgtacggggtttactaacgtcgtcttcgtcgtcggcctaccgtaacgttcgtacggaccaaacccgtccggtccccttacccgtacgaaccccttacgttccgttaccggtcggggtaccctaccggtacgggtacccgttagggaacgggtaaccggtcgggtaccgttagttaacttttacgtttacgtcgtacctacgtaccttacgttaacgtttcgaaccgttaacttacggtacgggttacggtaacgtttaccgtttagttcgggttttaaccggttacggggtaaacgggttccggggtaaaaccggttacgggttacccgttaaccggtttccggttacccggtaacgggttacccgaaacccggtaaccccggtaaacccccgg

SEQ ID NO: 233560 - DNA, 803 bp, Homo sapiens
  misc_feature: GYAE6OF01COF66.39.86.H09.1.454.CMB.1.raw
  modified_base (320)..(320): a, c, t, g, unknown or other
  misc_feature (320)..(320): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcgaggctgcctccgtgtcgtgggtctctaggacagtcgatcacatcctctgcacgtggaaccagcagtgtacggttggggtatgtactatcgtctcgtggtaaccagacaaatatccgaggacaaccgaccgacccccaaactcactactatttagnggtaagtccaagtaactccggtccctaggtacgggtttctaagtccgttacttcctcgtcgtcctacgtaacgtccgtaggacctaaccggtaccggtacccttacccgtacgtaaccccttacgttccccgtccggttacggggtaccccttacccgggtaacgggtccggttaacgggaacgggtaaccggggtaccggttaccgtttaaggttaaaccgtttttacgttaaccgttcccggtacgtacccggttaccttaccggttttaagttttaccgggaacccttaaagttccggtagggttacgggtaaaccgggttttctttaagggtttcccgtttaagggtttaaaccggggttaaaggggttaaccggggtaaaccccgtaaacgggtttcccttaacccgggtttacccggttaaacccgggtttagggtaaccccggtaaccccgggttaaaccccggaaaccccccggg

SEQ ID NO: 233561 - DNA, 766 bp, Homo sapiens
  misc_feature: GYAE6OF01BZQ00.39.86.H09.1.454.CMB.1.raw
tcagtcgcactagtcacgaccggtgctcgatttagtgctatagacttggggtttggggggggtctcaggaggcagcgctctcaggacatctccaccatggcctggctctgctgctcctccaccctcctcactcgacgggcacgacgggtcctcgggcccagtcctcgccctgactcgaggctgcctccgtgtcgtgggtctcgtaggactagtcgatccacctctcctcctcgactacgtacggaccagcgtaggtcggtacgggttaggggtatgtactcgtcgtctaccgtacggtaccagactaatcgtaccgaggccaaccgtacccgaacccccaaatcctacttacttaagtttagtacggtacgttaacgaacgttaccgtccggtacccgttacgggttacggtttacctaacgtccgttcttccgtacgtccgtacctacgtaacggttcgacggtaccctaaccggtcccgttacccgtaccctacgaccttcgttccgtacggtccggtaccgtccgtaacgggcctaggggaccggtaacggtcgttaccgtagtttaacttacggtacgtcgtacgtccttacttacgttacctttagaaccttagttcggtaccgggttagtaccggtttcgttaacgggttttccgtaaccggggttaacgggtacggtaccggtaaccgggttagttcccggttacgttaaccggggttacccaccgggttacccaacccgggtaacccccgtaaacccg

SEQ ID NO: 233562 - DNA, 257 bp, Homo sapiens
  misc_feature: GYAE6OF01A7D7J.39.86.H09.1.454.CMB.1.raw
  modified_base (204)..(204): a, c, t, g, unknown or other
  misc_feature (204)..(204): n is a, c, g, or t
  modified_base (247)..(257): a, c, t, g, unknown or other
  misc_feature (247)..(257): n is a, c, g, or t
tcagtcgcactagtcacgaccggtgctcgatttagtgctatagacttggggtttggggggtttggtggtctccactcccgccttgacgaggctgattattactgcagctcatttgcaatcagtgaggcttatgtcttcggaagtgggaccaaggtcatcgtcctaggtcagcccaaggccaaccccatgtcactctgttccccncctcctcactagtgcgactgagcgggctggcaaggcgcatagnnnnnnnnnnn

SEQ ID NO: 233563 - DNA, 636 bp, Homo sapiens
  misc_feature: GYAE6OF01AKFYJ.39.86.H09.1.454.CMB.1.raw
  modified_base (329)..(329): a, c, t, g, unknown or other
  misc_feature (329)..(329): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctcgccctgactcagctgcctccgtgtctgggtctcgtaggacagtcgactcaccactcctcctgcacgtacggaaccagcaggtcggtacgggtttgggggttatgtacttatcgtcctccgtacggtaccagactaatacgtaccaggcaccaccgaccccaaatcatctattangacgtcgacgtactccggtacccgtcggttacggttactaacgtcgtacttcgtccgtcgtctaccgtaagtcgtcgaccgaccgtccgtcctacctgacctactccgtcgtcggcctcggacggtcgacggacggaccggtaggtactacgtactttacgttcgtcgacgtctacttcttagttaccgtataagtacggaggttacgtacgttcgtttacgtcggttccggtaacggtacggtacgggtaacctacgttacgtaccgttaccggacggttaacgccgaccgtacccggtaaccccg

SEQ ID NO: 233564 - DNA, 749 bp, Homo sapiens
  misc_feature: GYAE6OF01DJXFP.39.86.H09.1.454.CMB.1.raw
  modified_base (246)..(246): a, c, t, g, unknown or other
  misc_feature (246)..(246): n is a, c, g, or t
tcagtcgcactagtcacgaccggtgctcgatttagtgctatagacttggggtttggggggggtctcaggaggcagcgctctcaggacatctccaccatggcctggctctgctgcctcctcaccctcctcactcgagggcacgacgggtcctgggcccagtctcgccctgactcgaggctcgcctcgtgtcgtgggtctcgtaggacagtcgatccactactcctccgtgactacgtacggaaaccngtacgtaggttcggtaacggggtttgggggttaatgtaacgttagttcgtccgttaccgtacgggtaaccacgaactaagttaccgaccgacggaccaaccgaacccgaaccccctaaatcctaacttacgttaaagttttacgacggtaacgttacgaagttaaccgtccggtaccgttaggttacggtttactacgtccgtacttcgtacgtcgtccttaaccgagtccgagtaacccgaacgtcccgtcctacctacgaaccctgtccgtacggtccgtacctacggacgggagtacgggaacggtacggtacgttctaagtaacgtttacgaacgtcgtacgtacgtaccttattacgttacactaagtcgtaggttaacggtaccgttattacggtacgggttacgggtaaacgggtaggggtaaccggaaaccttagggtcccttaacggtcccggttacggtaaccgtccgaaacccgggaccctaaacccccggg

SEQ ID NO: 233565 - DNA, 829 bp, Homo sapiens
  misc_feature: GYAE6OF01ECKEQ.39.86.H09.1.454.CMB.1.raw
tcagtcgcactagtcacgaccggtgctcgatttagtgctatagacgttggggggggggtctcaggaggcagcgctctcaggacatctccaccatggcctgggctctgctgctcctcaccctcctcactcgaggcacgaggtcctgggcccagtctcgccctgactcgaggtctcgcctcgtgtcgtgggtctcgtaggactagtcgatccacctatcctccgtgcacgtacggaaccagtcaggtggtacgggtttaggggtatcgtacttagtcgttcctccgtacggtaccagacctaaattaccgtaccgaacggaccaaccgtaacccgaaccccctaaactctaactaccgttaattttacgacggtaacggttacctaaaggttaaccgtcccggtaacccggtttaggttacgggtttacctaacggtccgttacgtttaccgtcggttacgtacccttaccggtaacggttccgtaccggaaccctaacccggtacccgtccccgttacccgtacgtaacccgtacttcccggtacgggtccggtaccttacccggagggttcggaagggaccgggtaacgggtacggttacttaacgtttaaggtttaaccttcggtacgtaacctacggttacccttaagttacgtttaaccgaacgttaacttacggttaggttacggtacggttaccgttagtttaccgggttacggttaaccggggtaaacgggttaccggtaaacgttaaccgggttacctaccgggtttaccgttacccgggtaacaccccgggaaccgtaaccccggaacccgtaaacccccg

SEQ ID NO: 233566 - DNA, 640 bp, Homo sapiens
  misc_feature: GYAE6OF01BJ1TB.39.86.H09.1.454.CMB.1.raw
  modified_base (231)..(231): a, c, t, g, unknown or other
  misc_feature (231)..(231): n is a, c, g, or t
  modified_base (275)..(275): a, c, t, g, unknown or other
  misc_feature (275)..(275): n is a, c, g, or t
  modified_base (310)..(310): a, c, t, g, unknown or other
  misc_feature (310)..(310): n is a, c, g, or t
tcagtcgcactagtcacgaccggtgctcgatttagtgctatagacttggggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctcctgcactggaaccngcagtgacggttggggtatgactatgtctctggtaccagcaatntccaggccacacgacccccaaatcatctatttagngagtctaagtaactccggtccctacggtacggggtttacaaacgttcgtaccgttcctcgtcggtccttaccgaaggttccgtacggtaccaaaccgtacccgggtacccttccccgtacggtaaccctacgttccgttaccgtacgggtccctacccgagggtcgtaggacgggacgtaggtcgttagtaacgttacttacgtacgacgtagtaccgttactagtttcgactaatcgtaggtagtacgttcttagtcgttacggttacgggaagggtcggaacgtacggtctacgttcgtaccgtaggtccaccggacccgtaacccgg

SEQ ID NO: 233567 - DNA, 708 bp, Homo sapiens
  misc_feature: GYAE6OF01BRR4H.39.86.H09.1.454.CMB.1.raw
  modified_base (241)..(241): a, c, t, g, unknown or other
  misc_feature (241)..(241): n is a, c, g, or t
tcagtcgcactagtcacgaccggtgctcgatttagtgctatagacttgggtttgggggctggggtctcaggaggcagcgctctcaggacatctccaccatggcctgggctctgctgctcctccaccctcctcactcgagggcacgagggtcctgggcccagtctcgccctgactcaggctcgcctcgtgtctgggtctcgtaggacagtcgactcacatcctcctgacacgtacggaaccngacgagtacggtacggtttggggttaactgtactagtcgtcttaccgtacggtaccagactaatacgtaccgacggaccaccacccgaacccccaaactcacttactaatttagtagtacgtactaagtaaccgtccggaccgtacggttacgggtttactaacgttccgttactttccgtacgtcggtaccctaccgtaacggttccgtacggaaccaacccgtaccgtccctacccgtacgacctacgtcttacggcggtcctacggacggtccgtaggaccggacgtaccggtagttacgttaaccttttagaaccgtcgaccgttacggtacttacgttaacgttacgaacgttaaccgttgtaacggttaaccgggtagttacccgtttaggtccgttaacgggttacggtaacggtacggaacgtacgtacgtacgtaccgtacgtcggaccgtaacccgg

SEQ ID NO: 233568 - DNA, 709 bp, Homo sapiens
  misc_feature: GYAE6OF01DA32S.39.86.H09.1.454.CMB.1.raw
  modified_base (340)..(340): a, c, t, g, unknown or other
  misc_feature (340)..(340): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctcgccctgactcaggctcgcctccgtgtcgtgggtctcgtaggacagtcgatccaccatcctcctgacacgtacggaaccagcgtaggtggtacgggtttgggggttatacggtactagttcgtccttccgtcggtaaccagactaatactccgaggaccacgaccaccccaaatcatctatttagngagtacagtacgccggtcctaggtaggttctaacgtcgtcttctcgtgtcctacgtagtcgacggacctaacgaccggtccctccgtacgaccctacgttccgtccggtacgggtcccttaccggacggtaccgtacgggacgggtacggtacggtccgttaagttaaccgttttaactaccgtcggtaactacgtcttaaccgttagttacgaaccttaagttacgacggttggtaccggtttacttaggtttccgttacggggttaacgggtaaacggggttaccgggaaacccgttacggttacgtaacccggtttccggttaacccggtaggtacccgacccgggttaaaccccgaaaccccggg

SEQ ID NO: 233569 - DNA, 655 bp, Homo sapiens
  misc_feature: GYAE6OF01B0ZST.39.86.H09.1.454.CMB.1.raw
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacgagggtcctgggcccagtctgccctgactcaggctgcctcgtgtctgggtctctaggacagtcgatcaccatctcctgcacgtggaaccagcaggtggtcggtttgggggttatggtactagtcgtctccgtaggtaccagacaatacgtccaggccaacgaccgacccccaaatccagtctatttagtgagtacagttactccggacctcgtacggttactaacgtcgtcttctcgtcggtctactaagtcgtacggacaacgtccgtcctaccgtacacctactcgtacgtcggactacgcgcgtggacggtacggtacggtcgtacgttaacgttacgtttaccgtcgtaccgtaacgttcttacgttacgtttaccgacttaacttcggtaggtgtaaacggttctttacggttggttaccgggttaacgggaacggttacggggtaaccgaaggttaccgacggtttaccgtacgttaccgggtaccgacccggtaaccccgtaacccgg

SEQ ID NO: 233570 - DNA, 758 bp, Homo sapiens
  misc_feature: GYAE6OF01ECH0R.39.86.H09.1.454.CMB.1.raw
tcagtcgcactagtcacgaccggtgctcgatttagtgctatagacttgggtttgggggggggtctcaggtaggctagcgctctcaggtacatctccaccatggcctggctctgctgctccgtcaccctcctcactcgagggcactagggtcctcgggcccagtctcgccctgacctcaggctgcctccgtgtctgggtctctaggactagtcgatcaaccgtatcctcctgccactcggaacctagctagtgtacggttggggttatgtactatcgtctcgtagtaccagcaatactccgagaccaaccgtaccgaccccctaaaactcctaacttaccgttaagttttacgtacggtaacgggtaccgtaaacggttaaccggtcccggtacccgttaacgggttacggggtttacctaagtcgttacttcgtccggtacgtccctacgaacgttcgtacggtaaccaaccgtaccggtaccctaccgtagaaccctagttccgtacgtcgggtacctacggtacggtacggtagggaacggtaaccggtagtacgttagttaacgtttacgttacgtacgtcgtaacgtacccttacttacgttaggaaccgttaaggtacggtaacgggttacgtaacgggttacttaaaggttccggttaacggtaaccgggttaagggtccgggtaaacgaccgggttaactaccggtttccggtacgttaaccggtccgtaacccgtaccccgaaaccccgg

SEQ ID NO: 233571 - DNA, 520 bp, Homo sapiens
  misc_feature: GYAE6OF01B6W5H.39.86.H09.1.454.CMB.1.raw
  modified_base (228)..(228): a, c, t, g, unknown or other
  misc_feature (228)..(228): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacgttggggttatgactatgtctcctggtaccagcaatatccaggcacacgcccccaaatcatcatttatgaggtcagtaatcggccctcgaggggtttctaatcgcttctctggctccaagtctggcaacacggcctcctgaccatcctctgggcctccgaggctggacggacgtaggtctgtatttacttactgcagtctctagtttcgctaatcgagtgagtcttagtgtcgttcggaaggtcgggaccaggtcacgtcgtcctaggtcacgcccgtaaacgg

SEQ ID NO: 233572 - DNA, 859 bp, Homo sapiens
  misc_feature: GYAE6OF01A1CHC.39.86.H09.1.454.CMB.1.raw
  modified_base (739)..(739): a, c, t, g, unknown or other
  misc_feature (739)..(739): n is a, c, g, or t
  modified_base (801)..(801): a, c, t, g, unknown or other
  misc_feature (801)..(801): n is a, c, g, or t
tcagtcgcactagtcacgaccggtgctcgatttagtgctatagacttgggggggggtctcaggaggcagcgctctcaggacatctccaccatggcctgggctctgctgctcctccaccctcctcactcagggcacagggtcctgggcccagtctgccctgactcaggctgccctccgtgtcgtgggtctctaggacagtcgatccaaccattcctcctcgtaccacgtacggaacccagacctaggtggtaccgggtttaggggggttactaggtaccttagttcgttaccgtccgtacgggttaaccacggtacctaaagttaccgtacccgagggacccaacccgaaccccggtaaccccccctaaaacgttccctaactttacccttaacgtttttaaccggagggttaaccgggttaccgtaaacggtttaaccggttaccccgggtacccccgttttacggggttaacggggtttttacctaaacgttccgttaccctttccgtcccggttacgggtaccttaacccggtacggttaccggtaccgggtaacccgtaaaccgtaccccgggtcccgtttacccgtaccgtaaccgttaccgttccggttccggtaccgggtacccttacccggagggttaaccccgtagggtaaccggggaaccgttaacggggttacttaacggttacgttttaacgtacgtccggtaacgtacgtccgttaagttaccgttntaccgtatacggtgtcgtaacgttacttcgtacggttacgtacgggtacgtgggtaacccgnggttacaccgttacgtaccggttacgtaccgaccgtaccccggaaccggtaacccccg

SEQ ID NO: 233573 - DNA, 605 bp, Homo sapiens
  misc_feature: GYAE6OF01C2CB8.39.86.H09.1.454.CMB.1.raw
  modified_base (302)..(302): a, c, t, g, unknown or other
  misc_feature (302)..(302): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggtatgactatgtctcctggtaccagcaatatcaggcacacgacccaaactcatcatttangagtcaagtaacgtccggacctagtagggtttctaagtcgtcttctctcgctccaagtcgtgacaacgaccggtcctcccgtagaccctatctcgtcggctccgaggctaggacggacgacgtcgtgtaactttactacgtgactacgtcctactagtttcgactaactcgagttacggtaacgttcttagttcggttaccggtttacggggtaacggttacggggtaaaccgtaacggttacccgtaacgttcccgttaaccgttaccgggtaaccgtaccggaaccccggtaaaaccccgg

SEQ ID NO: 233574 - DNA, 641 bp, Homo sapiens
  misc_feature: GYAE6OF01B34BV.39.86.H09.1.454.CMB.1.raw
  modified_base (233)..(233): a, c, t, g, unknown or other
  misc_feature (233)..(233): n is a, c, g, or t
tcagtcgcactagtcacgaccggtgctcgatttagtgctatagacttgggtttgggggtctcaggaggcagcgctctcaggacatctccaccatggcctgggctctgctgcctcctcaccctcctcactcagggcacgagggtcctgggcccagtctcgccctgactcaggctcgcctcgtgtcgtgggtctcgtaggacagtcgactcaccatcctcctgcacgtggaaccngcaggtcgtacggttggggttatgtactagttcgtcctccgtacggtaccagacaactactaccgacggcaccaccgaccccaactctactactatttagagtagtacaagtacgtccgtaccgtagtacggggtttactacgtcgtcttctcgtcggtctaccgacgtcgtacgacaaccgtcccgtcctaccgtcgacctctcgtcgtcggtcctcgacggtcgtacggaggtacggaggcgttagttacttattacgtgctacgtcttactatttcgatactcgtacgtacggtacgttacttacgtaggtttaccgttacgggtaagggttaaccgggtacgtaacggtccttacggttaccggttaccggttacggtacctaaccggacccggtaaaccccgg

SEQ ID NO: 233575 - DNA, 648 bp, Homo sapiens
  misc_feature: GYAE6OF01BDEJB.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggtatgactatgtctcgtggtaccagcaatactccgaggcaaccgaccgacccccaaaatccatctatttatggagtcaagtaacgtccggcccgttacgtaggggtttactaagtccgtcttactcgtcggtcctaccgtaaggtcctacggaccaaccgtacccgggtcccttcccgtacgaaccctacgttccgttaccggtcggggaccccttaccggacgggtccgttacgggaacgggtaccggtacgggtcgttaggtaacttttacgttaacgtgtaccgtacgtcttacgtagtttacgactaagtcgtagtacgtaggtcttagtcgttacgtacggtaaggtcgggtaacctaggtcctagttccggtactacgggtccaaccgtcccgtaaacccgg

SEQ ID NO: 233576 - DNA, 648 bp, Homo sapiens
  misc_feature: GYAE6OF01DV9WT.39.86.H09.1.454.CMB.1.raw
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctgcctcgtgtctgggtctctaggacagtcgatcaccatcctcctgcactggaaccagcagtgacggttggggtatgactatcgtcctcgtcggtaccagactaatactcgacggccaaccgaccgacccccaaactcatactatttactaggtacgtactaacgtaacgtccgtcccttacggtacgggtttactacgtcgtctttctcgttcgctaccaacgttcgcggactaacccgtaccggtccctacccgtacgacctacgtccgtcgtacgggtcctacccgaggtcgtacggagggtacgacggtcgttagtatttacgtacgtcgacgtacgtccttacgtagtttcaacgtattcgtaggtggtagtttaccttggttcgttacggttacgggtaacggtaacgggaacgtaggtacctcggttaaccgttcgttaacggtaccgaaccggacccgaaaccggtaacccccg

SEQ ID NO: 233577 - DNA, 747 bp, Homo sapiens
  misc_feature: GYAE6OF01A4FMD.39.86.H09.1.454.CMB.1.raw
  modified_base (270)..(270): a, c, t, g, unknown or other
  misc_feature (270)..(270): n is a, c, g, or t
tcagtcgcactagtcacgaccggtgctcgatttagtgctatagacttgggtttgggggtctcaggaggcagcgctctcaggacatctccaccatggcctgggctctgctgctcctccaccctcctcactcgagggcacgagggtcctcgggcccagtcctcgccctgacctcaggctcgtcctccgtgtccgtgggtctcgtaggacagtcgatccaccatcctcctgacctacgtacggaaccagcaggtcggtacggttaggggttangtacgtagttcgttccttaccgtggtaaccagtaacctaatacgtccgaggaccacctaccggaccccctaaagtccattaccgttattttacgaggtaacggtctaaggttaaccgtccggtacctacgggttacgggttacctaacgtcggtcttaccgtgtcccggtactaaccgacggtttccgacggtaccgaaacccgtccggtcccgttaccgtacgtacccgtacgttccgttccggtcgggtccctaccggtagaccggttacggaacgggtacggtacggacgtttgtaaacgtttacgttacgtacgactaccggtattcctaagtttcgaacttacgtacgtaagggtgttaacggttacttagtaccggtttacccggtagggtaacgggtacggtaacccgtaggtaccttaacggttaccccggtacgtaaccgttcgaaccggtaaccccgtaaaccccgg

SEQ ID NO: 233578 - DNA, 814 bp, Homo sapiens
  misc_feature: GYAE6OF01EQN5I.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttactgactatcgtctccgtggtaccagacaatactccgaggcacacgacccccaaactcaatctaatttatgtaggtactagtaacgtccggcccgttacgtacgggggttttacctaacgttcgtcctttcctcgtcgggccttaccgtaacggttccctagggtacccaaaaccgtacccgggtccccttaccccgttacggaacccctaacgtttcccgtttacccggttcggggtaccccttacccggtaacgggtcccgttacggggaaacgggtaccgggtaaacgggtcccgttaggttaaaccgtttttaactttaaccgttacgggtaccgtaacggtacccgtttacgttaacgtttttaccgaaccttaaacttaccgtaagggttacggtaacgggtttaccgttttaaaggtttacccgggtttccggttttaaacggggttaaaccggggttaaccgggggtaaacccggttaaacggggttcccttaacgtttaccgggttacccgttaacggggttacccgtaaacccggtaacccccggtaaaaccccggg

SEQ ID NO: 233579 - DNA, 255 bp, Homo sapiens
  misc_feature: GYAE6OF01CBDZJ.39.86.H09.1.454.CMB.1.raw
  modified_base (246)..(255): a, c, t, g, unknown or other
  misc_feature (246)..(255): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccaccctcctcactagtgcgactgagcgggctggcaaggcgcatagnnnnnnnnnn

SEQ ID NO: 233580 - DNA, 744 bp, Homo sapiens
  misc_feature: GYAE6OF01CN3ET.39.86.H09.1.454.CMB.1.raw
  modified_base (227)..(227): a, c, t, g, unknown or other
  misc_feature (227)..(227): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgcccctgactcaggctgcctccgtgtcgtgggtctctaggacagtcgatccaccatctcctgcactggaaccngcaggtcgacggtttgggggtatgtactagtcgtctccgtggtaccagacaatactccgaggccaacgaccgaacccccaaatcctatactaatttatgtaaggtctaagtaacgtccggtaccctcggttaacggggtttctaacgttccgtctttccttacgtcggtacctaccgtaagttccgtacggaccctaaaccgacccgggtccccttaccccgtacgtaaccctacgttcccgttccggtccgggtaccctaccggacggtccgtagggacgggtaaccggacgggtccttagtaatttaacttacgtacgcgtacgtactaccgttaagtttccgaactacgttacggtagttagggtaacgttaccgtttaggttaccggtttacgggtttaacgggaaacggggtttacccggggtaaacccgttaacggggttaactacccggtttcccggttaacccggttaccgggtaacccgtaaccccggaacccgggttaaacccccgg

SEQ ID NO: 233581 - DNA, 874 bp, Homo sapiens
  misc_feature: GYAE6OF01BE31W.39.86.H09.1.454.CMB.1.raw
  modified_base (200)..(200): a, c, t, g, unknown or other
  misc_feature (200)..(200): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcttcactcgagggcacgagggtcctgggcccagtctcgccctgactcaggctcgcctcgtgtcgtgggtctcgtaggacngtcgactcacctatcctcctgcctacgtacggaaccagcgtaggtacggtacgggtttagggggttacaggtaacgttacttcggttcccgttaccggttacggtaaccctaggtaaccttaaagtaaccgttcccgaaacggaccctaaacccgtaacccggaaaccccccttaaaagtaccctaacttaccgtttaaacgttttaacgtacgggtacggttaaacgtaaaccgggtttaccgtaccccggggttaccctttaacggggtttaaccgggggttttaactaaccgggtttcccgttaccgtttccgtaccggttaccgggtaccctttaaccggtaaacggttcccgttaccgggtaaaccaaccgggtaccccggttcccgtacccgtacggttaacccctggtttcccgttacggggtacccgtccgtaaccggacgggttacgacgggtaaccgggccggtaacgtcgtaacgtttaacgttaccttacggtacgtaccgtaacgttcgttacgttaacgtttccaacgttaacgtacggtacgtaggtaccggttcttacgttacgggttacccggtaagggtaacggtacgggtaaccgtacggtttaccgacctttaccgggtacccgtaggttcccgaaccggtcctaaaccccggg

SEQ ID NO: 233582 - DNA, 706 bp, Homo sapiens
  misc_feature: GYAE6OF01BGMAH.39.86.H09.1.454.CMB.1.raw
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacacgggtcctgggcccagtctcgccctgactcaggctcgcctccgtgtctgggtctcgtaggacagtcgatccacctactcctcctgcactacggaaccagcaggtggtacgggttgggggttatagacttattgtcctcgtcggtaccagactaagtctacgacggaccaccgaacccgaaccccctaaactacacgttataacgttttacgaggtaacgtactaagttacgtcccgggttacctcggttaagggtttactaagtccgtcgtttctcggtacgtccgtaccgtaagtccgtacgaactacccggtaccgtccctaccgtaccgtacctcttcgtaccggtggtaacccctcgacgggtacgtacggaagggaccggtaggtacctaagttacttacttcggtcgacgtacgtattaccgttaagttacaaccgtagtaccggtaggttaccgtattaccggtttgtaccggtttacggtaccgggtacggtaccggtaacgttccgtacttaccggttccttaccggtaggaccctaacccggacgtaaaccccgg

SEQ ID NO: 233583 - DNA, 765 bp, Homo sapiens
  misc_feature: GYAE6OF01DKMX0.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctccaccctcctcactcgagggcacgagggtccgtgggccagtctcgccctgactcaggctgcctcggtgtcgtgggtctcgtaggacagtccgtactccaaccgtacttcctccgtcggcaacgtagggaaccaggcgtacggtcggggtacgggtttagggggttactggtaacttacggttcgttcctcggtacggtaccgagactaaactcgtaccaagggccaaccgaaccgaacccccctaaatacctacgttacgttaagttttacgaggtacggtactaacggtaaccggtccgtacccggtaggttacgggttactacgtcggttacttcgtcgtacggtaaccctacggtacgttacgtaccggaacgtaaaccggccccggtaccccttaccgtaacgtaacccgtacgtttcccgtacgggttccgggtacccttaccgggacgggtcgtacgggaacggggtcggtaacggttaccgttaggttaactttaacgtcggtacgacgttcgttacgttcgttacttacgtaccgttataccgtagtaccggtgttacgttggttacggtacgtacgggtagggtacggtacgaaggtcctaaacggttcgtaccggtaggtacccgtgaaccccggtacccg

SEQ ID NO: 233584 - DNA, 253 bp, Homo sapiens
  misc_feature: GYAE6OF01EL2C5.39.86.H09.1.454.CMB.1.raw
  modified_base (238)..(238): a, c, t, g, unknown or other
  misc_feature (238)..(238): n is a, c, g, or t
  modified_base (244)..(253): a, c, t, g, unknown or other
  misc_feature (244)..(253): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaacccatgtcactctgttcccaccctcctcactagtgcgactgagcgggctggcaaggcncatagnnnnnnnnnn

SEQ ID NO: 233585 - DNA, 633 bp, Homo sapiens
  misc_feature: GYAE6OF01BOUZ3.39.86.H09.1.454.CMB.1.raw
  modified_base (235)..(235): a, c, t, g, unknown or other
  misc_feature (235)..(235): n is a, c, g, or t
  modified_base (258)..(258): a, c, t, g, unknown or other
  misc_feature (258)..(258): n is a, c, g, or t
  modified_base (324)..(324): a, c, t, g, unknown or other
  misc_feature (324)..(324): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcgagggcacgacgggtcctgggcccagtctcgccctgactcgaggctcgcctccggtgtcgtgggtctcgtaggacagtcgatcaccatcctcctgcacgtggaaccngcaggtcgtacggttggggttangacttatcgtctcgtaggtaccagactaatcgccgaggcaaccaccgaccccaatcatctatttancgtagtacaagtacgtccggtacctggtacgggttctaacgtcgtcttcgtcgtcggacttacgaagtccacgggaacctaccgaccggtccttaccgaccaccttactccgttcggtcggaccctcgaggtccgagggtacgagtacggtctaaggttactacttagccgatcgtctactagttcacgttagtcgaggtcgtcgtaacgttcgttacggttacggtaccgggtaaaggtccgggtaaacctcgggttacgttaacgtcccgttaacggttagtaccgaaccggtcccggtaaacccgg

SEQ ID NO: 233586 - DNA, 764 bp, Homo sapiens
  misc_feature: GYAE6OF01CSL4A.39.86.H09.1.454.CMB.1.raw
  modified_base (596)..(596): a, c, t, g, unknown or other
  misc_feature (596)..(596): n is a, c, g, or t
tcagtcgcactagtcacgaccggtgctcgatttagtgctatagacttggggggggggtctcaggaggcagcgctctcaggacatctccaccatggcctgggctctgctgctcctcaccctcctcactcagggcacgagggtccgtgggcccagtctcgcccttgacctcgaggtctcgccgttccgtgtcgtcgggttctcgtacggacagtacgactccaccactcctccgtgacctaacgtacggaaccagaccgaggttacggtacgggtttagggggttatcgtacttagtacgttccgtaccgttacggaccaagtactaatacgtaccgacgaccaccgaacccgaccccaaactcacttactatttacgagtacggtactaacggtaccgtacccggtaccgttagggttacggtttaactacgtacctaccgtttccgtccgttacgtacccgttacgtacggttaccgacggaacctaacccggtcccgtaccctaccgttaccgaaccttccgttaccgtcggtaccggccctaccggtaggtcgtacggacgggtacggcggttatacgttacttaagttaccgngtacctacgttctagttcgttacgaacttcggtaatggtacggttaacgttcttacggttccggttaacgggtaccggggttaacggacggtaaccgtaagggttcccgagtttcccgggttacccggaaaggtacccaacccgggttacccgtaaacccggaccccc

SEQ ID NO: 233587 - DNA, 773 bp, Homo sapiens
  misc_feature: GYAE6OF01DKE20.39.86.H09.1.454.CMB.1.raw
  modified_base (209)..(209): a, c, t, g, unknown or other
  misc_feature (209)..(209): n is a, c, g, or t
  modified_base (220)..(220): a, c, t, g, unknown or other
  misc_feature (220)..(220): n is a, c, g, or t
  modified_base (273)..(273): a, c, t, g, unknown or other
  misc_feature (273)..(273): n is a, c, g, or t
tcagtcgcactagtcacgaccggtgctcgatttagtgctatagacttgggttgggggtctcaggaggcagcgctctcaggacatctccaccatggcctgggctctgctgctcctcaccctctcactcagggcacagggtcctgggcccagtctcgccctgactcagcctgcctcgtgtctgggtcctctggacagtcgatcacatctcngctactggaancagcagtgtacggttggtggttatgtactatcgtctcgtggtaccagacaatntacaggacacaccgaccctaactcatactatttatgtagtacagtactcgtcccttgtacgggtttactaaacgtcgtctttctacgttcgtacctaccgtaaacgtcgttaccggtaccgtaaacccgtacccgggtacccctacccccgttacggtaacccttaaccgtttcccggttacccgttcgggggtaccccttccgggacccgggtagttacggggaaacgggtaacggacgggtaccttacggttaacttttacgtttaacgtaccggtaccgtaaccgttcggttaacccgttagttttaaccgtaaacccgttattaaccccggggtaaatttcgggggttaaacccgggtttctttaaaccgggtttaccggttttacccgggtttaaacggggttaaaccgggttttacggtaaccggttaaaccgggtacgggtttaaccccttaccgggttaaacccgtttcccggggtaccggttaaaccccgg

SEQ ID NO: 233588 - DNA, 664 bp, Homo sapiens
  misc_feature: GYAE6OF01AJSK7.39.86.H09.1.454.CMB.1.raw
  modified_base (201)..(201): a, c, t, g, unknown or other
  misc_feature (201)..(201): n is a, c, g, or t
  modified_base (317)..(317): a, c, t, g, unknown or other
  misc_feature (317)..(317): n is a, c, g, or t
  modified_base (323)..(323): a, c, t, g, unknown or other
  misc_feature (323)..(323): n is a, c, g, or t
  modified_base (475)..(475): a, c, t, g, unknown or other
  misc_feature (475)..(475): n is a, c, g, or t
tcagtcgcactagtcacgaccggtgctcgatttagtgctatagacttgggttggggggtctcaggaggcagcgctctcaggacatctccaccatggcctgggctctgctgctcctcaccctcctcactcagggcacacgggtcctcgggcccagtctcgccctgactcaggctcgcctccgtgtcgtgggtctcgtagacngtcgatcacatctctgccactagaaccagcagtggacggttgggggttatgactatcgtctccgtaggtaccagacctaatctccgaggcaaccaccgaccccaatcatctattangagtanagtacgcgacctcgtggttactagtctcttctcgtcgtctacgtagtcgtagtaccaacgccggtccctcccgtacgtaccacgttcgtccggccggtacctccggtacggtccgttagggacgacggcggtacgttagtactttaacgttnacgtacgtacgtcttacggtaacttcgaaactttcgtaacgtggttaacggtacgttacgtttaggttccggtttaacggtaaccgggggttaaggttacggggtaccgtaaaccgggttcgttaaacccgggttccctacgggtttaacccggacccgtaaacccgggcccccgttaaaacccccggg

SEQ ID NO: 233589 - DNA, 775 bp, Homo sapiens
  misc_feature: GYAE6OF01DWTZ2.39.86.H09.1.454.CMB.1.raw
  modified_base (216)..(216): a, c, t, g, unknown or other
  misc_feature (216)..(216): n is a, c, g, or t
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
tcagtcgcactagtcacgaccggtgctcgatttagtgctatagacttggggggggggtctcaggaggcagcgctctcaggacatctccaccatggcctgggctctgctgctcctcaccctctcactcagggcacagggtcctgggcccagtctgccctgactcaggctcgcctccgtgtcgtgggtctcgtaggacagtcgatcaaccatccgtcngcacgtcggaaccngcagtcggtaggtttggggttanacgtactagtcgtccgtacgtacggtaccagactaatacgtaccaggaccaaccgaccgaacccccaaacttcaactacttaatttagtacggtaagtacgtaacgttaacgtccggtaccgtacggttaacggggtttaccttaaagttccgtactttccgtacgtcggtaacctaccgtaagttccgtacggaccgtaaaccgtcccggtcccttacccgtacgtacccgtaacgttccgttccgggtaccggggtaccctacggaaccgggtacggttaacgggaacgggaaaccgggttacgggttaacttacggttaaacgtttaacgtttaaccgtaccgacgtaacgttaccgttcggttaaacctttcgaaccgtaagttaacgagggttacggtaacggttaccgttagttacccggttaacggttaccggggaaaggttaccggaacggtaacgttccgtacgttaccgttaccgaaggtaccgaacccggtaacccgaacccgtaaccccg

SEQ ID NO: 233590 - DNA, 723 bp, Homo sapiens
  misc_feature: GYAE6OF01DWRTI.39.86.H09.1.454.CMB.1.raw
  modified_base (287)..(287): a, c, t, g, unknown or other
  misc_feature (287)..(287): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcaggcacgagggtcctgggcccagtctgccctgacctcaggctcgcctccgtgtcgtgggtctcgtaggacagtcgatcacatctctgcactaggaaccagcaggtcgtacggttggggttatgacttagtcgtctctacggtaccagacaatcnccgagcctacaccgaccccctaatcatctaattagtgtaacgtacaagttacgtccgtaccgttacgtacggggtttactacgtcgttccttcgttcgtcgtaccttaccgtaacgttccgacggtaaccaacccgtaccgggtccccttacccgtcgtaaccctacgttcctacggtcccggtacctcccgaaggccgttagggacggacggtacggtactacgttaacgtttacgttacgttcgtaccgtagtaccgtacgttacgttacgtaacgtaacgttaccgtaggtaccgtaggtttaccgttaggttacggttacggttaaaacggggttaggtaacccggggttaacccgtaacgggtacccttaacggttacccgggttaacctaaccgggttccccgaaccggtaacccccggtaaacccccgg

SEQ ID NO: 233591 - DNA, 651 bp, Homo sapiens
  misc_feature: GYAE6OF01AQARW.39.86.H09.1.454.CMB.1.raw
  modified_base (163)..(163): a, c, t, g, unknown or other
  misc_feature (163)..(163): n is a, c, g, or t
  modified_base (305)..(305): a, c, t, g, unknown or other
  misc_feature (305)..(305): n is a, c, g, or t
  modified_base (608)..(612): a, c, t, g, unknown or other
  misc_feature (608)..(612): n is a, c, g, or t
  modified_base (615)..(616): a, c, t, g, unknown or other
  misc_feature (615)..(616): n is a, c, g, or t
  modified_base (622)..(622): a, c, t, g, unknown or other
  misc_feature (622)..(622): n is a, c, g, or t
  modified_base (624)..(624): a, c, t, g, unknown or other
  misc_feature (624)..(624): n is a, c, g, or t
  modified_base (626)..(627): a, c, t, g, unknown or other
  misc_feature (626)..(627): n is a, c, g, or t
  modified_base (630)..(630): a, c, t, g, unknown or other
  misc_feature (630)..(630): n is a, c, g, or t
  modified_base (632)..(636): a, c, t, g, unknown or other
  misc_feature (632)..(636): n is a, c, g, or t
  modified_base (638)..(651): a, c, t, g, unknown or other
  misc_feature (638)..(651): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacacgcccccaaactcatctattttangaggtcaagtatccggccctgtaggggtttctaatcgtcttctctcggcctaccgaagtctcggaccaaaccgaccggtcccctcccgtacgaaccctcgttccgtcggtcgggtcctaccgaggcgtaggacgggaacggnggtaccttagtaactttacttacgtcgaccgtagtccttaacgttaagtaaaggaaagtaacggtacgaccgttacgttcgggttacgggttcgggtaccggggaccgggaacgggaacctaacggtccgttaaccggtaacccgttaacgtaacggtaccgaaccggtaacccgtacggtcccgttaccccggtcccccgttcggtacccttcccgttaccgtttcccggtccccctccctcctaccgtacgtcggtacggcctaggtcggacggtccggacgtacggacgacgcactaggnnnnnacnnctagcngntnngtnannnnngnnnnnnnnnnnnnn

SEQ ID NO: 233592 - DNA, 259 bp, Homo sapiens
  misc_feature: GYAE6OF01E1U24.39.86.H09.1.454.CMB.1.raw
  modified_base (250)..(259): a, c, t, g, unknown or other
  misc_feature (250)..(259): n is a, c, g, or t
tcagtcgcactagtcacgaccggtgctcgatttagtgctatagacttgggtttgggggggtttggtggtctccactcccgccttgacgaggctgattattactgcagctcatttgcaatcagtgaggcttatgtcttcggaagtgggaccaaggtcatcgtcctaggtcagcccaaggcccaaccccatgtcactctcgttcccgccctcctcactagtgcgactgacgcgggctggcaaggcgcatagnnnnnnnnnn

SEQ ID NO: 233593 - DNA, 784 bp, Homo sapiens
  misc_feature: GYAE6OF01C1UDO.39.86.H09.1.454.CMB.1.raw
  modified_base (184)..(184): a, c, t, g, unknown or other
  misc_feature (184)..(184): n is a, c, g, or t
  modified_base (245)..(245): a, c, t, g, unknown or other
  misc_feature (245)..(245): n is a, c, g, or t
  modified_base (326)..(326): a, c, t, g, unknown or other
  misc_feature (326)..(326): n is a, c, g, or t
tcagtcgcactagtcacgaccggtgctcgatttagtgctatagacttggggtttggggggggtctcaggaggcagcgctctcaggacatctccaccatggcctgggctctgctgctcctccaccctcctcactcgagggccacgacgggtccgtcgggcccaggtcctcggcccctagactcgnggcctcgtccctccgtgtcggtcgggtcttcgtaggacaggtcgactacaccatcctccgncacgtacgaaccgagcgtaggtagggtacggtttgggggttatcgtactgtcggtcctccgtaggtaccagactaaactcncgaaggacccaaccgtaccgaaccccctaatacaacttactaagtttacgaggtacgtactaacgttaccgtcccggtacgttacggttacgggtttaactacgttccgttccttccgtacggttacgaccgtaacgtaacggttcgtaccggaacaaccccggcccggttcctaccccgtacgaacccttacttccgtcggtccggtacccgtccggacggttacggacggaacggggtacgacgggttacgtagtttaacgtttaaacgtgtacggtactcgttaaccgtacgttacgtacgtaaccttagtaccgaggttaacggtacgttacgttacggttggttaaccggttacgggggtaaggttaacccggggaactttaaccgggttccgtaaccggtttccggaaaccggtacggttaaaccccgcccggtaaacccggaaacccccgg

SEQ ID NO: 233594 - DNA, 743 bp, Homo sapiens
  misc_feature: GYAE6OF01AVLRV.39.86.H09.1.454.CMB.1.raw
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctcgcctccgtgtcgtggtctctaggacagtcgactcaccatctcctgcactcggaaccagcaggtggtacggtttgggggttatgactagtgtcctccgtcgtaccagacaatactccgacggacaccaccgacccccaaactccatctactttagtaggacgtactagtaaccgtccggtcccttggtagggtttacctaacgttcgtctttccgtcgtacgtcctacgaacgttcgtacgggaccaaccgtacccggtcccttcccgtaccgtaccgtacgttcccgttaccgggtccgggtcccgttccggtacgggtccggttaccgggaacgggtaaccggtacgggtacgtttacgttaacgtttacttaacggtcgtaccgtacgtccttacgtagttttcgaacgttaacgtacgtaacggttggtaaccggttagtttacggttacgggtttaccggttaacggggtaaccgggtttacgggaaaccggttacggttaccgtaccggttacccggttaacggtaccggttaccggaacccgtaaccccggtaaacccggtaaccccg

SEQ ID NO: 233595 - DNA, 518 bp, Homo sapiens
  misc_feature: GYAE6OF01CORX2.39.86.H09.1.454.CMB.1.raw
  modified_base (177)..(177): a, c, t, g, unknown or other
  misc_feature (177)..(177): n is a, c, g, or t
  modified_base (272)..(272): a, c, t, g, unknown or other
  misc_feature (272)..(272): n is a, c, g, or t
  modified_base (280)..(280): a, c, t, g, unknown or other
  misc_feature (280)..(280): n is a, c, g, or t
  modified_base (489)..(518): a, c, t, g, unknown or other
  misc_feature (489)..(518): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatcaggcacagccccaaatcatcatttatgaggtcagtaatcggccctnaggggtttctaatcgcttctctggctcaagtctggcaacacggcctcctgaccatctacgtgggcctcaggctagaggagaggctgattattacngcagcctntatttcgactaatcaggtgtagtcttagtcgtcgttacggaaggtggaacctaaggtcaactttccggtccgtaagggtcaaccggacccaaagggacccctaaaccccgtatcggtaccaccgtttcctacgttacccccaccctctaccgaacgttagtcgacgacgtgcggacgggctagggacctaaaggggcctagaacgtagnnnnnnnnnnnnnnnnnnnnnnnnnnnnnn

SEQ ID NO: 233596 - DNA, 693 bp, Homo sapiens
  misc_feature: GYAE6OF01AZ264.39.86.H09.1.454.CMB.1.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
  modified_base (307)..(307): a, c, t, g, unknown or other
  misc_feature (307)..(307): n is a, c, g, or t
  modified_base (405)..(405): a, c, t, g, unknown or other
  misc_feature (405)..(405): n is a, c, g, or t
tcagtcgcactagtcacgaccggtgctcgatttagtgctatagacttgggggggggtctcaggaggcagcgctctcaggacatctccacatggcctgggctctgctgctcctcaccctcctcactcagggcacagggtcctgggcccagtctgccctgactcagcctgcctcgtgtctgggtctcctggacagtcnctcacatcctctgcactggaaccngcagtgacgtttggtagttacacgtatgtctccgtggtaccaaacaaccaccccggacaaaccgcccccgaagtcagtcgtatttanagtacgtcaactaacgtccggccctcgaggggttctactaactcgtcttcgtcgtcggtctaccgtagttctacggaccaaacgtccggcccttaccncgtaacctacgtccgttcgtcgggccttccggacggtcgtacggacggacggcggtacgtagtaactttacgttacgtcgactaacgtcctactaactttacttacgaaacgtacgtaacgttaaacgttcgtttacggttcccggttttaccggggaccggggtacgggtaacccgtaaaggtccgttacccgggtaccccgttacggttaaaccggtcccgtaacccggacccgtaaccgggtcccgtaccccggttacccccggttccggttcccgttaccccgg

SEQ ID NO: 233597 - DNA, 251 bp, Homo sapiens
  misc_feature: GYAE6OF01E2XPO.39.86.H09.1.454.CMB.1.raw
  modified_base (246)..(251): a, c, t, g, unknown or other
  misc_feature (246)..(251): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccatgtcactctgttcccaccctcctcactagtgcgactgagcgggctggacaaggcgcatagnnnnnn

SEQ ID NO: 233598 - DNA, 693 bp, Homo sapiens
  misc_feature: GYAE6OF01CNK2G.39.86.H09.1.454.CMB.1.raw
  modified_base (224)..(224): a, c, t, g, unknown or other
  misc_feature (224)..(224): n is a, c, g, or t
tcagtcgcactagtcacgaccggtgctcgatttagtgctatagacttggggggggggtctcaggaggcagcgctctcaggacatctccaccatggcctgggctctgctgctcctcaccctcctcactcagggcacgagggtcctgggcccagtctcgccctgactcagctgcctcgtgtctgggtctcgtagacagtcgatcaccatctctgcacgtggaaccngacagtggacggttggggttatgacttagtgttcctccgtaggtaccaagactaatactaccgaggaccaccgaacccgtaacccccctaaaatccaacttaccttaattttacggtacggtaacggttactaacggttaaaccgtccccggtcccgttacggttaacggggttttacctaacgttccgttctttcgtcgttcggaccttaccgtacgttcgtacggaccaaccgtacccggtccctccctagtaccctacgtccgtcggtcggacctcgtaggcgtagggacggacgtacgtacgtagttacgtttaactcgtcgacgtacgtcttacttattacgactaacgtcgtaggtagtcgttacgttgtacggttacgttaaggacgggtacgggtaacctgggtaccttacggttacccggtacgttacgggacaccccgaaaccggtcccgaaacccccg

SEQ ID NO: 233599 - DNA, 254 bp, Homo sapiens
  misc_feature: GYAE6OF01DW48C.39.86.H09.1.454.CMB.1.raw
  modified_base (246)..(254): a, c, t, g, unknown or other
  misc_feature (246)..(254): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggccaacccactgtcactctgttcccaccctcctcactagtgcgactgagcgggctggcaaggcgcatagnnnnnnnnn

SEQ ID NO: 233600 - DNA, 544 bp, Homo sapiens
  misc_feature: GYAE6OF01DI07R.39.86.H09.1.454.CMB.1.raw
  modified_base (256)..(256): a, c, t, g, unknown or other
  misc_feature (256)..(256): n is a, c, g, or t
  modified_base (520)..(544): a, c, t, g, unknown or other
  misc_feature (520)..(544): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacagcccccaaactcatcatttatgaggtcagtaatccggccctcaggggtttctaatcgcttctctggctccaagtctggcaacaccggcctccctgaccatctctgggcctccaggcngaggacgaggctgattattactgcagtctctatttcgactaaatcaggtgaggtcctttagtcgttcgtttacggaaggtacgggaaccctaagggtcctagtccgttccgtagggtaccacggaccccaaacgggaccccaaacccccacgttcgtacctaccttcccttccgtttccccctaccccttccctacctacgttacggtcgaccgacgtaggcgggccgggtaccgtgggaccgaacgggtaccgactagtacgnnnnnnnnnnnnnnnnnnnnnnnnn

SEQ ID NO: 233601 - DNA, 618 bp, Homo sapiens
  misc_feature: GYAE6OF01B4J0L.39.86.H09.1.454.CMB.1.raw
  modified_base (352)..(352): a, c, t, g, unknown or other
  misc_feature (352)..(352): n is a, c, g, or t
  modified_base (497)..(497): a, c, t, g, unknown or other
  misc_feature (497)..(497): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagacaatatccaggcacacgcccccaaactcatctatttatgagtcagtaatccggccctcgtagggtttctaagtcgtcttctntggcctcgatctggcaaccgacgccctccctgaaccctatctcgtcgggtcctaccgagggtctggacgggaacgtacgggcttagtatttaacgttactgcacggtcttactagtttacgactaatccgtaggtgtacgggttntttaacgtcggttaccgtttacggggtaaacggttaccgggggtaaacccgtaagggttccgtaacggttcccggttacccggttaacgggttacccgaccgggacccccgtaaacccggg

SEQ ID NO: 233602 - DNA, 654 bp, Homo sapiens
  misc_feature: GYAE6OF01EYXSK.39.86.H09.1.454.CMB.1.raw
  modified_base (204)..(204): a, c, t, g, unknown or other
  misc_feature (204)..(204): n is a, c, g, or t
  modified_base (237)..(237): a, c, t, g, unknown or other
  misc_feature (237)..(237): n is a, c, g, or t
  modified_base (522)..(522): a, c, t, g, unknown or other
  misc_feature (522)..(522): n is a, c, g, or t
  modified_base (578)..(578): a, c, t, g, unknown or other
  misc_feature (578)..(578): n is a, c, g, or t
  modified_base (593)..(593): a, c, t, g, unknown or other
  misc_feature (593)..(593): n is a, c, g, or t
  modified_base (617)..(617): a, c, t, g, unknown or other
  misc_feature (617)..(617): n is a, c, g, or t
tcagtcgcactagtcacgaccggtgctcgatttagtgctatagacttggggtttgggggggggtctcaggaggcagcgctctcaggacatctccaccatggcctgggctctgctgctcctcaccctcctcactcgagggcacgagggtcctgggcccagtctgccctgactcgaggctcgcctcgtgtcgtggtctcgtagacngtcgatcaccatccgtctgacacgtacgaaccngacgaggtcggtacggttggggtatcggtacttagttcgttaccctccgttaggaccagactaactaccgtccgaacggaccctaaccgaacccggtaacccccctaaagtcctattaccgttaagtttacgtaggtacgtaacaagttacccgtccggtacccgtaggttacgggtttactacgtcgttcttacgtcgtacgtcctacgtatccggacgacaccggtccgtaccctcgtactacctattcccgtgtacggactacggaggtcgtaggaaccggngtagtacgtagtaactttagactgtaccgcgttactacgttagtaccgagttacgngtaggtcgtacgttnttacgtcgttaggacgaggtacgngacgtctacgtcgtacagtaccgacgacccgtaaccg

SEQ ID NO: 233603 - DNA, 653 bp, Homo sapiens
  misc_feature: GYAE6OF01AGO45.39.86.H09.1.454.CMB.1.raw
  modified_base (303)..(303): a, c, t, g, unknown or other
  misc_feature (303)..(303): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgtacggttggggtatgactatgtctcctaggtaccagacaatatccgaggcacaccgaccccaatcatctattngagtcagtactccgcctagtacggttactacgtcgtcttctcgtcggtacctacgaagttctcggaccaccgtaccgtccctacccgtcgaccctagttccgtcgtcgggtccctaccgaggtcgtacgggacgggaccgggtagtacgtacggttaactttacttacggtacgaccttacggtacctttacgttacgtttacggaacctagtacggtagttacggtaacggttcctttaggttaccggtttaaccgttacgggggtaaagtaccggggtaaccttaacggggttacctacggtttacccgtacggttaacggttcccgacccggttaaccgaaccccgg

SEQ ID NO: 233604 - DNA, 567 bp, Homo sapiens
  misc_feature: GYAE6OF01EK73Y.39.86.H09.1.454.CMB.1.raw
  modified_base (249)..(249): a, c, t, g, unknown or other
  misc_feature (249)..(249): n is a, c, g, or t
  modified_base (308)..(308): a, c, t, g, unknown or other
  misc_feature (308)..(308): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccattctcctgcactggaaccagcagtgacgttgggggttangactatgtctcctggtaccagcaatatccaggcacacgacccccaaactcatcatttangagtctagtaatccggccctgaggggtttctaagtcgtcttctcgtcggctccaagttctggacaaacgaccggccttcccgtgaccctagtcgttcgtcggggtcttccgaagggtcttacgggacggtcggaggtctaggtactttattaacgtgactaagccttacactttgacctaatcgagtgagtccttatcgttcgttcgggaagttcggaaccaagtccaagttcgtacgtagtcgacgtcccgaaaccgg

SEQ ID NO: 233605 - DNA, 255 bp, Homo sapiens
  misc_feature: GYAE6OF01AWTEH.39.86.H09.1.454.CMB.1.raw
  modified_base (242)..(242): a, c, t, g, unknown or other
  misc_feature (242)..(242): n is a, c, g, or t
  modified_base (248)..(255): a, c, t, g, unknown or other
  misc_feature (248)..(255): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggccaaccccatgtcactctcgttccccaccctcctcactagtgcgactgagcgggctggcaaggcncatagnnnnnnnn

SEQ ID NO: 233606 - DNA, 797 bp, Homo sapiens
  misc_feature: GYAE6OF01AKLKI.39.86.H09.1.454.CMB.1.raw
  modified_base (338)..(338): a, c, t, g, unknown or other
  misc_feature (338)..(338): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctcgcctccgtgtcgtgggtctctaggacagtcgatccacctatcctcctgcctactggaaccagactaggtcggtacggtttgggggttatggaacttattcggttcctccgtggtaccagacaatactccaggccaccaccgacccccaaactcactcctatttacgngtacggtacaagttacgtccggtacctacggtaggggtttacctaacggttccgttcttaccgttcgtcggtaccttaccgtaacggttcctacgggacctaacccggtacccgggttaccccttccccggtacgtaaccccgtctttccccggttccgggttacggggtacccctacccgggtaggtacccgggttacggggaacggggtaaccgggtacgggtccgtttaagggttaacttttaccggtttactacgggtacccgtaccggtttaccgttaccttacgttttacgtacccgttaaagttccgtaacgggttacggtaacggttcgtttacgttaccgggttaccgttaacgggggttacgggttaccgggaaacccggttaggttaccgaccgtttaccgggttaccgtaccgggtacccgtaccggtaaccccggtaaacccccgg

SEQ ID NO: 233607 - DNA, 282 bp, Homo sapiens
  misc_feature: GYAE6OF01BITP2.39.86.H09.1.454.CMB.1.raw
  modified_base (247)..(282): a, c, t, g, unknown or other
  misc_feature (247)..(282): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggccaaccccatgtcactctgttcccgccctcctcactagtgcgactgagcgggctggcaaggccgcatagnnnnnnnnnnnnnnnnnnnnnnnnnnnnnnnnnnnn

SEQ ID NO: 233608 - DNA, 684 bp, Homo sapiens
  misc_feature: GYAE6OF01D91ZK.39.86.H09.1.454.CMB.1.raw
  modified_base (231)..(231): a, c, t, g, unknown or other
  misc_feature (231)..(231): n is a, c, g, or t
  modified_base (330)..(330): a, c, t, g, unknown or other
  misc_feature (330)..(330): n is a, c, g, or t
  modified_base (567)..(567): a, c, t, g, unknown or other
  misc_feature (567)..(567): n is a, c, g, or t
tcagtcgcactagtcacgaccggtgctcgatttagtgctatagacttggggggggggtctcaggaggcagcgctctcaggacatctccaccatggcctgggctctgctgctcctcaccctcctcactcagggcacgaggtcctgggcccagtctgccctgactcaggctgcctccgtgtcgtgggtctcgtaggacagtcgatccacctatcctcctgcacgtcggaaccngctaggtcggtacgggtttgggggttatgacttagtcgttcctccgtggtaccagactaatactccgaggaccacaccgaccccaatcatctatttagngagtacagtacgccgtcctaggttaggttactacgtccgtacttctcgtcggtcctaccgtaaggtccgtacggaccctaacggccccgttcccttacccgtacgaccttacgtccgtcggtcggtccctacggtacggtacgtaggacgggaccggtaggttacgtagtttactttaacgtcgtcgtactacgtcttacgttagttacgaactacgttcgaggtacggtacgtttnttacggttacggttacggtacgggtaacgggtaccggtaaccggtacggttcccgtacggtttacccggttaccggtacggaaccgtaccccggaccccgtaacccggtaacccccc

SEQ ID NO: 233609 - DNA, 540 bp, Homo sapiens
  misc_feature: GYAE6OF01CVUPK.39.86.H09.1.454.CMB.1.raw
  modified_base (220)..(220): a, c, t, g, unknown or other
  misc_feature (220)..(220): n is a, c, g, or t
  modified_base (268)..(268): a, c, t, g, unknown or other
  misc_feature (268)..(268): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (384)..(384): a, c, t, g, unknown or other
  misc_feature (384)..(384): n is a, c, g, or t
tcagtcgcactagtcacgaccggtgctcgatttagtgctatagacttgggctggggtctcaggaggcagcgctctcaggcatctccaccatggcctgggctctgctgctcctcaccctcctcactcaggcacagggtcctgggcccagtctgccctgactcaggctgcctccgtgtctgggtctctaggacagtcgatcaccatctcctgcatggaaccngcagtgtacggttggggttatgactatgtctcctggtaccagctaatntccaggcacacgaccccaaatcatctatttatgaggtctagtaacgtccggaccctcgtagggtttacctaagtcgtcttctcgtggctccagtcnggcacncgtcctcctagccntctcgtcggtcctacgtacggctagggacggacgacggtctgtaattacttacgtcgctacggtcttacgtactttgaactatcgaggtgacgtcgttagtcgtcgttacgggaagtcgggactaaggtctacgtcgtacgtacgcacgtaacccg

SEQ ID NO: 233610 - DNA, 698 bp, Homo sapiens
  misc_feature: GYAE6OF01EGKJF.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtggtacggttgggggttatggactagtgttcctccgtcggtaccagacaatatccaggcacaccgaccccaactcatctatttagagagtcagtaacgtccggtcccgtcgtacggggtttactaagtccgtccttacgtcgtcggtacctaccgtaacgttccgtacgtacccgaaaacgtccccggtaccccttacccgtaccgacccttaccgttccgttccgggtttaccgggccttcccgagggtcctagggtacgggacggtacgggtacttaggtaacttttacgtttacctgtccgtaagtccttacgttactttacgaacctacgtcgtaggttaggacgtttaccgtttagttcggttaccgggttaacgggttaacgggttacggggaaccgttaaacgggtccttacggttacccggttacggttaacggtcccgtacggacccgtaaaacccccggg

SEQ ID NO: 233611 - DNA, 605 bp, Homo sapiens
  misc_feature: GYAE6OF01AC8DK.39.86.H09.1.454.CMB.1.raw
  modified_base (246)..(246): a, c, t, g, unknown or other
  misc_feature (246)..(246): n is a, c, g, or t
  modified_base (311)..(311): a, c, t, g, unknown or other
  misc_feature (311)..(311): n is a, c, g, or t
  modified_base (385)..(385): a, c, t, g, unknown or other
  misc_feature (385)..(385): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctcgtaggacagtcgatcaccatctcctgcactggaaccagcagtgtacggttggggttangactatgtctccgtggtaccagcaatactccgaggccacaccgacccccaaatctatctatttangaggtcagtactccggcctgtagggtttctagtcgtcttcgtcgtgcctacgagtcgcggacacgccgcctccngacctatccgtcgtcggcctccgaggtcgtacggacggtacggacgtcgtagtatttactacgtgacgtcgtacctacgttacgtttacgactaatcgagtacggtacgtcgtttagtcggttacggttacgggtaaggttacgggtaacccgtaacgggttacctacggtttacccgtaccggttaacggtcccgtaaccggaccccggtaaaccccgg

SEQ ID NO: 233612 - DNA, 692 bp, Homo sapiens
  misc_feature: GYAE6OF01DIG06.39.86.H09.1.454.CMB.1.raw
  modified_base (243)..(243): a, c, t, g, unknown or other
  misc_feature (243)..(243): n is a, c, g, or t
  modified_base (269)..(269): a, c, t, g, unknown or other
  misc_feature (269)..(269): n is a, c, g, or t
  modified_base (307)..(307): a, c, t, g, unknown or other
  misc_feature (307)..(307): n is a, c, g, or t
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttangactatgtctcgtggtacagcaatanccaggccacaccgaccccctaaatctatactatttagnggacgtcaagtaacgtccgacccgttgtacgggtttctaacgttcgtcttcgtctggtacctccgtaagttccgtagggaccctaaacggtcccggtacccttaccccgtcgaaccctaacttccgtccgtaccgggtcctcccggtacggtacgtacgggaacggacggtaacggtccgtaggttaactttaacgttacgtacgtacgtacgtccttacgtacgttttacgaacgttaacgttacgtacggttacggtaccggttactttacggttcggtttaaccggtaacgggtaacggttaccgggaaacgtaacgggttacctacgttccgtttaccggtaacggttaccgaaccggtaccccgtaaccgggtaaccccc

SEQ ID NO: 233613 - DNA, 690 bp, Homo sapiens
  misc_feature: GYAE6OF01A8UDF.39.86.H09.1.454.CMB.1.raw
  modified_base (222)..(222): a, c, t, g, unknown or other
  misc_feature (222)..(222): n is a, c, g, or t
  modified_base (325)..(325): a, c, t, g, unknown or other
  misc_feature (325)..(325): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctcgtgtctgggtctctaggacagtcgatcacatcctcctgcctacncggaaccagctaggtggtacggttggggttatggactattgtcctcgtggtaccagactaatactcgaggaccaccaccgaccccaaactcattctaagtttntggtagtacagttaacgtccggtcctcggttaggggtttacaacgttctcttctcgtcgtctaccgaagttcgtcggaacctaaccgtccggtcccttaccgactaccctattccgtcgttcgggaccttccggacggtacggtacggtacgggacggtacgggtagttactttaacgtttaacgtttcggtacgtacggtaacctcgtttaacttccggttttacgaaccttaaacgttggtaggttaacggttcggttaccgtttagttacgggttttacgggttacggggtaacggtacgggtaaccgttaacggtgttaccgttacggtaccgttaggacccgaacgacccggaaaccccg

SEQ ID NO: 233614 - DNA, 322 bp, Homo sapiens
  misc_feature: GYAE6OF01B3SG4.39.86.H09.1.454.CMB.1.raw
  modified_base (139)..(139): a, c, t, g, unknown or other
  misc_feature (139)..(139): n is a, c, g, or t
  modified_base (192)..(192): a, c, t, g, unknown or other
  misc_feature (192)..(192): n is a, c, g, or t
  modified_base (254)..(255): a, c, t, g, unknown or other
  misc_feature (254)..(255): n is a, c, g, or t
  modified_base (258)..(322): a, c, t, g, unknown or other
  misc_feature (258)..(322): n is a, c, g, or t
tcagtcgcactagtcacgaccggtgctcgatttagtgctatagacttggggttttggggggggttttgggtgggtctccactcccgccttgacgaggctgattattactgcagctcatttgcaactcagtgaggcttangtcttggaagtggaccaaggtcatcgtctaggtcagcccaaggccaaaccccnctgtcactctcgttccccgcctcctcactagtgcactgagcgggctggacaaggcgcatagnntannnnnnnnnnnnnnnnnnnnnnnnnnnnnnnnnnnnnnnnnnnnnnnnnnnnnnnnnnnnnnnnn

SEQ ID NO: 233615 - DNA, 802 bp, Homo sapiens
  misc_feature: GYAE6OF01DJU8X.39.86.H09.1.454.CMB.1.raw
tcagtcgcactagtcacgaccggtgctcgatttagtgctatagacttggggttgggggtctcaggaggcagcgctctcaggacatctccaccatggcctgggctctgctgctcctcaccctcctcactcgagggcacgacgggtcctcgggcccagtctcgcctgactcgaggtctcgcctcgtgtcgtcgggtctcgtaggacacgtcgactaccacctacttcctcctacgctaacgtacggaaccaggccgtaggttcgggtacgggtttagggggttatacggtacttagttcgtccttaccgtacggtaccagactaactactccggaacgccaaccgacccgaacccctaactactacttacgttaaagttttagaggtaacggttacgtaacgtaccgtcccggttaccgttacgggttaccggtttactacgttccgttcgttacgtcgtcgtacctacggtagtccgtacggacctaaccgtccggtaccctaccgtctaccttacgtccgtcgtccgggtaccctaccggacggtcgtaacgggacggaacgtcggttaacttaggtttaacgtttacgtacgtcgtacgtaacgttccgttaaagtttcctaggtaaaccttaacggttacggtaacggttcgggttaacttttaccgttagggtttccgttaaccggggttaacgggtaaacggggtttacgggtaaacccggttaacgggttacctaaccggggtttacccgttaacggtaaccggtacccggaacccgaaaccccgggtaacccccgg

SEQ ID NO: 233616 - DNA, 859 bp, Homo sapiens
  misc_feature: GYAE6OF01CEVHG.39.86.H09.1.454.CMB.1.raw
tcagtcgcactagtcacgaccggtgctcgatttagtgctatagacttggggttgggggtctcaggaggcagcgctctcaggacatctccaccatggcctgggctctgctgctcctcaccctcctcactcagggcacgagggtcctgggcccagtctcgccctgactcgaggctgcctcgtgtcgtgggtctcgtaggacagtcgatcaccatctcctgacacgtaggaaccagcaggtcggtacgggtttaggggtatggtaacttagtcgttccttacccgtacgggttaaccagtactaaacttacgtacccgaaggaccctaaccgaccccggtaaacccccctaaaacgttcctaacgtttaccttaacgttttttaacggaggttaacggttaactaaacggtttaaccgtccccgggtacccgttagggtttaaccggggtttttaactaacgttcccgtttaccgtttccgttacgttcgggtacccttaaccggtaagttcccggtacggaaccctaaacccggtcccggtacccttaccccgtacgtaacccttacgttcccgttaccgggtcggtaccccgttaccggaaccggggttcgtaacgggaaccgggtacgggtaccggttacgttacgttaacttttaacgtaccgtcggtaacctacgttaccgtttacgttaacgtttccgaacttaaccgttggtaggtacgggttacgttacgttttacggttaccgggtttaacggttacggggaacggttacccgggtaaacgtacgggttaccctaaccgggtttcgttaacccgtagggttacccgaacccgggtaaccccggtaaacccccg

SEQ ID NO: 233617 - DNA, 817 bp, Homo sapiens
  misc_feature: GYAE6OF01BQR6S.39.86.H09.1.454.CMB.1.raw
  modified_base (173)..(173): a, c, t, g, unknown or other
  misc_feature (173)..(173): n is a, c, g, or t
  modified_base (223)..(223): a, c, t, g, unknown or other
  misc_feature (223)..(223): n is a, c, g, or t
  modified_base (249)..(249): a, c, t, g, unknown or other
  misc_feature (249)..(249): n is a, c, g, or t
  modified_base (318)..(318): a, c, t, g, unknown or other
  misc_feature (318)..(318): n is a, c, g, or t
  modified_base (363)..(363): a, c, t, g, unknown or other
  misc_feature (363)..(363): n is a, c, g, or t
tcagtcgcactagtcacgaccggtgctcgatttagtgctatagacttggggttggggggtctcaggaggcagcgctctcaggacatctccaccatggcctggtctctgctgctcctcaccctccgtcactcagggcacgtggggtcctcgggcccagtcctcgccctgactcnggtcctcgccttccggtgtacgtgggtctcgtaggcacgtcgatccaccnctacctcctagaccacgtaggaaccngctacggttaggtacgggtttggggttatcgtacgtatggttcctacgtacggtaccagtacaattacnccgaggtccaacgcccgaacccaactactactactacgtttacgngtacgtacgtaacgttaacgtccggttacccgtacggtacgggggtttacttaacgtccgtttctccgttacggtcggtaccgttaccgtacggttaccgtacggaaccgtaacccggtcccgggttacccctaacccgtcgaacccgttactttcccggtacggttaccggggccttaaccggcgggtacgtaacggggacggggtaacggtacggttcgtaacggttaacgtttaaccgttcgtaaccgggtacgtccggttaacctttcgttaaaccgtttacgaaacccgttacgtacggttacggtacgtacggtttaacttacgggttaccgggttacgggtttaccggggaagggttaacccgggggtaacgttaacccggtagttaaccccgtccgggttaccgttacccggaaccggtacccggtaaccccgttaaaccccgggg

SEQ ID NO: 233618 - DNA, 565 bp, Homo sapiens
  misc_feature: GYAE6OF01EAYFE.39.86.H09.1.454.CMB.1.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (297)..(297): a, c, t, g, unknown or other
  misc_feature (297)..(297): n is a, c, g, or t
  modified_base (361)..(361): a, c, t, g, unknown or other
  misc_feature (361)..(361): n is a, c, g, or t
  modified_base (377)..(377): a, c, t, g, unknown or other
  misc_feature (377)..(377): n is a, c, g, or t
  modified_base (384)..(384): a, c, t, g, unknown or other
  misc_feature (384)..(384): n is a, c, g, or t
  modified_base (431)..(431): a, c, t, g, unknown or other
  misc_feature (431)..(431): n is a, c, g, or t
tcagtcgcactagtcacgaccggtgctcgatttagtgctatagacttggggggggggtctcaggaggcagcgctctcaggacatctccaccatggcctgggctctgctgctcctcaccctcctcactcagggcacagggtcctgggcccagtctgccctgactcaggctcgcctccgtgtctgggtctctaggacagtcgatcacatctctgcactgaaccngcagtgtacggttggggtanagactatgtctccgtgtaccagcaatctcagcacacgaccccaatcatctattcnggagttcagtaactcgacctgtacgggttactatcgtcttccgtccggctaccagtctgcaacncggcctccctgacctntctacanactccgagtctaggaagcgaggtcctagtacttagttatgacgtacnctacgtataactgtaagtaagtataacgtagtaactcaagttcggcgttacgggttcggacggggtaacgacccggtaaggtttaccggacccgttacccggtagtacccggaactcccggtaacgggtccccg

SEQ ID NO: 233619 - DNA, 725 bp, Homo sapiens
  misc_feature: GYAE6OF01CUWHF.39.86.H09.1.454.CMB.1.raw
  modified_base (424)..(424): a, c, t, g, unknown or other
  misc_feature (424)..(424): n is a, c, g, or t
  modified_base (477)..(477): a, c, t, g, unknown or other
  misc_feature (477)..(477): n is a, c, g, or t
  modified_base (480)..(480): a, c, t, g, unknown or other
  misc_feature (480)..(480): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcacctcagggcacagggtcctgggcccagtctgccctgacctcaggctcgcctccgtgtcgtgggtctcgtaggacagtcgactcacctatctcctgcacgtggaccagcagtgtacggttggggtatgactatgtctcctggtacagcaatcaccaggcctacaccgaccccaactcactactatttgaggtacgtcaagtacgtccgggtcccctaggttaggttttactaactcgtccttcgtcgtcggtcctaccgaattcgtacggacctaacgcccggtccctacccagaccctntccgtcgtcggcctccgagtcgtgaggacgtagtccttagtacttaacgtcgngcncggtacctacgtttagttccgacgtaacgttaccgttaggtaaccgggttagtttaccttttaggtcccgttttaaccggggttaaccgggtaaccgggggtttaacccgggttaaaccccgggttaaaacgggttcccccgtttaacccgggttttaaacccccggggggtttacccccgttttaaagggaaccccccccgggttaaacccggggtaaccccccccggtttaaaaacccccggg

SEQ ID NO: 233620 - DNA, 735 bp, Homo sapiens
  misc_feature: GYAE6OF01BM8YO.39.86.H09.1.454.CMB.1.raw
  modified_base (338)..(338): a, c, t, g, unknown or other
  misc_feature (338)..(338): n is a, c, g, or t
tcagtcgcactagtcacgaccggtgctcgatttagtgctatagacttgggtttgggggggtgtctcaggaggcagcgctctcaggacatctccaccatggcctgggctctgctgctcctcaccctcctcactcagggcacagggtcctgggcccagtctgccctgactcaggctgcctcgtgtcgtgggtctctaggacagtcgatccacatctcctgcacgtcggaaccagcagtgtacggttgggggttatcgtacttagtgtcctccgtacggtaccaggactaactactacccgaggccaccgaccgacccccaaactcctatactaatttagngaacggttacaaggttaacgtccggtacccttggtacgggtttactagtccgtacttctacgtcggtcctacgtacgtcgtacggaccaaaccgtcccggtccccttacccgtacgtaccctacgtttccgtacgggttccgggtccctaccggacgggtccgtacgggaacgggtaaccggtacgggttactaggttaactttaacgttaccgtcggtctaacgtccttacgttagtttaccgaactagttaccgtaggtacggtacggttcttacggttacggttccggtttaacggggtaacgggttcccggggtaaaccgttaaacggggttccctaacgggtttacccgtttaacccggttacgggttaacccgaacccggtaaacccccgg

SEQ ID NO: 233621 - DNA, 765 bp, Homo sapiens
  misc_feature: GYAE6OF01CXZZH.39.86.H09.1.454.CMB.1.raw
tcagtcgcactagtcacgaccggtgctcgatttagtgctatagacttgggttggggggtctcaggaggcagcgctctcaggacatctccaccatggcctgggctctgctgctcctcaccctcctcacctcgagggcacgacgggtccgtcgggcccagtctcgccctgactcaggctcgcctccgtgtcgtgggtctcgtaggacagtcgactaccacctattcctccgtcgaccgtacgtacggaaccaggtcgtaaggttcgggtaacggggttttgggggttaactacggtaacgttacgttcggtacccgttccgtacggtaaccgagtaacctaataccgtacccggaaggacccgaaccacccgaaccccctaaacctcctaactacttaagtttacgtacggttaacggtacgtaacggttaaccgtccccgggtacccgttacgggttaaccggggttttactaaaccgttccgttacccgttcgtccggtacggtaccctacgtaaccggttcgtacggtaccgtaaccgacccggtccctacccgacgtacctaccgttccgtcgtccgggccgtaccggtacgtaccggtagggacgggtacggtcggtacgtagttaactttaacgtaacgtcgacgtacggtacttacgtagtttacgacttaacaggtacgtgtacgttacgtgttaccggtacgtaggtacggtacggtactacgtcgtacgtcgtacgtagccgaccgccggtaacccg

SEQ ID NO: 233622 - DNA, 722 bp, Homo sapiens
  misc_feature: GYAE6OF01BOV7E.39.86.H09.1.454.CMB.1.raw
  modified_base (185)..(185): a, c, t, g, unknown or other
  misc_feature (185)..(185): n is a, c, g, or t
  modified_base (442)..(442): a, c, t, g, unknown or other
  misc_feature (442)..(442): n is a, c, g, or t
tcagtcgcactagtcacgaccggtgctcgatttagtgctatagacttgggttgggggtctcaggaggcagcgctctcaggacatctccaccatggcctggctctgctgctcctcaccctcctcactcagggcacagggtcctggcccagtctgcctgactcaggctgcctcgtgtcgtgggtctntaggctagtcggatcaccgatcctctgccacgtacggaaccagcgagtcggacgttgggggttatgacttagtgttcgtcccgtaggaccagctaatacgtccgaggccacgaccacccccaaagtcatactacttagtagacggtactaagtaacgtccggacccgttacgtaggggtttactaacgttcgtctttcgtacgtcggacccttacgtaacgtccgtaggacctaaccgaccgggtcccttacccgtnaacccgtacttccgtccgttacgggccctaccgacggtacgttacggacggtacggaacgtgtacgttaattacgttaacgtcggtaccaagttcctagtttaaccgtttacgaaccttaggttaccgtacggtacggtaaacgtttcccttagggtttacggttacggttacgggggtaaccggtaacggggtaacccgttaagggtacccttaaccggttaccccgggtttaacgttacccgggtaacccgtaacccgtaaccccggtaaacccccgg

SEQ ID NO: 233623 - DNA, 670 bp, Homo sapiens
  misc_feature: GYAE6OF01DSY0N.39.86.H09.1.454.CMB.1.raw
  modified_base (311)..(311): a, c, t, g, unknown or other
  misc_feature (311)..(311): n is a, c, g, or t
  modified_base (567)..(567): a, c, t, g, unknown or other
  misc_feature (567)..(567): n is a, c, g, or t
tcagtcgcactagtcacgaccggtgctcgatttagtgctatagacttggggtttggggggggtctcaggaggcagcgctctcaggacatctccaccatggcctgggctctgctgctcctcaccctcctcactcgaggcacgagggtcctgggcccagtctcgccctgactcgaggctcgcctcgtgtcgtgggtctcgtaggacagtcgactcactactcctccgtgcctacgtacggaaacctgctagggtcggtacggggtttaggggttatgtaactagtcgtccgtacgtaggtaccagactaatcnccgaagccacaccgaacccctaatcatctattacgagtagtactaagtacgtccgcctggttacggttactagctcgttctcgtacgtcctacggtacgtcgacgtacaaccgccgtccctccctagaccctatccgtcggtacggtaccctcgtaacggcgtaggaaccgggtacggtcggtacttagtaactttacgtcgtcgaacgtccgttacttacgttagttacgaccttaagtacggagtaggtacgtntttacggtacgttacgggtacgggaacggggttaccgaacggttacgggtaccaccgggttttccgtaccggtacgtacggacccggaaccctaaaccccggg

SEQ ID NO: 233624 - DNA, 689 bp, Homo sapiens
  misc_feature: GYAE6OF01BT7V5.39.86.H09.1.454.CMB.1.raw
  modified_base (230)..(231): a, c, t, g, unknown or other
  misc_feature (230)..(231): n is a, c, g, or t
  modified_base (279)..(279): a, c, t, g, unknown or other
  misc_feature (279)..(279): n is a, c, g, or t
  modified_base (311)..(311): a, c, t, g, unknown or other
  misc_feature (311)..(311): n is a, c, g, or t
  modified_base (319)..(319): a, c, t, g, unknown or other
  misc_feature (319)..(319): n is a, c, g, or t
tcagtcgcactagtcacgaccggtgctcgatttagtgctatagacttgggtttggggggggtctcgaggaggcagcgctctcaggacatctccaccatggcctgggctctgctgctcctcaccctcctcactcaggcacagggtcctgggcccagtctgccctgactcaggctcgcctccggtgtccgtgggtctcgtaggcagtcgatcacatctctgcacgtgaaccnncagtggtacgttggggtatgactagtgtactcgtggtacagctaatanccgaggacacacgaccccaaatcactctattntagacgtnagtacgtccgaccttggtaggtttactattcgcttccgtcgtcggacctagtaacgtcgtacgaccaaaccgtccggtcccttaccgtacgtacgtaactcggttaccgttccgggccttaccgtacgggcgttacgggaacgacggtacgggtacttagttaaccgtttaatttaccgagtacggtacctacgttctaacgttttcgaacgttaacgtaccgtaggtaccggttaagtcgttttaaaggtccgggtttacggttaacggggtacgggttacggttaaaccccgggaggttaaccttacgggttacccttacccgggtttaaaaggccccggtaaacggtaaccccgtaaacccccgggg

SEQ ID NO: 233625 - DNA, 736 bp, Homo sapiens
  misc_feature: GYAE6OF01EXAU7.39.86.H09.1.454.CMB.1.raw
tcagtcgcactagtcacgaccggtgctcgatttagtgctatagacttggggttggggggtctcagggaggcagcgctctcaggacatctccaccatggcctgggctctgctgctcctccaccctcctcactcgagggcacgagggtcctgggcccagtcctgccctgactcaggctcgcctccgtgtcgtcgggtctcgtaaggactaggtcgatccacctattcctcctgccacgtacggaacccagcgaggtggtacggggtttggggttatcgtacgtatcgtcctccgtaggtaccagactaatcgtcgaggccacgaccgaccccaatcatctattgagtagtactacgtacgtccggtacccgttcgtaggggtttacacgttccgtacttccgtcgtacggtcctaccgtacgtccgtacggaaccaacccgtccggcccttacccacggtaccctacgttccgtaccggtacgggtccctcccgggtaacgggtcgtaccggggaacggtacggtaccgggttagttaaccggtttaatttaccgtttaccgtgggtacctacggttccttacgttaccgtttaggaaccttacggtaccggtaagggttacggtacggttaccggttttagaccgggtttaacgggttacggaaggggtttaccggaaccgttacggtacctacggttccgttaccggacggtcccgaccggtaccccgaaacccgg

SEQ ID NO: 233626 - DNA, 755 bp, Homo sapiens
  misc_feature: GYAE6OF01DTMXJ.39.86.H09.1.454.CMB.1.raw
  modified_base (232)..(232): a, c, t, g, unknown or other
  misc_feature (232)..(232): n is a, c, g, or t
tcagtcgcactagtcacgaccggtgctcgatttagtgctatagacttgggttgggggtctcaggaggcagcgctctcaggacatctccaccatggcctgggctctgctgcctcctcaccctcctcactcgagggcacgacgggtccgtgggcccaggtctcgccctgactcaggctcgcctccgtgtctgggtctctaggcagtcgatcaccatctcctgcacgaggaaccngcaggtacggtacggttggggttatgtacgtagtcgtctccgtacgtaccgagtacaacgtactacgacggacaaccgaccgtaaccccaacttcaacttctaactttaagcgtaacgtacgtaaacgttaccgtaccggtaccgttacggttacgggtttacgtaactcgtccgttacttccgtacggtacctaccgtaacgtcgtacgtaaccgaaccgaccggttccctacccgtaaccgtaccctacgttccgttacggtccggtacccgtacgtggtacgtacggacgtacggtacggtacttacggttacttacgttacgtacgtcgtaacgtaccttacgttagttaccgtaacgttacgtacggttaggtacgggttaacgtttagtttaccggttcgtttaacgggttaccgggtaaacgggtttaccggtaaaccggttacggttaccgttaccggttaccggttaaccgggttaccggtaacccgacccgttaaccccgggtaaacccccgg

SEQ ID NO: 233627 - DNA, 676 bp, Homo sapiens
  misc_feature: GYAE6OF01BTCZY.39.86.H09.1.454.CMB.1.raw
  modified_base (316)..(316): a, c, t, g, unknown or other
  misc_feature (316)..(316): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcacgtcggaaccagcagtggtacggttggggttatgtactatcgtcctcgtggtaccagacaatctccgaggcacaccgaccccaatcatctatttangtagtacagtacgtccgtcctcggtagggtttacaacgtcgtcttcgtcgtcgtaccttacgaacgttccgtacggacccgaaaccgtcccggtaccccttaccccgtacgaaccccttacgttcccgttaccgggtccggtcccttacccgggaggtccgtagggaacggggtaccgtacgggtccttaaggttactttacgttacgacgtacgtcgtccttacgttagtttaccgaactacgttacgtaggtggtagttctttaggtccgttacggttacgggtaggtaccgggtaacgtaacgggttctaccgttccggtaaccgtacggtaccgtaccggaaccccgtaaccccgg

SEQ ID NO: 233628 - DNA, 645 bp, Homo sapiens
  misc_feature: GYAE6OF01EN0GM.39.86.H09.1.454.CMB.1.raw
  modified_base (225)..(225): a, c, t, g, unknown or other
  misc_feature (225)..(225): n is a, c, g, or t
  modified_base (315)..(315): a, c, t, g, unknown or other
  misc_feature (315)..(315): n is a, c, g, or t
  modified_base (467)..(467): a, c, t, g, unknown or other
  misc_feature (467)..(467): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcacgtggaaccngcagtggtacggttgggggttatgactagtcgccttccgtggtaccagactaatactccgaggcacaccgaccccaaatcatctatttangagtacagtaactcggcctgtagggtttactactcgtcttcgtcgtcggtcctaccgagttcgtacggacaacgccggtccctcccgtacgacctactcctcggtcggtccaccgagtcgtaggagggaacgcggtctagtacttagttacncgtacacgtactcgtacgtttacactaacgtcgtaaggtggtaacgttcgtttacgttacggttaccggtttagggttaaacgggtacggggtaaacccttaacgggttacccgttaacgttacccggttaacccggttaagggtaaccctaacccgggtcccccgtaaaaccccggg

SEQ ID NO: 233629 - DNA, 272 bp, Homo sapiens
  misc_feature: GYAE6OF01C8G00.39.86.H09.1.454.CMB.1.raw
  modified_base (261)..(272): a, c, t, g, unknown or other
  misc_feature (261)..(272): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcacgcccaaggcccaaccccactgtcactctcgttccccaccctcctcactagtcgcgtactggacggccgggctcgggcgaaggcgacaatgnnnnnnnnnnnn

SEQ ID NO: 233630 - DNA, 590 bp, Homo sapiens
  misc_feature: GYAE6OF01AJAGR.39.86.H09.1.454.CMB.1.raw
  modified_base (159)..(159): a, c, t, g, unknown or other
  misc_feature (159)..(159): n is a, c, g, or t
  modified_base (170)..(170): a, c, t, g, unknown or other
  misc_feature (170)..(170): n is a, c, g, or t
  modified_base (441)..(441): a, c, t, g, unknown or other
  misc_feature (441)..(441): n is a, c, g, or t
  modified_base (474)..(474): a, c, t, g, unknown or other
  misc_feature (474)..(474): n is a, c, g, or t
  modified_base (557)..(557): a, c, t, g, unknown or other
  misc_feature (557)..(557): n is a, c, g, or t
  modified_base (559)..(566): a, c, t, g, unknown or other
  misc_feature (559)..(566): n is a, c, g, or t
  modified_base (568)..(575): a, c, t, g, unknown or other
  misc_feature (568)..(575): n is a, c, g, or t
  modified_base (577)..(590): a, c, t, g, unknown or other
  misc_feature (577)..(590): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacacgaccccaaatcatcattangagtcagtacncggccctcgagggtttctaatcgcttctctggctcgagtctggaccaacgccggccctccctagacctatccgtccgtggccttccggagccgtggaggaccgaggtcgtataatttacttcgtacgcacgcttacgtatttcgaccttaagtcgaacggtggaacggttctttagtggttttaccgttagggaagggtccgggaaacctacgggtctaccgttccgttaccgaggttacccaacggccccgaaacggccccaaaccccgngttcctaccctacctttccctccgttaaccccnccccttaccgtaacctacccgttacggcgtaccggacgtacggccggtcgggcgtacggtaccgacggcccgagtacagctancnnnnnnnncnnnnnnnngnnnnnnnnnnnnnn

SEQ ID NO: 233631 - DNA, 704 bp, Homo sapiens
  misc_feature: GYAE6OF01BK55K.39.86.H09.1.454.CMB.1.raw
  modified_base (178)..(178): a, c, t, g, unknown or other
  misc_feature (178)..(178): n is a, c, g, or t
  modified_base (274)..(274): a, c, t, g, unknown or other
  misc_feature (274)..(274): n is a, c, g, or t
  modified_base (414)..(414): a, c, t, g, unknown or other
  misc_feature (414)..(414): n is a, c, g, or t
tcagtcgcactagtcacgaccggtgctcgatttagtgctatagacttggggtttgggggggggtctcaggaggcagcgctctcaggacatctccaccatggcctgggctctgctgctcctcaccctcctcactcgagggccacgagggtccgtcgggcccagtctcgccctgactcgnggctcgcctcgtgtcgtgggtactcgtaggacagtcgatccaccatcctcctgactacgtacggaaccagcgtaggtggtacgggtttggggttanggtactagtcgtcctcgtagtaaccagtactaatacgtccgaaggccaaccgacctaacccccaattaccattactacgtttacgaggtacgtataacggtacctccggtacccgttaggtaccggtttactactccgtnttccgtcgtacggtccctaagtacgtcgtacggacctaccgtaccgtcctacgtaccgtaactcgtccgttacgggtcggtaccctacggaggttaccgagggaaccgggtaacggtcggttacgttagttacgtttacgtcgtaacggtaactcgtaccgtttagtagtttaccagttaacgttacgaggtcggtagtttacgttacggttacgttccgggaacgggtagtaccggtaactagggtactacggttccgtacgtaaggtccaaaccgggtcctaaccccg

SEQ ID NO: 233632 - DNA, 681 bp, Homo sapiens
  misc_feature: GYAE6OF01AL4I4.39.86.H09.1.454.CMB.1.raw
  modified_base (211)..(211): a, c, t, g, unknown or other
  misc_feature (211)..(211): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcaggcacagggtcctcgggcccagtctgccctgactcaggctgcctccgtgtctgggtctctaggacagtcgatccaccattcncctgcactcggaaccagcaggtcggtacggttgggggttactgtacgtatggtctccgtcggtaccacgactaactactccgacggaccaaccgaccgacccccctaaactcctaacttcttaacttttagtacggtaacggttctaacggttaaacgtcccggtacccgtacggttacgggtttactaacgttcgtacttcgtctcggctaccgaagttccgacgacaccgtaccggtccctcctacgaacctcgtcgtacgtcggtaccgtaccgtaggtcggtacggacgggtacggtacgtcgttacgtaactttacgtacgtcgtcgtacgtacttcgttattacgactacgttacgtaggtggtacgtacgtttagttacggttaccggtacggttacgggtacggaccgtacggttacttacgttccggtacgttacggtaaccgacggtcccgaaaccccgg

SEQ ID NO: 233633 - DNA, 326 bp, Homo sapiens
  misc_feature: GYAE6OF01CCXK0.39.86.H09.1.454.CMB.1.raw
  modified_base (265)..(267): a, c, t, g, unknown or other
  misc_feature (265)..(267): n is a, c, g, or t
  modified_base (269)..(326): a, c, t, g, unknown or other
  misc_feature (269)..(326): n is a, c, g, or t
tcagtcgcactagtcacgaccggtgctcgatttagtgctatagacttggggtttggggggtttggtggtctccactcccgccttgacgaggctgattattactgcagctcatttgcaatcagtgaggcttatgtcttcgggaagtggaccaaggtcatcgtcctaggtcacgcccaaggccaaccccatgccactctcgttcccccacctcctcactagtcgctaactgaggccgggtagtcgggactaaacggcgacagtagcnnncnnnnnnnnnnnnnnnnnnnnnnnnnnnnnnnnnnnnnnnnnnnnnnnnnnnnnnnnnn

SEQ ID NO: 233634 - DNA, 618 bp, Homo sapiens
  misc_feature: GYAE6OF01EJZKZ.39.86.H09.1.454.CMB.1.raw
  modified_base (159)..(159): a, c, t, g, unknown or other
  misc_feature (159)..(159): n is a, c, g, or t
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (267)..(267): a, c, t, g, unknown or other
  misc_feature (267)..(267): n is a, c, g, or t
  modified_base (303)..(303): a, c, t, g, unknown or other
  misc_feature (303)..(303): n is a, c, g, or t
tcagtcgcactagtcacgaccggtgctcgatttagtgctatagacttggggggggtctcaggaggcagcgctctcaggacatctccaccatggcctggctctgctgctcctcaccctcctcactcaggcacagggtcctggcccagtctgccctgactnaggctgcctcgtgtctggtctctaggacagtcgatcaccatctcctncactggaacngcagtgagttggggtatgactagtgtccttccgtggtaccagccaattacnccgaggcaccacgacccccaaatcatctatttacgngacggtcaagtactcggcctgtagggttctactcgacttcgtactggcctacgtacgtccgtagaccgtaacgaccggtcccttaccgcgtaaccctagttcctacggtccgggtaccttcccggacggtccgttacgggaacggtaccgggtacgtcgtaagttacttaacttaacgtcgaccgtcgtacgtactaactttgactaaagttcgacggtacgtcggtactttacgtcgtacggttaacgtacgggtacgaaccgtaggtccgtacgtaccgtacgtacgtaccgaaccgcgaacccgtaaccccg

SEQ ID NO: 233635 - DNA, 663 bp, Homo sapiens
  misc_feature: GYAE6OF01EHZC0.39.86.H09.1.454.CMB.1.raw
  modified_base (312)..(312): a, c, t, g, unknown or other
  misc_feature (312)..(312): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaccagcagtgacgttgggggttatgactatgtctcctggtaccagcaatatccaggcacacgacccccaaatcatcatttatgagtcagtaancgacctcgtcggttactacgtcgtcttctcgtcgtccactacgtctggactaacaccggtcctccgtacacctatcctacgtcggtcctaccgtacggctaacggacggtaacgggacggtcgtacggttaacttactttaacgtacgtacgtaacgtaccgtacctttacggtttacgaaccgttaacttacgtacgggttacggtacgggttaccgtttacggtaaccgttttcgggttaaacgggttaacgggggtaaccggtaaaccgggtaaccggtaacggttaccgttacccgggttaccgtaacggtttaccggtaaacccggtacccgggtaaaacccccgg

SEQ ID NO: 233636 - DNA, 722 bp, Homo sapiens
  misc_feature: GYAE6OF01BGI50.39.86.H09.1.454.CMB.1.raw
  modified_base (227)..(227): a, c, t, g, unknown or other
  misc_feature (227)..(227): n is a, c, g, or t
  modified_base (573)..(573): a, c, t, g, unknown or other
  misc_feature (573)..(573): n is a, c, g, or t
tcagtcgcactagtcacgaccggtgctcgatttagtgctatagactttgggttgggggtctcaggaggcagcgctctcaggacatctccaccatggcctgggctctgctgctcctcaccctcctcactcagggcacagggtcctgggcccagtctgccctgacctcgaggctgcctcgtgtcgtgggtctctaggacagtcgatcaccatctcctgcacgtgaaccngcagtcgtacggttggggttatgtactagtcgtctcgtaggtaccagactaatacgtcgagaccacgaccgaccccctaaatcgaacttctaagtttacggaggtacggtactaaggtacctcccggtacccgttacgggttaacggggtttacctaacgttccgttacgtttccgtacgtacgggtaccttaaccgtaacggttcgtacggaacctaacccggtacccggtcccttacccgtaaccgacccttacgtcccttacggtacggtacccttaccggtacggtccgtaaggtaccgggaacggtacggtacttaacggtaacttttacgtacgcgtacncgttacttacgtagttacgaacttaagtcgtaggtcgacggtttacttacgttacggttacggttaacgggaacgggtacggtaaaccgtaacggttacttacggttaccgttacgtacgggtacctaaccggaccccggtaaacccgg

SEQ ID NO: 233637 - DNA, 699 bp, Homo sapiens
  misc_feature: GYAE6OF01AMNMC.39.86.H09.1.454.CMB.1.raw
tcagtcgcactagtcacgaccggtgctcgatttagtgctatagacttgggtttgggggctggggtctcaggaggcagcgctctcaggacatctccaccatggcctgggctctgctgctcctcaccctcctcactcgagggcacagggtcctgggcccagtctcgccctgactcaggctgcctccgtgtcgtgggtctcgtaggacagtcgatccacctatcctcctgaccacgtcggaaccagcgaggtcggtacgggtttagggggttactgtaacttagtcggttccttccggtacggttaacccgaagtacctaaactacgtacccgacgggtaccaacccgaacccgacccccctaaaaccgtctaaacgtttacttaagttttacgtaggtaacggttacgtaacggttaaacgtcccggtaccccgttacggttacggggtttactacgttccgtctttctccgtggtcctaccgtagtcgtacgactaaccgaccgtccctccgtactacctagtctcggtcgctacgtacggcagggaaggcggtagtcgtagtacttacgtcgtcgaccgtagtccttagttacttagactagtacgaggttagtacggttgttaacgttcggttacgttacgggtaacgtaccgggaccgttacggtcgtacggttaccgtacgtcggtccgaccccgg

SEQ ID NO: 233638 - DNA, 836 bp, Homo sapiens
  misc_feature: GYAE6OF01D9B5D.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctccaccctcctcactcagggcacgacgggtcctcgggcccagtctcgccctgactcaggctcgcctcgtgtcgtggtctcgtaggacagtcgatccaccactctcctgcctacgtacggaaccagcgagtggtacggttgggggtatcgtaactgtcgtccgtccgtacggtaccagactaactacgtaccgaaggtcccaaccgacccgaaccccctaaaacgtcctaacttacttaagttttaggacggttaaggtaccgtaaacggtttaaccgtccccgggtacccgtttaacgggtttaacgggggttttaaccttaacgttccgttcctttcccgttcgtaccggttaccttaacccggtaacggttcccggtacggaacccgtaacccggtacccggtaccctacccgtacgtaccccttacgttccgttccggtaccggtccctaccggacgggtcgtacgggaacggtaccggtaacggtcttaggttaacttacttaccgcgtactcgttaccgtactttacgttaccggtaacttaacgttcggtaacgggttacgttacgggtttactttacgggttacggtttaaccggggttaacgggttaaacccggggtacgggtaaacccgggttaaccggtttaccggtaacggtttcccgggttaacccggttaacgggtaccccgaacccgtaaaccccgggtaaacccccgg

SEQ ID NO: 233639 - DNA, 758 bp, Homo sapiens
  misc_feature: GYAE6OF01DR1Z8.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctcgccctgactcgaggctcgcctcgtgtcgtgggtctcgtaggacagtcgactaccgacctactccttccgtgcctaccgtacggaaacccagtcctaggtgggtacggggtttgggggttaactggtacttattcggtcctccgttacgggttaaccagtacaacttacaccggaaggccaaccgaccccgaacccccaaaacttccaactttacttaattttaacgtaggtacgttacgtaaacggttaccggtcccggtacccgtttacggtaccggggttttacctaacgttccgtcctttccgtcgtcggttccctaccggtaagttccggtacggaacccaaccggtcccggtccccttacccgggtataaccccgttcgtccttccgggacggggtccccttacgggacgggttacgcgggacgggtacggacgtactaggttactttacgtaccgtgccgtagtcttacctatttcgaactacgttagacgggttagtaccgttacgttacggttccgttagggttaacgggtaacggcggtaacttacggtccttagttcccgtacgtaccgacgccgtacccggtaacccg

SEQ ID NO: 233640 - DNA, 270 bp, Homo sapiens
  misc_feature: GYAE6OF01DRDKW.39.86.H09.1.454.CMB.1.raw
  modified_base (258)..(270): a, c, t, g, unknown or other
  misc_feature (258)..(270): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggtcttatgtcttcggaagtgggaccaaggtcatccgtcctaggtcacgcccaaggcccaaccccatgtcactctcgttccccgccctctcactagtgacagtgacggcgggctcggacgaaggtcgacagagnnnnnnnnnnnnn

SEQ ID NO: 233641 - DNA, 723 bp, Homo sapiens
  misc_feature: GYAE6OF01E05XQ.39.86.H09.1.454.CMB.1.raw
  modified_base (237)..(237): a, c, t, g, unknown or other
  misc_feature (237)..(237): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacgagggtcctgggcccagtctcgccctgactcgaggctcgcctccgtgtcgtgggtctcgtaggactagtcgactcaccatcctcctgccacgtacggaaccngctaggtggtacgggtttgggggttatagtacttagttcgtccgtaccgttacggtaaccagtactaagttaccaccgaacggaccaaccgaaccccggtaacccccctaaaattcctaacttactaacgttttagacgggtacgtaccgtaaggtaaccgtcccggtacccgttacgggttaacggggtttacctaaccgtccgttaccgtttccgttcgtaccggtccttaaccgtaagttccgtacggacctaaccggcccgtaccctcccgtacgaccctacgtcctcggtacgggcctaccgacgggtcgtaacggacgggtacgtacggtcgttacgttaacgtttacgttaacgcgtactcgtactacgttgttacacgtacgtagtagtcggttagttactttcggtacggttaccggttagggtaacggtcggtaacgtagtcgtacgtccgtacgtacgcaccgtaccgtaacccg

SEQ ID NO: 233642 - DNA, 732 bp, Homo sapiens
  misc_feature: GYAE6OF01C3XUY.39.86.H09.1.454.CMB.1.raw
  modified_base (140)..(140): a, c, t, g, unknown or other
  misc_feature (140)..(140): n is a, c, g, or t
  modified_base (203)..(203): a, c, t, g, unknown or other
  misc_feature (203)..(203): n is a, c, g, or t
  modified_base (209)..(209): a, c, t, g, unknown or other
  misc_feature (209)..(209): n is a, c, g, or t
  modified_base (323)..(323): a, c, t, g, unknown or other
  misc_feature (323)..(323): n is a, c, g, or t
  modified_base (580)..(580): a, c, t, g, unknown or other
  misc_feature (580)..(580): n is a, c, g, or t
  modified_base (717)..(717): a, c, t, g, unknown or other
  misc_feature (717)..(717): n is a, c, g, or t
tcagtcgcactagtcacgaccggtgctcgatttagtgctatagactttgggttgggggtctcaggaggcagcgctctcaggacatctccaccatggcctgggctctgctgctcctcaccctcctcactcgagggcaacgngggtcctgggcccagtcctcgccctgactcgaggctcgcctccgtgtcgtggtctacaggacngtacgntcacctatcctctgcacgtacggaacctagccgtaggtcgggtaacgggtttgggggttatacggtacttagtccggtccttccgtacggtaaccacgtactaactacacccgngtaccgaaccgaccccgaaacccctaacgtactacttactttaagtttagtacggtaacggtctaaacgtaccgtccccggtacccgttcggttaagggtttcctaacgttccgttcttacgtcggtcgtacctaacgacgtcgtacgactacccgtaccgccctccgtcgacctcgtcgtcgacgggtccaccggtggaccgtaggaaccgggaggtaacccgtgtaagtttactttacgtaccgcgtctaccgtntaccgtaattccgtaacgacggttacttacgttaaacgtttccgttaccgggttccgtttagggggaccccgttacggaaacccgtcggtacccctacggcccggtttacggtccgtaccgacggtaaccccgggtntccccgggtaccccg

SEQ ID NO: 233643 - DNA, 846 bp, Homo sapiens
  misc_feature: GYAE6OF01CNZHC.39.86.H09.1.454.CMB.1.raw
  modified_base (235)..(235): a, c, t, g, unknown or other
  misc_feature (235)..(235): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacgaggtcctcgggcccagtctcgccctgacctcaggctcgccttccgtgtcgtgggtctcgtaggacagtcgatcacctatcctctgccacgtcggaaccngcaggtcgtaggtttggggtatgactagtcgtctccgtacggtaaccagtacaatacgtccgaggacccaaccaaccgaacccccctaaagtccaacttacctaagttttacgacggtaacggttactaacggtaaccggttcccgggtaaccccgtttagggttaaccggggttttaactaacggttccgttacgtttccgttccggtcggttacccttaccgtaaacggtttccgtaacggtacccgaaaccggtccccggtcccgttaccccgtacgtaacccttacgttccccgtttaccggtccggggtaccccttaccgggaacggtccgttaacgggaaccgggtaacggtacggtaccgttaacgtttacgtttaacccgtttacgaccggtaacgttaccgttacgttacccttaaggtttaccgaaccgttaacgtaagggtagttaaccgggttaacgttccggtttaaccgttagggttcccgttttaaacgggggaaccgggttaacccgggtaaaccgttaacgggttacccttaacggttcccgtttaaacccgggtacgtaacccgggaacccggtaaacccccggtaaccccgg

SEQ ID NO: 233644 - DNA, 811 bp, Homo sapiens
  misc_feature: GYAE6OF01CIP1X.39.86.H09.1.454.CMB.1.raw
tcagtcgcactagtcacgaccggtgctcgatttagtgctatagacgttggggggggggtctcaggaggcagcgctctcaggacatctccaccatggcctgggctctgctgctcctcaccctcctcactcgagggcacgacgggtcctcgggcccagtcgtcgccctgactcgaggctcgcctcgtgtcgtcgggtctcgtaggacagtcgactccacctactcctccgtcgacctacgtacggaaaccaggtcgtaggttagggtacgggtttagggggttactaggtacttagtcgtaccgtccgtacggtaccagtaactaatacgtaccgacggacaacccgaaccccgtacccctaaatccaacttacgttaagtttacgtaggtacgtacgtaacggtaccgttcccggtaccgttacggtacggtttacctagtccgtcttacgtcgtacggtacctacgtacgtacgtaccggaaccgtaccgtcccggtccctaccgtacgtaacccttcgtcccggttcggtaccggtaccgtaccggtacgggttaccggaacggggttaacggacccgggtacggttacgtttaagttaaccgttttaacgaccgtacgaaccggtacttacgttacgttacttaccggaaccttacgtacgggtaaggtcgttaaccgtttaccgtttggttaccggttacggggttaaacgggttaccggtaaacgggttaacccgtaacggttccggttaacggttacccgtacggtaaacggtccggaaaccccggacccggtaaacccgtacccg

SEQ ID NO: 233645 - DNA, 603 bp, Homo sapiens
  misc_feature: GYAE6OF01A9NTY.39.86.H09.1.454.CMB.1.raw
  modified_base (310)..(310): a, c, t, g, unknown or other
  misc_feature (310)..(310): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcaggtgacggttgggggttatgactatgtctcctggtaccagcaatactccaggcacacgacccccaaatcatctatttangagtcagtaactccggcctcgtaggggtttactaagtcgtcttcgtctcggcctaccgtaagtcgtagggaccaaccgtaccggtccctccctacgaccctacttccgtacgtcgggtcctccgaacggccgtaggacgggacgaggtcgttagtactttaagttacgtgacaacgtctactagtttgacagtacagtcgtagtacttagtcgttaccgttcggaaggtacgggtacgtaacggtctaacgttccggttaccgtaggtccgtaaccggacccgtaaaccccgg

SEQ ID NO: 233646 - DNA, 682 bp, Homo sapiens
  misc_feature: GYAE6OF01BB3HA.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcgagggcacgagggtcctcgggcccagtctcgccctgactcgaggctcgccgtccgtgtcgtgggtctctaggacagtcgatcaccattcctcctgcacgtacggaaccagcgtaggtaggtacgggtttgggggttatgtacgtattcgtccgtccgtacggtaccagactaatcgtaccgaggaccacgacccgacccccaagtactactctaattacgtacggtagtactaacgttacgtccggtcccgttaggtacgggttactacgtccgtcttcgtcgtcgtctacgagtcgtacggaccaccgacccggtccctaccgtacacctacttcgtcgtccggtctaccggaggtcgtacggacgggtaccggtagtaccgtagttaacgttacttacgacgtacggtactaccgttcttagttaccaacgttataccggtaggtcggttacgtactttacggtggtttacccggtaacgggtaagggtacgtaaccggtacgtacgtaccggtaccgttacggtacggaccacccggacccgtaaccccgg

SEQ ID NO: 233647 - DNA, 795 bp, Homo sapiens
  misc_feature: GYAE6OF01AQ8IV.39.86.H09.1.454.CMB.1.raw
  modified_base (232)..(232): a, c, t, g, unknown or other
  misc_feature (232)..(232): n is a, c, g, or t
  modified_base (303)..(303): a, c, t, g, unknown or other
  misc_feature (303)..(303): n is a, c, g, or t
tcagtcgcactagtcacgaccggtgctcgatttagtgctatagacgttgggggggggtctcgaggaggcagcgctctcaggacatctccaccatggcctgggctctgctgctcctcaccctctcactcgagggcacgacgggtccctcgggcccctagttcctcgccctggacctcgaggctcgccttcgtgtcgtcggttctcgtacggactacggtcgaactccaacctnttcctcctcggactaccgtacggaaaccctggccctagggttagggtaaccggggtttggggggtttaacnccggtaacgtttagttccgttaccgttcccggttacggtaacctacgaccttaaactaccgtacccgacgggcctaaccgaccccgaaccccctaaactcctactaccgttatttagtcggtacgtactaaacgtacgttcccgccgttacgggttaacggtttaccaagttccgtcgtttacctcggttccggtactaccgtacgtccgtacgtaccaccgtaccgtccctccgtacgtaccctacgtcctcggtccgtaccgtacgtcggtacgtacgggtacggacggtcgtacgtaacgttaacgttccttaacgacgtcgttacgaaccttcgtttacgtaccggtactaacggtcgttaaggttccgtaacggtttactcgtttaccgggtgttaacgggtaacgggttaccgtaacggttaacgtacgttacccgttaacggttccgtacgggttaccccaacggtcccgtaacccgtaaccccg

SEQ ID NO: 233648 - DNA, 310 bp, Homo sapiens
  misc_feature: GYAE6OF01AJY9J.39.86.H09.1.454.CMB.1.raw
  modified_base (255)..(256): a, c, t, g, unknown or other
  misc_feature (255)..(256): n is a, c, g, or t
  modified_base (258)..(310): a, c, t, g, unknown or other
  misc_feature (258)..(310): n is a, c, g, or t
tcagtcgcactagtcacgaccggtgctcgatttagtgctatagacttgggtttgggggggtttggtggtctccactcccgccttgacgaggctgattattactgcagctcatttgcaatcagtgaggcttatgtcttcgggaagtgggaccaaggtcatcgtcctaggtcagcccaaggccaaccccatgtcactctcgttcccgccctcctcactagtcgcactgacgcgggcttggacaaggcgacagtacgnnannnnnnnnnnnnnnnnnnnnnnnnnnnnnnnnnnnnnnnnnnnnnnnnnnnnn

SEQ ID NO: 233649 - DNA, 664 bp, Homo sapiens
  misc_feature: GYAE6OF01CI90O.39.86.H09.1.454.CMB.1.raw
  modified_base (264)..(264): a, c, t, g, unknown or other
  misc_feature (264)..(264): n is a, c, g, or t
  modified_base (314)..(314): a, c, t, g, unknown or other
  misc_feature (314)..(314): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctcgccctgactcaggctgcctcgtgtctggtctctaggcagtcgctcacatctcctgcactcgaacagctagtggtcggttaggggtatgactatcgtctctcggtaacngactaatctcaggacctacgaaccgacccctaactcactactatttacgngtacggtacgtaacgtacgtccggtacccgtggtacgggttttactaacgttccgttacttcgtccgtcggtcctaacgtacggtacgtacggaacccaaccggtacccggtccctacccgtacgaaccttgtccgtcggtcggtcctaccgaggtcgtacggacggtacggacggttcttaggttaactttaataccggtgtaacgtacgtcgttactacgttccgaattaccgtagtaggtaccggtcgtttaacgtttgtccgggttacggttacgggaaggttaccgggaacttaacgggtcttacggtccggttaactgggaaccccgccgacccggtaaacccg

SEQ ID NO: 233650 - DNA, 653 bp, Homo sapiens
  misc_feature: GYAE6OF01AWT3B.39.86.H09.1.454.CMB.1.raw
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (302)..(302): a, c, t, g, unknown or other
  misc_feature (302)..(302): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttangactntgtctcctggtaccagcaatatccgaggcacacgccccaaactcatcatttangagtactagtaactcggccctgtacggggtttactaagtcgtacttctcgtcggtctaccgtaacgtcgtaggaccaaccgtccgggtaccccttcccgtacgtaccctagttcccgttcgtcgggtcccttaccgaacggtccgtacgggacgggtaaccggacgggtacctttaggtaacttttacgttaccgtcggtacctacggtaccttacgtacgttttacggaccttaacgtccgtaggttacggagttcctttaagttcggttacgttacgggtaaggttacggacccgttaaggtacgtacgttccgttaccgtacggtactaaccggcccgtaaacccggg

SEQ ID NO: 233651 - DNA, 719 bp, Homo sapiens
  misc_feature: GYAE6OF01AJJTQ.39.86.H09.1.454.CMB.1.raw
  modified_base (321)..(321): a, c, t, g, unknown or other
  misc_feature (321)..(321): n is a, c, g, or t
tcagtcgcactagtcacgaccggtgctcgatttagtgctatagacttgggtttggggggggtctcaggaggcagcgctctcaggacatctccaccatggcctgggctctgctgccctcctcaccctcctcactcagggcacagggtcctgggcccagtctgccctgactcaggctgcctccgtgtctgggtctctaggacagtcgacctcaccatctcctgcactggaaccagcagtgacggttgggggttatgactatcgtctcctcggtaccagactaatactccgaggccaccacgaccccccaaatcatctatttanggagtcagtaactccggccctagtaggggtttactaagtccgtcttctcgttcggccttaccgaacgttccgacgggtacccaaacccgtcccgggtaccccttaccccgtacgaaccctacgttcccgtaccggttccgggtcccttacccgagggtaccgtagggaccgggacggtacggtccgttagtaactttacgttaccgtcgtactacggtaccttatacgttttacgaacctaagttccgaagggttcggaacggtttcttaacggttcggttaccgggtttaacggggtaacgggttaccggggaaccgttaacgggttcccttaacggttaccccggttacccggttaacgggtacccgtaacccgggtacccccgtaaacccccggg

SEQ ID NO: 233652 - DNA, 257 bp, Homo sapiens
  misc_feature: GYAE6OF01BCXX4.39.86.H09.1.454.CMB.1.raw
  modified_base (244)..(244): a, c, t, g, unknown or other
  misc_feature (244)..(244): n is a, c, g, or t
  modified_base (250)..(257): a, c, t, g, unknown or other
  misc_feature (250)..(257): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggccaaccccactgtcacctctcgttccccgccctcctcactagtgcgactgagcgggctggcaaggcncatagnnnnnnnn

SEQ ID NO: 233653 - DNA, 878 bp, Homo sapiens
  misc_feature: GYAE6OF01E0235.39.86.H09.1.454.CMB.1.raw
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacgagggtcctgggcccagtctcgccctgactcaggctcgcctccgtgtcgtgggtctcgtaggacagtcgatccacctatcctcctgacctacgtacggaaccagcgtaggttcggttacggggttttggggggttaattcggtaaccttattccggttcccttaccccgttacggtttaacccagtaacctaaaacttaccgtacccgaacgggtaacccaaccgtaacccccggaacccccccctaaaacttcctaactttaccttaaagtttttacggtacgggtaacgggtttaccgtaaacggtttaaacccgtccccgggttacccccggttacgggtttaaccgggggtttttaaccttaaccggtttcccgttccgttttcccggttaccggttcccggttacccgttaacccgtaacgggtttcccggtaccggtaaccccgtaaacccggtccccgggttacccccttaccccggtaccgtaaccccgttacgttccggttaccgggtcgggtacccctaaccgggtacgggtccgttagggaaccgggacggtacggttcgttacgttaactttacgttccgtgtacgtacgtaccttgtacttcgaactgtacggtagtaggtacgttcgtttagtcggtttaacgggtacggtaacgggttacggaccgttacgtccgttacgttacccggttacgtaccgtccggtaacccgcccggtaaccccg

SEQ ID NO: 233654 - DNA, 773 bp, Homo sapiens
  misc_feature: GYAE6OF01BXFAH.39.86.H09.1.454.CMB.1.raw
tcagtcgcactagtcacgaccggtgctcgatttagtgctatagacttggggtttgggggggggtctcaggaggcagcgctctcaggacatctccaccatggcctgggctctgctgctcctccaccctcctcactcagggcacgagggtcctcgggcccagtcctcgccctgactcaggctcgcctccgtgtcgtgggtctcgtaggacaggtcgactccaccattctcctgccacgtacggaaccaggcgtaggtacggttacgggtttggggggttaactgtaacgttacgttcggttacccttccgtacgggttaacccaaggtactaaactacgtacccgacgggaccaacccgacccgtaaccccccaaaactctaacttacttaagtttacgaggtacgtacgtaagttaccgtccggtaccctacgggttacgggtttactaacgtccgtcttctcgtcggtcctacgtaacgtccgtacggaacccaaccgtcccggtaccctacccgtaccgtaccctacgttccctacggtcccgggaccctacccggacggtaccggacgggaaccgggtaccgggtaggtccgtttaagttaacttttaccggttaactttccgggacgttacgtccttacgttaagtttccgaaacgttacgtacggtacgttgggtacgtttcgttaggtacggtttccggtaagggtaaccgggtacggtaccgtaaggtcctaggtcccgttacgtaggccacccggacgaaccccgg

SEQ ID NO: 233655 - DNA, 266 bp, Homo sapiens
  misc_feature: GYAE6OF01A6IVB.39.86.H09.1.454.CMB.1.raw
  modified_base (251)..(266): a, c, t, g, unknown or other
  misc_feature (251)..(266): n is a, c, g, or t
tcagtcgcactagtcacgaccggtgctcgatttagtgctatagacttggggtttggggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctcgttcccaccctcctcactagtgcgactgagcgggctggacaaggcgacatagnnnnnnnnnnnnnnnn

SEQ ID NO: 233656 - DNA, 540 bp, Homo sapiens
  misc_feature: GYAE6OF01D5XAT.39.86.H09.1.454.CMB.1.raw
  modified_base (159)..(159): a, c, t, g, unknown or other
  misc_feature (159)..(159): n is a, c, g, or t
  modified_base (252)..(252): a, c, t, g, unknown or other
  misc_feature (252)..(252): n is a, c, g, or t
  modified_base (513)..(540): a, c, t, g, unknown or other
  misc_feature (513)..(540): n is a, c, g, or t
tcagtcgcactagtcacgaccggtgctcgatttagtgctatagacttgggtttggggggctgtgcctggatattgctggaaccagcagtgacgttgggggttatgactatgtctcctggtaccagcaatatccaggcacagccccaaatcatcatttangaggtcagtaatcggccctcgaggggtttctaatcgcttctctcggctccagtctggacaacacggccctccctgaccatctcgtgggctcgngctgaggcgaggctgattagtactggcagctcatttcgactaatcgtaggtgacggtctttatcggttcttagggaacgtgggaactaggtctaacgtccgtcctaggtccacggccccaaacggaccccaaaccccgtactcgtaccaccttaccgttccgttcccccgtaccccttccctcctaaccgttcggtcggaccgtaccgttaggacgggtccggggcgtcggggacccaacggggcgaacctaggtagctcnnnnnnnnnnnnnnnnnnnnnnnnnnnn

SEQ ID NO: 233657 - DNA, 786 bp, Homo sapiens
  misc_feature: GYAE6OF01B1IBI.39.86.H09.1.454.CMB.1.raw
  modified_base (390)..(390): a, c, t, g, unknown or other
  misc_feature (390)..(390): n is a, c, g, or t
tcagtcgcactagtcacgaccggtgctcgatttagtgctatagacttgggttgggggtctcaggaggcagcgctctcaggacatctccaccatggcctgggctctgctgcctcctcaccctcctcactcgagggcacgagggtcctgggcccagtctcgccctgactcgaggctcgcccttccggtgtctgggtctcgtaggacagtcgatccaccatcctcctgactacgtacggaaccgagcgtaggttcgggtacggggttttagggggttatcggtacttagttcgtccgttaccgtacgggtaacccagtactaaagttactacccgaaggacccaaccgaccccgtaaaccccctaaatcctaaactttcttaaagtttaacgnggtaacgttaacgtaaccgttaaccgcccggttaaccgtggtttaacggggtttactaacgttccgttcttacgttcgtcggtacctacgtacgtcgtaccgggaactaacccggcccgtccctaccgtaccgaccctacgttccgtacgggtccgtacccgtcggtagccggtaggaaccgggtacgtaacgggtccttaaggtaacttttaacgttcgcgtaccgtacgtaccgtttataacgttagtaacctaagttccgtagggttaacgttcgggttactttacgggtcggttacccggttaagggtaaccgggccggtaaacgttaccgggttactaccgggtttaccgtaacccgtagggtaaccaccccggtaaccgtaaacccccgg

SEQ ID NO: 233658 - DNA, 723 bp, Homo sapiens
  misc_feature: GYAE6OF01EQP1Q.39.86.H09.1.454.CMB.1.raw
  modified_base (226)..(226): a, c, t, g, unknown or other
  misc_feature (226)..(226): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcgaggctgcctcgtgtctgggtctcgtagacagtcgatcaccatcctcctgcactaggaaccngcagtgtacggttggggttatgactatgtcctccgtaggtaccagactaatactccaggaccacaccgaccccctaaatcaactctaatttacgaggtacgtacgtaagtaccgtcccgttaccgtacgggttacgttaactacgtccgtcgttacgtcggtacccttaccgtaacgtacgttacggtaccgaaccgtaccggtacccgtaccccttaccgtacctaccttaccgtccgtcggtccggtacccgtacggtacggtcggtaacgggacggtaacggtacgtacggttacgttaacgtttacgttacgtacgtacgtaccgttacgttactttacgtactaacgttacgtacgtaggtacgggttacgttacgtttacggttaccggttaacggttacgggtaacgggttaccggtaaacggtacggttacgtacccggtttacgtacggggggttacctacccggtacccggaacccggtaaaccccg

SEQ ID NO: 233659 - DNA, 781 bp, Homo sapiens
  misc_feature: GYAE6OF01EAC4G.39.86.H09.1.454.CMB.1.raw
  modified_base (203)..(203): a, c, t, g, unknown or other
  misc_feature (203)..(203): n is a, c, g, or t
tcagtcgcactagtcacgaccggtgctcgatttagtgctatagacttgggttgggggtctcaggaggcagcgctctcaggacatctccaccatggcctgggctctgctgctcctccaccctcctcactcgagggcacgagggtcctcgggcccagtctcgccctgactcgaggctcgcctccgtgtcgtcgggtctcgtaggngagtcgactcacctatcctccgtgcacgtacggaaccagcgtaggtagggtacgggttgggggttataggacttagtcgttaccgtccgtaggtaaccagtactaatcgtaccgacggtaccaaccgacccgaaccccctaattacccgtacttacttaatttacggtacggtaacgtaccgtaagttaaccggtcccgggttaacccgtttagggttaccggggttttaactaccggttaccgttccttccgttcggtcccggtacttaaccggtacgttaccggtcggaaaccgtaaccgtccccggtccctacccgtaccgtaccctacgttccgtcggtaccgtcccgtaccggtacggtcggtacgggaacgggtacggtaggtaccgttacgttactttactcgtagtacgaccgttcttacgttacgttacgtaacctaagtcgtaagtacggttacggtactttaggttaccggttacgggttacgggaaccgggttaacggtaacccggtagttaccgaccgtttaaccggtacggttacccggcgtaaacccggacccgtaaaccccg

SEQ ID NO: 233660 - DNA, 765 bp, Homo sapiens
  misc_feature: GYAE6OF01E5SM0.39.86.H09.1.454.CMB.1.raw
  modified_base (744)..(744): a, c, t, g, unknown or other
  misc_feature (744)..(744): n is a, c, g, or t
tcagtcgcactagtcacgaccggtgctcgatttagtgctatagacttgggttgggggtctcaggaggcagcgctctcaggacatcctccaccatggcctggctctgctgcctcctccaccctcctcactcgacgggcacgcgggtcctcgggccctagtctccgccctgactcgaggtctcgcccgttacgtgtcgtcggttctactaggacctagtccactccacctctcctcctcgacctacgtacggaaccgacgtcggtacggttcggttacggggttttaggggttaatcgtaagttcttcgttaccgtccggtacggtaccacgtactaactaccggaccgtaacgaccaaccgtaacccccaaccctaaagtccaatttaccttatttacggaggtaccgttacgttaaacggtcccaccgggttcctacgggtttaccggttactacgttccgttacttccgtcgttccggtactaacggtacgttcgaccggtacacccgtcccggttcccttaaccggacgttaaccttcgaccgttcgggtccgaccttcggaccgggtggtaaaccggtcgggaacggtttacgacgttaacttaaccggtttacgtcggttacgccgttaacgttcctaggtaacttctaacgacgtgttacggtagttcgttacgtttacgcgttaccgggtaggtaccggtaacggtacgttacgtccgttacgtacggtacccgtaancccgggaacctaccgaccccg

SEQ ID NO: 233661 - DNA, 833 bp, Homo sapiens
  misc_feature: GYAE6OF01C3EBM.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgcctcctcaccctcctcactcgacgggcacgacgggtcctgggcccagtcctcggccctagactcgagctcgtccgttccggtgttccgttgggtacctacgtaggaccaggtcgaactacaacctacttcctcctcgaccacgtaacggaacacgtacgtaggtacggtagggtttaggggttactacgtactagttccgtccttacggtacgaaccgtagtacaagtaccgtcgaccggactaaccgaccccgtaaccctaacgtactacgtacttaagttacgagtaacgtaactacggtaccgtccgtaccgtacggttaaggtttcctacgttccgttacttcgtcggtacccgtacgtaccgttaagtccgggtaccaaccgaacccgtaccgtcccgttaaaccgctaaccgttactccggttacggccggtacccgtaaccgtgtaccggtaggaacgggtagtaacggtcgtaacgttaacgttacctcggtacggtacctacgttaccgttacgtttaacgtacgtaaaccgtaagttccgggtacgttaacgggtttacttaccgtttaaacgggttcggttttaaaccgggaacgggggttaagggttcccggtaaaaacggttccggtttaaacccgggtaacgtttacccggggtaacccgtttaccgggaaacccgtacccgggtaaaccccgtaaaaaccccggg

SEQ ID NO: 233662 - DNA, 692 bp, Homo sapiens
  misc_feature: GYAE6OF01B6KYS.39.86.H09.1.454.CMB.1.raw
  modified_base (197)..(197): a, c, t, g, unknown or other
  misc_feature (197)..(197): n is a, c, g, or t
  modified_base (248)..(248): a, c, t, g, unknown or other
  misc_feature (248)..(248): n is a, c, g, or t
  modified_base (321)..(321): a, c, t, g, unknown or other
  misc_feature (321)..(321): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgccctccgtgtctgggtctcgtaggacngtcgatcaccatctcctgcactggaaccagcgagtgtacggttggggttangactagtgtcctccgtggtaccagactaatctccgaggcaaccaccgacccccaaacgtctatcttatttagngacgtcaggttaacgtcccggtaccgttcgtaacggggtttactaacgttccgtccttcgtcgtcggtacccttaccgaaggttcctagggtaccaaacccggtcccgtaccctacccgtactacccgtacttccgtacgtcgggtccctccgaggtcgtacggacgggtacgaggtaccgttagttaacttacgtttacgcggttaacgcgttacttcgttacgtttagaccttaagtccgtagggtacgtaggttccttagttcgggtttaccgtaagggtacgggttaccgggaaccgtttaacgggtaccttaacggttcccggtacggttaaccggttcccgaccggtacccggtaaacccccggg

SEQ ID NO: 233663 - DNA, 938 bp, Homo sapiens
  misc_feature: GYAE6OF01C6JN8.39.86.H09.1.454.CMB.1.raw
  modified_base (174)..(174): a, c, t, g, unknown or other
  misc_feature (174)..(174): n is a, c, g, or t
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (226)..(226): a, c, t, g, unknown or other
  misc_feature (226)..(226): n is a, c, g, or t
  modified_base (240)..(240): a, c, t, g, unknown or other
  misc_feature (240)..(240): n is a, c, g, or t
tcagtcgcactagtcacgaccggtgctcgatttagtgctatagacttgggttgggggtctcaggaggcagcgctctcaggacatctccaccatcggcctgggctctgctcgcctcctccaccctctcactcgaggcacgtacgggtccgtcgggcccagtctcgcctgactcgngctcgcctcgtgttccgtggtcctcgtacggacngtcgatccacnctcgtcngtcacgtagaaccngacgtggtacggtacgggttgggttatagtcgtattcggtacctccggtaacgtaacacgtactaaacctacgtccgaggaccctaaaccggacccctaaccccaaattcctaattacgttaccgtttaaggtacggaagttaccggaaacggttcccgaccggtttacccggagggtttaaccggtttaacttaccgggtccctttacgttcccggttacggtaccgtaccgttaaccggttaacgggttacccacggggaaccctaacccgggttaccccgaccccgtttaccgtaacgtaccccggttaccgtttaaccggccggttaccggtaacccggttacccggtaagggttaccccgggttaagggtacccggggtaaacgggttaacccggttaaccgttttaacgggtttaaacccttttaaccccgggtttaaacgttccggtaaccggtttaaaccgttaacccggttttaacgtttaaccggttacccgttaacccgttaaggttaaacccggggtttcgttaacgggtaaccggttttaccgttaccggttacggttaaccggggttaccggttaaacgggggtaacccgggtttcggtaaaaaccgggttcctttaaccggttacccgggttaacccggttaaccggtaacccggttaccccgggaaaccgttaacccccggg

SEQ ID NO: 233664 - DNA, 776 bp, Homo sapiens
  misc_feature: GYAE6OF01BZH3S.39.86.H09.1.454.CMB.1.raw
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (327)..(327): a, c, t, g, unknown or other
  misc_feature (327)..(327): n is a, c, g, or t
tcagtcgcactagtcacgaccggtgctcgatttagtgctatagacttggggttgggggtctcaggaggcagcgctctcaggacatctccacatggcctgggctctgctgctcctcaccctcctcactcgagggcacgagggtcctcgggcccagtcgtcgcctgactcgaggtctcgccgtccgtgtcgtgggtctcgtaggactacgtcgactcacctagttcctcgtgactacgtacggaaccagctagggttcggtacgggttgggtatcgtactgtcgtcctcgtgtaaccnacgtaatcncgagacaccgaccgaccctaanctactacttagttacgacgtacgtacgtaagttaccgtccgtacgttacggtacgggtttactaacgttccgttacgttcgtacgtacgggtacctaacggtacggtacccggaggtaacccgtaacccggtacccgttcccgttaccgtaaccgtaaccgtccgtttccgtacggggtaaccgtcccgttaacggcggggtacgtaacgggtaacggacggtaacgttcgtttaagttaacttacgtacgtccgtaaggaccttacttaccgtagttaccgaacgttacgtacggtacgttaacgtacggtttacttacggttacccgggttaacggttaaccggggaggttaaacccgggtacgttaaccgttaaccgttcccggggttaaaccttacccggggtaaaccttacccggtaaaccgggtaacccccgtaaacccccgg

SEQ ID NO: 233665 - DNA, 754 bp, Homo sapiens
  misc_feature: GYAE6OF01DAXIQ.39.86.H09.1.454.CMB.1.raw
  modified_base (223)..(223): a, c, t, g, unknown or other
  misc_feature (223)..(223): n is a, c, g, or t
  modified_base (235)..(235): a, c, t, g, unknown or other
  misc_feature (235)..(235): n is a, c, g, or t
  modified_base (667)..(667): a, c, t, g, unknown or other
  misc_feature (667)..(667): n is a, c, g, or t
tcagtcgcactagtcacgaccggtgctcgatttagtgctatagacttgggttgggggtctcaggaggcagcgctctcaggacatctccaccatggcctgggctctgctgcctcctcaccctctcactcagggcacagggtcctgggcccagtctgccctgactcgaggctgccttccgtgtccgtgggtctcgtaggacaggtcgatccaccatcctcctgcncgtacggaaccngcagtggtacgggtttaggggttatggtactagttcgttccttaccgtacggtaaccagtactaacttacgaccgagggaccaacccgaaccccgtaaccccctaaacttcctaacttacttaacttttaggacggtaaacggttcctaaagggtacccgtcccggtcccgttaggttaaccgggggtttacttaacggtccgtttacccgttcgttcccggtgggttaaccccttacggttaaacggtccggttaaccggaacctaaccggtacccgggttccccttaacccgtacgtacccctagttccgtccgtacgggcccttcccgaggtcgtacgggacggtacggcgggttactagttaacttttcgtaaccgtgtacctcggtacttacgttacttacgacttacgttcgagttcggtacgttntaggtttcgtaccgtgggtaaaggtcggaaaccgttagtacgttaccggttcggttacgttacggcaacccgggacccgtaaacccg

SEQ ID NO: 233666 - DNA, 712 bp, Homo sapiens
  misc_feature: GYAE6OF01CQST8.39.86.H09.1.454.CMB.1.raw
  modified_base (452)..(452): a, c, t, g, unknown or other
  misc_feature (452)..(452): n is a, c, g, or t
  modified_base (580)..(580): a, c, t, g, unknown or other
  misc_feature (580)..(580): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcaacgcgggtccgtgggcccagtcctcggccctgactcgagctcgccgtcgtgtcgtcgggtctacgtaggaccagtcgatcacctatcctcgtcgactacgtacggaaacctggcgtaggtacggttacgggtttggggggtaatacggtaacgttacgttcgtccgttccgtacggtaaccagtactaactaaccgtccgaagggtccaaccggaaccctaacccctaaactcctaactactaatttacgacggtacgtaacgtacgtacgtccgtacccgtaggtacggttactaacgtcgttacctcgttcncggttaccctacgtaagttcgtacggaacctaaccggtcccggacccttccggtaaccacttcgttccggtcgtacggtacccgtcgtaggtacggacggacggtagcggtacttagttatacgtacncggtactgttcgtatttaacggtcgaactagtacggtacgttacgacgtttcgtacgttggtaccggtaacggaggggttaccgaacgtttagaccttcggttacgacgttcggacgacgtaccccgaaccg

SEQ ID NO: 233667 - DNA, 773 bp, Homo sapiens
  misc_feature: GYAE6OF01CTZTA.39.86.H09.1.454.CMB.1.raw
  modified_base (260)..(260): a, c, t, g, unknown or other
  misc_feature (260)..(260): n is a, c, g, or t
  modified_base (569)..(569): a, c, t, g, unknown or other
  misc_feature (569)..(569): n is a, c, g, or t
  modified_base (595)..(595): a, c, t, g, unknown or other
  misc_feature (595)..(595): n is a, c, g, or t
tcagtcgcactagtcacgaccggtgctcgatttagtgctatagacttggggtttggggggggggtctcaggaggcagcgctctcaggacatctccaccatggcctgggctctgctgcctcctccaccctcctcactcgacgggcacgagggtcctgggcccagtctcgccctgactcgaggctcgcctccggtgtcgttggtctacgtaggactagtacgactcaacctactcctccgtgacctacgtacgggaaacccnggacgtagggttacgggtacggggttttagggggttaatcggtaaccttaagtttccggtccgttaccgtacgggttaaccacggtaaccaaacttacgaccgacggtaccaacccgacccgtaacccctaaactccgtaattaccttaacgttttagtcggtaagtacgtacggtaaccgtccggtccgttaacggttacgggtttactacgtccgtctttccgctggtacctacgtacgtcgtacggacctaacggtcccgttcctaccgaacgtacctacgttccgtaccggtcgtcccgtacggngtaacggtgggaacggacggtacgtnttaggtactttagtcgtagacgttactaccttagttaccgtagaccttaatccggtaggtacggtacgtttacgtagggtttcgttaccgggtaacgggtacggttacgggtaacttaccgggactttacggtcccgttaacccggttacgaacgtacccggtcccgtaaaccccggg

SEQ ID NO: 233668 - DNA, 715 bp, Homo sapiens
  misc_feature: GYAE6OF01C4YYU.39.86.H09.1.454.CMB.1.raw
  modified_base (234)..(234): a, c, t, g, unknown or other
  misc_feature (234)..(234): n is a, c, g, or t
tcagtcgcactagtcacgaccggtgctcgatttagtgctatagacttggggtttgggggggggtctcaggaggcagcgctctcaggacatctccaccatggcctgggctctgctgcctccgtcaccctcctcactcagggcacagggtcctgggcccagtctgccctgactcaggctgcctccgtgtcgtgggtctctaggacagtcgactcaccatcctctgcactggaaccngcagtgacggttgggggtatgactatcgtctccgtaggtaccagccaatactaccgaggacacaccgaccccaaatcactactagtttatgagtctaagtacgtccggtccgtggtacgggtttactaacgtcgtcttcgtctcggtcctacgtacggtcttacgggacctaaccggaccggtccccttcccgtacgaaccctcttcccgtccggtcgggccctacgtacggtccgtagggaacgggtacggcgttaccgttagtttaaactttacttacgtagtaccgtaacggtcttacggttactttacgacgttaacttccggtagggtacggtacggttactttacgttcgggtttaccggttaacggggtaagggtttacccggggaaaaccggttacgggttacccgttaaggttccccgggtttaaccggtaacggttacccggaaaccccggtaccccggtaaaaccccggg

SEQ ID NO: 233669 - DNA, 780 bp, Homo sapiens
  misc_feature: GYAE6OF01B6HSP.39.86.H09.1.454.CMB.1.raw
  modified_base (199)..(199): a, c, t, g, unknown or other
  misc_feature (199)..(199): n is a, c, g, or t
  modified_base (235)..(235): a, c, t, g, unknown or other
  misc_feature (235)..(235): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcgagggcacgagggtcctgggcccagtctcgccctgactcgaggctcgcctcgtgtcgtgggtctcgagacngtcgatccacctatcctcctagcacgtacggaaccngacaggtcggtacgggttggggttatggtacttacgtcgtccgtaccgtacgggtaaccagtactaatacgtaccggagcccaaccgaccgtacccccaaatcgtattacttaagtttacacgggtaacgtactaacggtaacggtcccggaccgttacgggtacgggtttacctacgtccgtacttccgtacgtcggtaccttaaccgacggttactacggaacccgtaaccgtacccgggtccccttaccggtacgtacccgttaacgttccggtccggttcgggtaccccgttccgggtaacgggtccgggttaccgggaacgggtacgtaaccgggtttccttaagtttaccgttaacgtttacggaccgttacgaccgttaccttacgttaaccgttcaacgttacgttagtacggttaggtccgtttaacgtttcgttacggttaaccggtacgggttaacgggtaaccgtaacggttaaccggtcgtaacggttccggtacggtaacccggtaccaaccgggtacccgtaaaccccgg

SEQ ID NO: 233670 - DNA, 907 bp, Homo sapiens
  misc_feature: GYAE6OF01BJ5NR.39.86.H09.1.454.CMB.1.raw
tcagtcgcactagtcacgaccggtgctcgatttagtgctatagacttggggggggggtctcaggaggcagcgctctcaggacatctccaccatggcctgggctctgctgctcctcaccctcctcactcagggcacagggtcctgggcccagtctgccctgactcaggctgcctccgtgtctgggtctcgtaggacagtcgatcacctatcctacctgctacctaggaaaccaggctaaggttggtacggtttaggggggttaatgtacttacgttacgttccgttcccgtacggttaacccaaggtacctaaacgttaacgtcccgtaaggacccgaaccctaacccggaacccccctaaaaccgtccttaaaccttacccgttaaattttaacgtaccggtaacgggttacctaacgggttaaaccggttccccgggttacccccttacggggttaaccgggggttttaaccttaaaccgttccggtttacccgtttacccgttccgtaccggtacccgtttaacccgaaacggtttacccgttacggggacccctaaaaccccggtcccgggttaccccgtaccccgttaccgggtaaaccccgttaactttcccgtccggttttaccgggtacccgttaccggaacgggttcgtaaccgggtaaacgggaacggtaccgggtacttacggtaacttttaacggttaccgtcgtaaccgtacggtaccgttaccgttaagtttcggaaacttagtaaccgtaggttacgtaacggtttacgttacgttacggttaccggttaacggtaacggggtaccgggttaaacggtacggttaccctacggttaccggtttaacccgtacgggtaccctaacccgtaaccccgggtaacgtaaaccccccg

SEQ ID NO: 233671 - DNA, 777 bp, Homo sapiens
  misc_feature: GYAE6OF01DH0Z2.39.86.H09.1.454.CMB.1.raw
  modified_base (537)..(537): a, c, t, g, unknown or other
  misc_feature (537)..(537): n is a, c, g, or t
  modified_base (555)..(555): a, c, t, g, unknown or other
  misc_feature (555)..(555): n is a, c, g, or t
tcagtcgcactagtcacgaccggtgctcgatttagtgctatagactttgggttgggggtctcaggaggcagcgctctcaggacatctccaccatggcctgggctctgctgccttcctccaccctcctcactcgagggcacgacgggtcctcgggccagtcctcgccctgactcgagctcgccttcgtgtcgttcggtcctcgtaggactacgtcgactccacctactccttcctcgactacgtacgaaccagcgtaggttacgggtacggggtttaggggttaatacggtaaccttgttccgttccgttacccgtacggtaacctagacctaaactaccgtaccgaacgaacccaaccgaaccccgaaccccctaaattcttaacttacgtttaagtttaacggtaggtaacggttacgtaacgttaccggttcccgtaccgttaaggtttacggttactacgttcgttccgttcctacgtacgtcctaaccgtacggtcgtccgaacctacccgtccgtccctactcaacccgttntccgtcgggtcgtacccnggtacgcggtacgggaacgtacgtacgttattactttaacgtttaacgtacgccgtagttacccgtagtttacgttaccgttaagaccgtttaagtacggttggtaacgttcgtttaacgttcggttaagtaaccggggttacgggtaccggtaacggtaacgttacggttctaaccggttcgtaaccggttacgccccggaaccgttacccggaacccccg

SEQ ID NO: 233672 - DNA, 696 bp, Homo sapiens
  misc_feature: GYAE6OF01CTO3L.39.86.H09.1.454.CMB.1.raw
  modified_base (249)..(249): a, c, t, g, unknown or other
  misc_feature (249)..(249): n is a, c, g, or t
  modified_base (309)..(309): a, c, t, g, unknown or other
  misc_feature (309)..(309): n is a, c, g, or t
  modified_base (314)..(314): a, c, t, g, unknown or other
  misc_feature (314)..(314): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactaggaaccagcagtggacggtttgggggttangactatgtctcctggtacagtcaatatcaaggcaacacgaccccaaactcatctatttangagtnagtaatcggccctgtacggggtttactaatcgtacttcgtcgtcggtcctacgtaagttctggaaccaacgacccggccctcccgtacgaacctattccgtcgtcgggcccttaccggagggtccgtaggaacggggaacgtacgggtaccgttaacggtaattttaaacgttaacgtaccgggtactaaaccggtctttacccttaagttttacggaaacccgttaaattaccggtaaggtacgggttaacggttacccgtttaaagttacggttaccgtttaacggggtaaacgggttacggggaaacccggtaaagggttaccctaaggttcccggttaaccgaaccgggtttaacacccggtaacccgaaaccccggg

SEQ ID NO: 233673 - DNA, 561 bp, Homo sapiens
  misc_feature: GYAE6OF01B9MIW.39.86.H09.1.454.CMB.1.raw
  modified_base (279)..(279): a, c, t, g, unknown or other
  misc_feature (279)..(279): n is a, c, g, or t
  modified_base (308)..(308): a, c, t, g, unknown or other
  misc_feature (308)..(308): n is a, c, g, or t
  modified_base (441)..(441): a, c, t, g, unknown or other
  misc_feature (441)..(441): n is a, c, g, or t
  modified_base (455)..(455): a, c, t, g, unknown or other
  misc_feature (455)..(455): n is a, c, g, or t
tcagtcgcactagtcacgaccggtgctcgatttagtgctatagacttggggggggggtctcaggaggcagcgctctcaggacatctccaccatggcctgggctctgctgctcctcaccctcctcactcagggcacagggtcctgggcccagtctgccctgactcaggctgcctcgtgtctgggtctcgtaggacagtcgatcaccatcctcctgcacgtggaaccagcaggtggacggtttgggggttatgactatgtctcctggtaccagacaatacnccaggcacacgaccccaaatcatcattangagtcagtactccggcctacggtagggtttctagtccgtcttcgtctcggtcctactacgtcgcgaccaaccgccggtcccctccctagacctattccgtcgtcgggcctccgaggtccgtaggacgggacgnggtctgtaagtttntacgtgcaagtctactatttcgactatctagtgaggttcttagtcgttcggtacggtaggtacggaactaggtcctagtcgtccgtagacacgccgaacgtacccc

SEQ ID NO: 233674 - DNA, 809 bp, Homo sapiens
  misc_feature: GYAE6OF01BOLEV.39.86.H09.1.454.CMB.1.raw
  modified_base (656)..(656): a, c, t, g, unknown or other
  misc_feature (656)..(656): n is a, c, g, or t
tcagtcgcactagtcacgaccggtgctcgatttagtgctatagacttgggttgggggtctcaggaggcagcgctctcaggacatctccaccatggcctgggctctgctgctcctccaccctcctcacgtcgagggccacgacgggtccgtcgggcccctagtccgtcgtcccgtagacctcgacggccgtcgtcccgttccggttcggtccgttgggtccttacgtacggacgtacggtccactaccacctactcctcctacgtacctaaccggtacggaacccagacggtacggtacgggttacggggttacgggggttatacgttacgttagttccggtccgttacgtaccggtaccgaacgtactaacgttaacgtccggaacggacccaaccgacccaaccctaactactaactacgttagtttacgacggtaacgtacgtaacgttaaccggtccggttacccgttacggttacgggtttaaccttacgtccgtttccctacggttccgttacggtcccttaagtccggtacggtaccgtaccgttaacccggccgtcccacgtaccgtccgtacgtccgttccgggtaccggtaccgtaccggcgtaaccggtaggaccggaagggtcgtacgttacttaacgtcttacncggtactaccgtcgttaacgtcgttaacggtactaaggtccgaagtttcggtagttactttaggtccggttacgggtaccggttaagggtccggaactacggtcgtaacccggttccgaacggttaccggaacaccccggtaaccgaccccgg

SEQ ID NO: 233675 - DNA, 703 bp, Homo sapiens
  misc_feature: GYAE6OF01DV6ER.39.86.H09.1.454.CMB.1.raw
tcagtcgcactagtcacgaccggtgctcgatttagtgctatagacttgggttggggggtctcaggaggcagcgctctcaggacatctccaccatggcctgggctctgctgctcctcaccctcctcactcgagggcacagggtcctgggcccagtctgccctgactcaggctcgcctccgtgtcgtgggtctcgtaggacagtcgatccaccatcctcctcgcaccgtacggaaccaggctacggtggtacgggtttgggggtacttgacttagtcgtctccgttcggtaccagtacaattactccgacggacaaccgaaccgaacccccaactcctaagttactacttttagacggtacgttaccgtaagtaaccgtccggacccgttacggttacgggtttactaacgttcgtcttcgtctgtcctacgtagtcgtcggtaacaaccgtaccgtcctccctgacctctccgtccgtcggtccctcggacggcgtacggacggtacggtcggtgtacgtttatttacgttacgtcacgacgttcttacgttactttcaacgttaactcggttacggtaggttacggttacgtttacgtacggtttaccgtaggggttaaacgggtacggttaaaccgggtaacgtccgttaacgttaccggttaccggtaccggtccggaacccggtacccggtaaaccccgg

SEQ ID NO: 233676 - DNA, 698 bp, Homo sapiens
  misc_feature: GYAE6OF01B29JJ.39.86.H09.1.454.CMB.1.raw
  modified_base (220)..(220): a, c, t, g, unknown or other
  misc_feature (220)..(220): n is a, c, g, or t
  modified_base (240)..(240): a, c, t, g, unknown or other
  misc_feature (240)..(240): n is a, c, g, or t
  modified_base (656)..(656): a, c, t, g, unknown or other
  misc_feature (656)..(656): n is a, c, g, or t
tcagtcgcactagtcacgaccggtgctcgatttagtgctatagacgttggggggggggtctcaggaggcagcgctctcaggacatctccaccatggcctgggctctgctgctcctccaccctcctcactcgagggcacgacgggtcctcgggcccagtctcgccctgactcaggctcgcctccggtgtcgtgggttctcgtaggacaggtcgatcacctntctctgcacgtacggaaccngacgaggtggtacggtttaggggtatggtacttagtcgttccgtaccgttacggaaccagtacctaaagtcctacccgacggaccaacccgacccgtaacccccaaaacttcaacgttacctttaagtttacgacggtaacggttaagtaacggttacggtccccgggttaccgttacggttagggtttacctaacgtccgttctttccgtccgtaggtaccctaccgtaacgtcgtaccgaacgtaaccgcccggtcctccgacgtaccttacgtcgtcggtcccggctaccggcgtacgaggacgggcgtagtcgtagttactacgtagcgaactctacgttagtctaactacacgttgagttacggtagtctttacgggcgttacggtacgggtacgtcgggtaactggtacnccggtttacgccgtggaccctaacgtcccgaaccgtaacccc

SEQ ID NO: 233677 - DNA, 723 bp, Homo sapiens
  misc_feature: GYAE6OF01CPVTW.39.86.H09.1.454.CMB.1.raw
  modified_base (200)..(200): a, c, t, g, unknown or other
  misc_feature (200)..(200): n is a, c, g, or t
  modified_base (534)..(534): a, c, t, g, unknown or other
  misc_feature (534)..(534): n is a, c, g, or t
tcagtcgcactagtcacgaccggtgctcgatttagtgctatagacttgggtttggggggggtctcaggaggcagcgctctcaggacatctccacatggcctggctctgctgctcctcaccctcctcactcagggcacgacgggtcctgggcccagtctcgccctgactcagctcgcctccgtgtcgtggtctcgtagacngtcgactacaccatcctctcgacacgtacggaaccgagcgtaggtacgggtacgggtttagggggttactacggtacttagtcgttacttccgtacggtaccacgaacgtaactacgtccggacggaccaaccgacccgaacccctaactactacgttacttaatttacgtaggtacgtacgtaacgttacgccgtaccgttaggtacggtttactacgtccttacttctacgtcgtactaccgtacgtccgtacgacctaaccgtccgtaccctccgtacaaccttctaccggtcgtacggccctacggcccggtagacgggacgtacgggtntacgtcgttaacttacgtcgtaccgtatcgtaccgttgttacgttacgaacgttacgtacgttacggtacgttgtaccgtttacggttacgttaacgggttacgggtaaggttaccggttaacgtaccgggttacttacccgggtaccgttacggaccggtaacccgaccgtaaccccggtaaaccccg

SEQ ID NO: 233678 - DNA, 723 bp, Homo sapiens
  misc_feature: GYAE6OF01A01AX.39.86.H09.1.454.CMB.1.raw
  modified_base (159)..(159): a, c, t, g, unknown or other
  misc_feature (159)..(159): n is a, c, g, or t
  modified_base (229)..(229): a, c, t, g, unknown or other
  misc_feature (229)..(229): n is a, c, g, or t
  modified_base (248)..(248): a, c, t, g, unknown or other
  misc_feature (248)..(248): n is a, c, g, or t
  modified_base (315)..(315): a, c, t, g, unknown or other
  misc_feature (315)..(315): n is a, c, g, or t
  modified_base (562)..(562): a, c, t, g, unknown or other
  misc_feature (562)..(562): n is a, c, g, or t
tcagtcgcactagtcacgaccggtgctcgatttagtgctatagacttgggtttggggggggtctcaggaggcagcgcgtctcaggacatctccaccatggcctgggctctgctgctcctcaccctcctcactcagggcacagggtcctgggcccagtcngccctgactcaggctgcctccgtgtctgggtctctaggacagtcgatcaccatctcctgcactggaaccngcagtgacgttggggttangactatgtctccgtggtaccagtcaagtctccgagcacacgccccaactcatcatttacaggagtanagtaacgtccggacccgtcgtaggggttttcaacgtcggtactttccgtacgtcggtacctaccgtaacgttccgtacgggaccctaaaccgacccgggttaccccttaccctacggtaacccttacgttccttacggttccgggacccttccggacgggtccttagggaacgggtaccggtaggtaccgtacgttaacgtttactttaacggtccgtaacggtctaaccggttccttacggtttanacccttaaacgttaccggtacgtacgggtacggttaccgtttacgtaggtttacccggttaaggggttaacggttacggggaacccggttaaagggttaccccgttacggttaccgttaccggttaaggtttccacccgggttaaccccggtaaaccccgg

SEQ ID NO: 233679 - DNA, 326 bp, Homo sapiens
  misc_feature: GYAE6OF01BFBC3.39.86.H09.1.454.CMB.1.raw
  modified_base (268)..(326): a, c, t, g, unknown or other
  misc_feature (268)..(326): n is a, c, g, or t
tcagtcgcactagtcacgaccggtgctcgatttagtgctatagacttggggtttgggggggtttggtggtctccactcccgccttgacgaggctgattattactgcagctcatttgcaatcagtgagctatgtctcggaagtggaccaaggtcatccgtcctaggtcacgcccaaggcccaaccccgatgtccacctccgtcccaccctcctccactagtgcgacgtcgacggcgggctggacgaacggccgataatagcagcatgannnnnnnnnnnnnnnnnnnnnnnnnnnnnnnnnnnnnnnnnnnnnnnnnnnnnnnnnnn

SEQ ID NO: 233680 - DNA, 787 bp, Homo sapiens
  misc_feature: GYAE6OF01BJU37.39.86.H09.1.454.CMB.1.raw
  modified_base (584)..(584): a, c, t, g, unknown or other
  misc_feature (584)..(584): n is a, c, g, or t
tcagtcgcactagtcacgaccggtgctcgatttagtgctatagacttggggtttggggggggtctcgaggaggcagcgctctcgaggacatcctccaccagtcggccgtggctctgtcgtgcctccctccaccctcctcacgtcgagggacacggtcggtccgtcgggccctagttcctcgcccgtgactcgacgtctcgtcccgtccgtgttcgtcggtctcgtagacgtacgtcgactccgaacctcgttccgtccgtcgacgtaccgacggaaccgcgacgtacggttacgggttacggggttagggtatacgtacttacggttcgttccgtaccggttacgacgagtactaaccgttcggaccggacgaacccaacccgaccccgtaaccctaaagtccgtaaagtttacctttaagttaggtaacgtacgttacgtaacgttccgtacgttacccgttagggttaccgtttacctagtccgttcttacgtccgtacgtaccgtctaacgtcgaaccggaacctacccgtcggtacccttacgactcgtacgtccgacgtcgtcccgacgtcggtaacgnggaacggtctacggtatttaacgtgttaccgagtaccgttagacctttactaaccggtgtaaccctaggaccgttaagtcgggtaactttggtacgtttcgggtaagttacccgggtaacggtacggttaacggcccgttaacgtacgtacccggtttaccggaaccggttacccaacggtaaccccggcgttaaaacccccg

SEQ ID NO: 233681 - DNA, 797 bp, Homo sapiens
  misc_feature: GYAE6OF01C1UQP.39.86.H09.1.454.CMB.1.raw
  modified_base (170)..(170): a, c, t, g, unknown or other
  misc_feature (170)..(170): n is a, c, g, or t
  modified_base (332)..(332): a, c, t, g, unknown or other
  misc_feature (332)..(332): n is a, c, g, or t
tcagtcgcactagtcacgaccggtgctcgatttagtgctatagacttgggttgggggtctcaggaggcagcgctctcaggacatctccaccatggcctgggctctgctcgctcctccaccctcctcactcgaggcacgacggtccgtcggcctagtctcgcctgactcgngctcgtccttcgtcgtcgtcggtctacgtacggacgtagtcgatccaacctactccgtcctcgaccgtaacgtaccggaaccacggtcgtaggttacgggttacgggggtttaggggttacttacggtaacttagttcggtccttacggtacgtaaccgtanaaccttaagtccgtaccgaacggaccctaaccgaaccctaacccctaacttacctagttaccttaagtttacgtacggtaacgttacgtaaacggttacccggccggttacccgttaacggggttttaccgggtttaactaaccggtttccgttcctttacgggttccttacggtacccgttaaccgtacgtttacgaccgggtaaacctaccggacccgttccctacccgtaccgtaccgtcttaccgtcgttaccggacccgtacggacggtacgtacgggaacgtacggacggtacgtttataacgtttacgttgacgtactacgtactcgttaacgtacctaacgtacgtacgtacgggtacgttacggtttaccttagggttaacgttcggttaacgggacgggttacgacgttacgtcgttcgtaccgttacgttacgacggacccgtaccggaacccg

SEQ ID NO: 233682 - DNA, 538 bp, Homo sapiens
  misc_feature: GYAE6OF01CLX9L.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatactccaggcacagtcccccaaaactcatcatttatgaggtcaagtaatcggccctgtaggggtttcaatcgcttctctggctcaagtctggacaactacggcctccctgacctatcctctggggcttcccgaggcctagaggtacgaggctgatttactacgtgcgtagccttcaattttcgactaatcagttgacggtcttagtgttcgttacggaagttgggaacccaaggtcaagttccggctaaggtccaacgtcccgaaaccgg

SEQ ID NO: 233683 - DNA, 661 bp, Homo sapiens
  misc_feature: GYAE6OF01AYLFD.39.86.H09.1.454.CMB.1.raw
  modified_base (268)..(268): a, c, t, g, unknown or other
  misc_feature (268)..(268): n is a, c, g, or t
  modified_base (464)..(464): a, c, t, g, unknown or other
  misc_feature (464)..(464): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgccttccgtgtcgtgggtctcgtaggacagtcgatccaccatcctcctgcacgtggaaccagcagtggtacggttgggggttatgactatgtccnctgtaccagacaatctccgaggcaccaccgacccccaaactcaatctatttagagtaggtactaagtaactccggtaccctaggtacggggtttctaacgtcgttcttccgttcgtcgtactaccgtaagtccgtcggacccaaaccgccgtaccctcccgtacgaccctactccgtaccgtcgggccctaccggnggtactaacgggacgggaccggtaggtacttacggtaacttttaacgttaccgtccgacgtaccggttacttaccgttaacgttttacgaaccttaagttacgtaggttggtacgttcgttacgttcgttacggttacgggtaggtacggaaccgtacgtctacgttcgtaccgtaggacccaaggcccgtaacccg

SEQ ID NO: 233684 - DNA, 759 bp, Homo sapiens
  misc_feature: GYAE6OF01A6L5E.39.86.H09.1.454.CMB.1.raw
tcagtcgcactagtcacgaccggtgctcgatttagtgctatagacttggggtttggggggggtctcaggaggcagcgctctcaggacatctccaccatggcctgggctctgctgctcctcaccctcctcactcgagggcacgacgggtcctgggcccagtctgccctgactcaggctcgcctccgtgtcgtgggtctcgtaggactagtccgatccgtacctagtcctccgtagacctacgtcgggtaaacccaggtcctagggtcggtacgggttttacggggggttaatcggtaaaccttagtcgttcccgttaccgtacgggtaacctaggtaccgtaaattacctcgacggtacccaacgtacccgaaccccctaaacttcgaacttacgttacgtttaaggtcgtagggttacctaaggttacccgttccgggtaccctttacgggttaacggggtttacctacgttccggtcttcgtacgtcggtaccctacgtacgtcgtacgaccgtacgaccgtccgtccctagacctacgtcgttaccggtcgtccgtacgacggtactacgggacggtaacggcgtcgtagtacgttagttaccgaggtactaccgtacgtacgttaacgtttcggaaccttagtacgtacggtggtacctttaggtgttacccgttaggttacggtacgggttaccggaaccttaagggtccttacgtaccggtacgttaccggctaacccgggacccgtaaacccg

SEQ ID NO: 233685 - DNA, 721 bp, Homo sapiens
  misc_feature: GYAE6OF01E3JJN.39.86.H09.1.454.CMB.1.raw
tcagtcgcactagtcacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtcctgccctgactcaggctgcctcgtgtctgggtctctaggacagtcgatcaccatcctcctgcacgtggaaccagcagtggtacggttgggggttatgaactagtcgtcctccgtacggtaccagactaatactccgaaggccacgaaccgaccccctaaactccattcctaattttagtacggaggttcaacggttaacgtcccggtacccgttacggttaacgggggttttacctaagtccgtcctttacgttccgtacggtaccttaccgaacggttccgtacggaaccctaacccgaccgggtcccctacccgtaccgaacctacgttccgttcggtcgggtccctccggacgggtctacgggaacgggtacgtacgggtactacgttactttacgtaaccgtcgtacgtacgtccttaacgttacgtttacgacgtaacgtcgaggttacgtaggttaccgtttaaggttccgttacggttacgggtaaacgggtacccgggtaaaccgtacgggtacctacggttaccggttacccgtaaggttccctaaacccgg

SEQ ID NO: 233686 - DNA, 733 bp, Homo sapiens
  misc_feature: GYAE6OF01B94V0.39.86.H09.1.454.CMB.1.raw
  modified_base (280)..(280): a, c, t, g, unknown or other
  misc_feature (280)..(280): n is a, c, g, or t
  modified_base (335)..(335): a, c, t, g, unknown or other
  misc_feature (335)..(335): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacgagggtcctggacccagtctcgccctgactcaggctcgcctccgtgtctgggtctctaggcagtcgatcaccatctcctgcactacggaaccagcgtaggtggtacgggttgggggttatgactatcggtcctccgtcggtaccngactaagtactaccgacggcaaccgaccgaccccctaaactcactacttatttanaggtacgtacgtaacgtacgtcccggtccctacgtacggggtttcctaacgttccgtccgtttccgtaccgtcgtcccgtacgtaacgtcgtacggtaccaaaccgcccggtaccctcccgtacgaaccctacgttccgtaccggtcgggtacccgtcccgagggtccgtaggacgggacggtacggttacgtagtttactttacgttactacggacgtacgtccttacgtttagttacgtaacttacgtaacggtaggtacggtaacggttcgtttaacggttggtttaaccggtacgggtaaacgggttaccgggtaaaccgggttaaacggttcctaaacgggtttccccgttaacggtaccggttacccgaaccgttacccccggaaaccccgg

SEQ ID NO: 233687 - DNA, 644 bp, Homo sapiens
  misc_feature: GYAE6OF01DJ5B2.39.86.H09.1.454.CMB.1.raw
  modified_base (121)..(121): a, c, t, g, unknown or other
  misc_feature (121)..(121): n is a, c, g, or t
  modified_base (629)..(629): a, c, t, g, unknown or other
  misc_feature (629)..(629): n is a, c, g, or t
tcagtcgcactagtcacgaccggtgctcgatttagtgctatagacttggggttgggggtctcaggaggcgtagcgctctctaggacatctccaccatggcctgggctctgctgctccgtcnccctctcactcagggcacaggcctgggcccagtctgccctgactcgaggcctgcctaccgtgtctgggtctctaggcagtcgatcaccatctcgtgcacgtggaccagcaagtgtacggttggggttatggactagtcgtctaccgtaggtaccagactaatactccgaggtccacgaccgacccccaattccagtacctattttacgaggtacggtacaagttaactccggtacccttacgtaaggggttttcctaacgtccggtacctttcgtacgtcggtctaccgtaacggtcgtacgacctaacgaccggtcccttacgacgacctagtacctcgtacggtcctaccgaggtcgtaggacgggtacggtacggcgttagttattacgtactacggtaccgacgtcgtacttgtttaccagttacttcgagttggaccttacgtagtccgtagttacgggtacggtccggtaaccctaaggtccctagttccgtactcggtacnccgtcccgaacccgg

SEQ ID NO: 233688 - DNA, 919 bp, Homo sapiens
  misc_feature: GYAE6OF01ENRKC.39.86.H09.1.454.CMB.1.raw
tcagtcgcactagtcacgaccggtgctcgatttagtgctatagacgttgggggggggtctcaggaggcagcgctctcaggacatctccaccatggcctgggctctgctcgcctcctccaccctcctcactcgagggcacgtacggggtcctgggcccagtctcgccctgactcgaggctcgcctccgtgtcgtggtctcgtacggactacgtcgaactccaactacttcctccgtcgactacgtacggaaccagcgtaggttcggttacgggtttaggggtatcggtacttagttcgttaccgttaccggtacggttaaccgacgtaacgttaacgtaccgtaccggacggaccaacccggaaccctaaacccccttaaacttaccgtaacttaccgtttaagtttacggtacgggtaacggttaaccgttaaacggttaaccggttccccggttaccgggtttaacgggtttaacggggttttaacccttaacggttccgttaccgtttccggttaccggttcggtacccgttaaccggtaacggtttccgtaacgggaaccccgttaaacccggtcccggttacccgttaccccggtaagttaacccgttccgtttacccggtccgggttacccgggttccaacccggggttacgacgggtaacggggtaacccggtaagggtaccgggtttaacgtttaacgtttaaccgtttttaccgaacgttaccgggcgttaacgtcccgtttacggttaacttccggtaaataccggttacggtaagggttacgttaacgttacgtttaaccggtaccggtttaaccgggttacgggtaaccgggtacccggtaacggttagtcccggttaacgtccgttacggtaaccgtaaccggtacccgacccggaccgtaaacccc

SEQ ID NO: 233689 - DNA, 807 bp, Homo sapiens
  misc_feature: GYAE6OF01DARX3.39.86.H09.1.454.CMB.1.raw
  modified_base (291)..(291): a, c, t, g, unknown or other
  misc_feature (291)..(291): n is a, c, g, or t
tcagtcgcactagtcacgaccggtgctcgatttagtgctatagactttgggtttggggggggtctcaggaggcagcgctctcaggacatctccaccatggcctggctctgctgcctcctcaccctcctcactcgagggcacagggtcctgggcccagtctgccctgactcgagctcgcctcgtgtctgggtctcaggacagtcgatcaccatcctcctgactacgtacggaacagcaggtggtacggttggggttatcggtacttagtcgttacctccgtacggtaaccanaccaattacgtaccgacggaccaaccgtaaccccggtaaccccctaaatacctaacttacgtaattttacgaggtaacggtacgtaacgtaaccgtcccggtccttacggttaacgggtttactaacgtcgtaccttcgtacgtcgtacgtccgtaacgtcgtacgaacccaaccgtccggtaccctaccgtacgtacctacgttccgtacgccgggtaccctaccggaggtccgacggtacgggaacgttaggtccgtaattactttaaccgtacgtcgtaacccgtaggtttacctaacggttttccgtaacgaaccgttaacgtttaacgggttaagggtaaccgggtttaaccggttacccttttaaagggtttcgggtttaaaaccccgggttaccggggggtaaagggtttaccccggaaaacggttacggtttcccggtaacccggtttttaacccggacccgggttaggtaaaccccccgacgtaacccccccgggttaaaacccccg

SEQ ID NO: 233690 - DNA, 351 bp, Homo sapiens
  misc_feature: GYAE6OF01EK4R6.39.86.H09.1.454.CMB.1.raw
  modified_base (290)..(351): a, c, t, g, unknown or other
  misc_feature (290)..(351): n is a, c, g, or t
tcagtcgcactagtcacgaccggtgctcgatttagtgctatagacttggggtttgggggggtttggtggtctccactcccgccttgacgaggctgattattactgcagctcatttgcaatcagtgaggcttatgtcttacgggaaggtggggaaccaagggtcagttccgtcctaaggtcacgccccgaagggtcccaaaccccctacgtgtccacctccttcgttaccccaccctcctcactaggtgccgacgtggacggccgggtctggaccaaggtcgacagtagcnnnnnnnnnnnnnnnnnnnnnnnnnnnnnnnnnnnnnnnnnnnnnnnnnnnnnnnnnnnnnn

SEQ ID NO: 233691 - DNA, 734 bp, Homo sapiens
  misc_feature: GYAE6OF01DMHUJ.39.86.H09.1.454.CMB.1.raw
  modified_base (350)..(350): a, c, t, g, unknown or other
  misc_feature (350)..(350): n is a, c, g, or t
tcagtcgcactagtcacgaccggtgctcgatttagtgctatagacttggggttgggggtctcagggaggcagcgctctcaggacatcctccaccatggcctgggctctgctgcctcctccaccctcctcactcgagggccacgacgggtccgtcgggccctagtcgtcgccctgactcgaggctcgcctccggtgtcgtcgggtctcgtaggacagtcgactcaccactcctctcgacacgtacggaacagctaggtaggtacggtttagggggttatagtaacttgtcgtcttccgtacggtaccagacaatactaccgagacaccaccgacccaactcactctaattnaggtacgtactacgtaacgtccggccgtaggttacggtttactacgtcgtccttcgtcgtcgtactacgtaagttcgacgacctaaccgaccgtcctaccgtaccgtaccgtacgtccgtcggtcggtaccgtaccgtcggtacggtacggacgggtaacggtacggtacgttaacgttaacgtttaacgttacgtcgtcgtacgtaccttacgttacttacgggggggggggggggtactaacgttacgtaggtacggttacggttacgttacggttacggttaccgggttaacgggtaacgggtaacgggtaccggttaacggtaccgttaaccgttacccggttacggtaccggtaccggtaccgtaacccggtaaccccg

SEQ ID NO: 233692 - DNA, 268 bp, Homo sapiens
  misc_feature: GYAE6OF01C9KG1.39.86.H09.1.454.CMB.1.raw
  modified_base (183)..(183): a, c, t, g, unknown or other
  misc_feature (183)..(183): n is a, c, g, or t
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (210)..(210): a, c, t, g, unknown or other
  misc_feature (210)..(210): n is a, c, g, or t
  modified_base (243)..(243): a, c, t, g, unknown or other
  misc_feature (243)..(243): n is a, c, g, or t
  modified_base (248)..(268): a, c, t, g, unknown or other
  misc_feature (248)..(268): n is a, c, g, or t
tcagtcgcactagtcacgaccggtgctcgatttagtgctatagacttggggtttggggggtttggtggtctccactcccgcttgacgaggctgattattactgcagctcatttgcaatcagtgaggtcttatgtcgttcgggaagtggaccaaggtcatcgtctaggcagccaagccaacccntgcactctccgtcccncctcncactgngcacgtggacggcgggctggacgaaggccgtanagtgnnnnnnnnnnnnnnnnnnnnn

SEQ ID NO: 233693 - DNA, 633 bp, Homo sapiens
  misc_feature: GYAE6OF01BMA71.39.86.H09.1.454.CMB.1.raw
  modified_base (312)..(312): a, c, t, g, unknown or other
  misc_feature (312)..(312): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctcgccctgactcaggctgcctcgtgtctgggtctcgtaggacagtcgatcaccatcgtctgcacgtgaaccagcagtgacggttggggtaatgtactagtgtctcgtggtaccagcaatatccaggcacaccgaccccaatccagtctatttagngtagtctaagtaactccggtccctacggtacggggtttactaactcgtccgttctacgtgtcctacgaagtcgtaggacaaccgacgtccctacctcgtaacctactcgttcgtccggtccgcgtacggactcggacggtacggtacggcgtagttaacgtttacttacgtacgacgtacgtaccttattacgttcgaacctaagtccggtaggtacgtcggtacctttagttaggttaccggttacggaaggggttaccggtacgtaacggttcgtacttccggtaccttaacgggtactaccggacccgtaaaccccgg

SEQ ID NO: 233694 - DNA, 678 bp, Homo sapiens
  misc_feature: GYAE6OF01C07ZY.39.86.H09.1.454.CMB.1.raw
  modified_base (233)..(233): a, c, t, g, unknown or other
  misc_feature (233)..(233): n is a, c, g, or t
  modified_base (656)..(656): a, c, t, g, unknown or other
  misc_feature (656)..(656): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcgagggcacagggtcctgggcccagtctgccctgactcgaggctcgcctcgtgtctgggtctctaggacagtcactccaccatcctcctgccacgtacggaaaccngacaggttacgggtacgggttttgggggtatagacttatcgtctaccgtacgtaaccagtactaatactaccgacggaccaaccgacccgaccccctaaatctacttactaagtttagaggtaacgttactaacggtacgtcccggtacccttcgggttaacggtttactaacgtccgttcttcgtcggtacgtacctacgtacggtcgtacggaccgtaacgcccgtaccctccgtacaccctacgtctccggtcggacccttacggagtcgacgggacgacggtacgtcttagtactttacgcgtcgaacgtcgttactacgtttcgttcgaacttacgttacggtaggtacgtagttacttacgtcgtttaaccgggaggtacggtaccgggtaactaccgtactacggttccgtaacgngtacccacgacccgtaacccgg

SEQ ID NO: 233695 - DNA, 711 bp, Homo sapiens
  misc_feature: GYAE6OF01BJOTO.39.86.H09.1.454.CMB.1.raw
  modified_base (216)..(216): a, c, t, g, unknown or other
  misc_feature (216)..(216): n is a, c, g, or t
  modified_base (230)..(230): a, c, t, g, unknown or other
  misc_feature (230)..(230): n is a, c, g, or t
tcagtcgcactagtcacgaccggtgctcgatttagtgctatagacttgggctggggtctcaggaggcagcgctctcaggacatctccaccatggcctgggctctgctgctcctcaccctctcactcgagggcacgagggtcctgggcccaggtctcgccctgactcgaggctcgcctcgtgtctcgggtctcgtaggacagtcgatcaccatctcngcacgtcggaaccngcaggtgtacggttggggtatagacgttatcgtactcgttacggtacctagactaactacgtcgaacgtaccgaacgaccgtaaacccctaactacgtaacttaccgttaattttaacgtagtacggttacctaacgttaacggtcccggtacccgtttaggggttaacgggtttcctaaacgtcccggttactttaccgttcggtacggtacctaaccgttaaacggtcgtaacggtacccgtaaacgccggttcccttacggtaccctaacgtacttccgtcggtcggacctcggacggacgtagggtacggtcggtaacggtctaacgtttaagttacgttacgacgtacgtacttaccgtacttagttacgaacttacgtacgaggttacgtcggttccttaacgttcggtaacggttacgggacggttaacggacgtagtctaacggtaccgtacgtacggacgtaccgtaacccg

SEQ ID NO: 233696 - DNA, 1021 bp, Homo sapiens
  misc_feature: GYAE6OF01BC7GG.39.86.H09.1.454.CMB.1.raw
  modified_base (122)..(122): a, c, t, g, unknown or other
  misc_feature (122)..(122): n is a, c, g, or t
tcagtcgcactagtcacgaccggtgctcgatttagtgctatagacttgggggggggtctcaggaggcagcgctctcaggacatctccaccagtggcctgggctctgctgcctctcaccctcncactcgagggcacggacggtccgtcgggccagtctcgcccgtgtactacgcgtctcgtccgtcgtcgtcgtcggttctcgtaggactagtcgactacctactactcctccgtacgtaccgtaccgtaacggaaacctcggacgttaacggttacggggttacggggtttaaggggttacgtaccgtacgtttacgttaccggttccgtttaccggttaaccggacgtaaaccggttaaccttaacgtaaccggttaaccccggaacgaaacccccgtaacccgttaacccccggaaaacccccgttaacgtacgtttaaccctttaaacgttttacgggtttaacgttaaaccgggttaaccggttaacgttaaaacgggtttaaccccggggttcccgtttaacccggggttttaacgggttttaaaccgggtttccttaaaaccggtttccgttttaaccgttcgttaaccgttaccgggtttacctaaaccggttcgtaccggtaaacccggtaaccgttaacccggttccccgttaacccgttttaccccggaacttaacccggttaacctttcccgggttacggtaccgggttaccggtacccggtaacggtaccggtacgggaaccgggttacgtaggttaaccgttacgtttaaacgttaccggtttacgggtacctaccgttacgttaccgttacgttaacgttacgttacgtaaaccgggttacgttacgggtccggttaacggtttacgtttaaccggtttacggggtttaacccgggttaacggttaaccgggttacccgggttaaaaccggttcggttaaccgttcggttaccgttaacccggtaccggaacccgttaaccggaccccgtaaaccggttaacccccg

SEQ ID NO: 233697 - DNA, 748 bp, Homo sapiens
  misc_feature: GYAE6OF01AZP2J.39.86.H09.1.454.CMB.1.raw
tcagtcgcactagtcacgaccggtgctcgatttagtgctatagacttggggggggggtctcaggaggcagcgctctcaggacatctccaccatggcctgggctctgctgctcctccaccctcctcactcagggcacgaggggtcctcgggcccagtctcgcccctgactcaggctcgcctccgtgtcgtgggtctcgtaggacagtcgatccacctatcctcctgacactacggaaccacgcgtacggtcggtacgggtttggggggttaatcggaacttagtcgtccgtaccgttacgggtaccagacctaaatacgtaccgacggaccaaccgacccgaccccaaactctactacttactttagtaggtacggtactaacgttaacgtcccggtaccccgttagggttaaccgggtttacctaaccgttcggtacctttcgtccgtaccgtacccgttaccgaacggtttcgtaacggtacccaaaccggtaccccggtcccttaccccgtacgtaccctaccgttaccgttccggtcgggtacccgtccggtacgggtaccgtagggtaacggacgtacggttcgtagttacgtttacgtaacgtcgtacgtgtcttacgtattacgactaacttcgagtacgtaacgttgttacgttcgtacggtaacgggcggtacgggtaaccggtacgttacgtaacggttcgtaacggtacgtacccgacgaacccgaaccccgtaaccc

SEQ ID NO: 233698 - DNA, 735 bp, Homo sapiens
  misc_feature: GYAE6OF01AQVBI.39.86.H09.1.454.CMB.1.raw
  modified_base (243)..(243): a, c, t, g, unknown or other
  misc_feature (243)..(243): n is a, c, g, or t
  modified_base (305)..(305): a, c, t, g, unknown or other
  misc_feature (305)..(305): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttangactatgtctcctggtaccagacaatactccgaggccacacgaccccaaatcatctatttangagtcaagtaactccggacccttcggtaggggtttctaacgttccgtctttccgtacgtcggtcctacgaacggttccgtacggacctaaccgacccgggtcccttaccccgtacggtaaccctacgttcccgttaccggttacggggtaccccttacccggaacgggtccgttacgggaaccggggtaaccggtacgggtaccttagggttaacttttacgttaccgtcggtaccgtaacgtccgttacgtacgttttacgaacttaacgtaccggtaggttacggtacgggttacttttacggttaccggttaccgggtttaacggggaacgggtttaccggggtaacccgttaaacggggttaccctacgggttaccccgttaccggttaacgggtacccgtaaccggtaaccccggaaaccccggg

SEQ ID NO: 233699 - DNA, 266 bp, Homo sapiens
  misc_feature: GYAE6OF01E3TT9.39.86.H09.1.454.CMB.1.raw
  modified_base (183)..(183): a, c, t, g, unknown or other
  misc_feature (183)..(183): n is a, c, g, or t
  modified_base (214)..(214): a, c, t, g, unknown or other
  misc_feature (214)..(214): n is a, c, g, or t
  modified_base (237)..(237): a, c, t, g, unknown or other
  misc_feature (237)..(237): n is a, c, g, or t
  modified_base (242)..(266): a, c, t, g, unknown or other
  misc_feature (242)..(266): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtctagtcagcccaagccaaccccntgtcactctcgtcccgccctcctcactagtncgactgagcgggctggcacggcncatgnnnnnnnnnnnnnnnnnnnnnnnnn

SEQ ID NO: 233700 - DNA, 695 bp, Homo sapiens
  misc_feature: GYAE6OF01AEE5R.39.86.H09.1.454.CMB.1.raw
  modified_base (86)..(86): a, c, t, g, unknown or other
  misc_feature (86)..(86): n is a, c, g, or t
  modified_base (116)..(116): a, c, t, g, unknown or other
  misc_feature (116)..(116): n is a, c, g, or t
  modified_base (162)..(162): a, c, t, g, unknown or other
  misc_feature (162)..(162): n is a, c, g, or t
  modified_base (291)..(291): a, c, t, g, unknown or other
  misc_feature (291)..(291): n is a, c, g, or t
  modified_base (518)..(518): a, c, t, g, unknown or other
  misc_feature (518)..(518): n is a, c, g, or t
  modified_base (573)..(573): a, c, t, g, unknown or other
  misc_feature (573)..(573): n is a, c, g, or t
  modified_base (591)..(591): a, c, t, g, unknown or other
  misc_feature (591)..(591): n is a, c, g, or t
  modified_base (614)..(614): a, c, t, g, unknown or other
  misc_feature (614)..(614): n is a, c, g, or t
  modified_base (642)..(642): a, c, t, g, unknown or other
  misc_feature (642)..(642): n is a, c, g, or t
  modified_base (679)..(679): a, c, t, g, unknown or other
  misc_feature (679)..(679): n is a, c, g, or t
tcagtcgcactagtcacgaccggtgctcgatttagtgctatagacttgggttgggggtctcaggaggcagcgctctcaggacatcnccaccatggcctgggctctgctgctcctcnccctcctacactcgacggcacgacgggtcctcggaccctagttccncgtccctagacctcgacggtctccgtcccgtcgtgtccgtagggtctacgtacgacgtgtcgactccacacttcctcctgacctacgacggaaccaggacgtaggtacggtaggggttttcggggttanacggtaccgtaagttccttcgtaccgttaggaccagtacttaacgtacctcgaacggcctaacgaccccgtaaccccgaacttacacgtcgtttaagtttacgacgggtacgacgtaacgtaaccggttccgtacgttacccgggttaggttacctaaccttccggtttatcctcccgggtacgtaccgttacgaacgttccaggttacccaaccgttccggtcccnccgtacgtactctccgtacgtcgtccaacggacgtcggtacgacggacggacgtntacggtattacctggtcncgagtacttctacgtctactaancgtaggtactagttctaactcggtacgnggtacggaccgacgtacgttccaggttccgacgttanaccgtgacccggtacg

SEQ ID NO: 233701 - DNA, 778 bp, Homo sapiens
  misc_feature: GYAE6OF01CRXND.39.86.H09.1.454.CMB.1.raw
tcagtcgcactagtcacgaccggtgctcgatttagtgctatagactttggggtttggggggggtctcaggaggcagcgctctcaggacatctccaccatggcctgggctctgctgctcctcacctcctcactcgaggcacgacgggtccgtcgggcccagtctcgccctgactcaggctcgcctcgtgtcgtggtctcgtacgacagtcgactcactactctctcgtacacgtcgaacagcgtaggtcggtacgggtttaggggtatacggtacttagtcgtcctacggtacgtaccagtacctaagtaccgacgaacgtaccgaacctaaccgaacccctaaactctaactttacgttaaagttttacgacgggttacgtaataaccggttaaccgtcccgggtaccgttaagggttaccgggtttaactaacttccgttcttccgttacggcgttacccgtacgtaacggtacgtccggaaacctaaccgcccggtcccttacccgtacgtaccttaccgttcgtaccggtacggacccttacgggacggtaacggtagggaaccggaacggttcggttaacgtacggtttaatttaccggtaaacgtccgtaacgtaacgtttcctacgtttaacgtacgtaaacgtaacgttctaaggttcggtaaccgggtttatacgggttacggttaacggtaaagggtaaccgggacggtaacccgtaggttacccacggttaaccggttctaaggacccgtaccgaaacggtaaccccg

SEQ ID NO: 233702 - DNA, 867 bp, Homo sapiens
  misc_feature: GYAE6OF01B1J3N.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctcgccctgactcaggctcgcctccgtgtagtcgggtctctaggacagtcgatcaccatcctcctgcacgtacggtaaccagcgtaaggtggtacgggtttgggggttataggtacttagtcgttccgttccgttacggtaaccagtactaaacttacgtccgaaggaccaaccgacccggaaaccccccctaaacttacgtaacttaccgtttaaagttttaacgcggtaaacgggtttccgtaaagttaaaccggttcccggtaccccgttacgggttaacgggggtttttcctaaacgttccggttcctttccgttccggtaccgggttacccttaaccggtaaacggttttccccgacggggtaaaccctaaacccggtacccgggttaccccccttcccggttaacccggtaaccccttaaccgtttccccgttacccggggtcccggggttccccgttaaacccgggcgggtacggtttaaccggggaaccggggtaccgggtaacggtttaccggtactttaagttttaaaccgttcgtaccggtacgtaaccggtcctttacgttaacgttttggaacttaacgttcggaacggttaggtacgttacgtttagtacggtttacggtacgggtaacggttaccgggtaacgtaacgttcgaccgttacggtacgtagacccggtacgtaccccggtaaacccgg

SEQ ID NO: 233703 - DNA, 744 bp, Homo sapiens
  misc_feature: GYAE6OF01ER47P.39.86.H09.1.454.CMB.1.raw
  modified_base (481)..(481): a, c, t, g, unknown or other
  misc_feature (481)..(481): n is a, c, g, or t
tcagtcgcactagtcacgaccggtgctcgatttagtgctatagacttggggtttgggggggggtctcaggaggcagcgctctcaggacatcctccaccatggcctgggctctgctgcctcctccaccctcctcacctgacgggcacgacgggtccgtcgggcccagtcctcgccctagactcgaggctcgccgtcgtcgtcgtggtctcgtaaggactacgtcgactaccgacctacttcctccgtacgtacctaccgtacgaaaccgtgaccgtagggtttacgggtaacggggtttaggggtaattacgtacttacgttccgttccgttacggtaccggtaacacgtaactaactaccgtaccgaacggaccaaaccccgaaccccgtaaccccttaaaactcgtaactttacgttagtttacgaggtaccgtacgtacgtaccgtccggtaccgtagtacgttcacgtcgtattccgngtcgtactacgtagtccgacgtaccgtaccggccgtacccgtcactaccgtacgtcgtcggtccgtaccggcgacgtcggtaacggacgacggtacgtacgttagttacgttactacgtactcgtactcgttactacgtacgtacgtacgtacggtagttcggtacgttcgttacgttacggttcgggtacggtaggttacggtacgttaccgtaccggtcgttaaccggtaccgtacggtacccaccgggtacccgaacccg

SEQ ID NO: 233704 - DNA, 799 bp, Homo sapiens
  misc_feature: GYAE6OF01D6I7G.39.86.H09.1.454.CMB.1.raw
tcagtcgcactagtcacgaccggtgctcgatttagtgctatagacttggggggggggtctcaggaggcagcgctctcaggacatctccaccatggcctgggctctgctgctcctcaccctcctcactcagggcacgagggtcctgggcccagtctgccctgactcaggctcgccccgtgtcgtggtcgtctacgtacgagtcgataccaccactcgtcctcgaccacgtacggaaccacgacgaggtggtacgggttgggggttagtcggtaacttagttcgttaccgtccggttcggtaccagacctaataacttcccgaacggaccaaccaacccgaacccccctaaactacgtacttacttaatttagtcggtaacgggtactaaggttaaccgtcccggttcccttaacgggtcgggttttactaagtccgttcttacgtccgtggtcctaacgtaacgtcgtcggaacctacgtaccgcccttaccctacggtacctacgtccgttacgtcggtaccttaccggacggtacgtacggacgggtaacggtcgggtacgttaacttacgtttaacgttccgacggttaccgagtaccttacgttacgttacgaccgttaaagttcggtacgttacggtacggtttaactttccggttagggtttaccggttaaccgggttacggggttaacccgggtaacggttaacgtttacccggtacgtttacccgggtacccggttaagggaccccgaaacccggtaaccccgtaaccccggtaaacccccgtaaaccccgg

SEQ ID NO: 233705 - DNA, 667 bp, Homo sapiens
  misc_feature: GYAE6OF01BH2P1.39.86.H09.1.454.CMB.1.raw
  modified_base (238)..(238): a, c, t, g, unknown or other
  misc_feature (238)..(238): n is a, c, g, or t
tcagtcgcactagtcacgaccggtgctcgatttagtgctatagacttggggtttgggggggggtctcaggaggcagcgctctcaggacatctccaccatggcctgggctctgctgctcctcaccctcctcactcacgggcacgagggtcctgggcccagtctcgccctgactcaggctcgcctcgtgtcgtgggtctctaggacagtcgatcactatcctcctgcacgtacggaaccngcaggtggtacgggttagggggttataggactagttcgtctccgtggtaccagacaatctccgaggcacaccgaccccctaatcattctatttacgaggacgtactaaggtacgtccggtccgttacggtacgggtttactacgtctcgttcgcgtcgtctacgagttccgagacccacggtacccgtcctccgtactacctactccgtcgtcgggccccttacggacggttcgacgggacggtaacggtcggtacgtttagttaactttacgttacgcgtacgtccgtaccgtataacgttaaccgaagtaccgacacggacctacgtcttacggttacggtttaggtacgggttaccggtacgggggaccggtaccgggtaacgacggtccgtaccgggtacccgttcggtaccggccgtaacccgg

SEQ ID NO: 233706 - DNA, 736 bp, Homo sapiens
  misc_feature: GYAE6OF01AOK4Y.39.86.H09.1.454.CMB.1.raw
tcagtcgcactagtcacgaccggtgctcgatttagtgctatagacttggggttgggggtctcaggaggcagcgctctcaggacatcctccaccatggcctgggctctgctgctcctcaccctcctcactcgagggcacgagggtcctgggcccagtctcgcccctgactcaggctgccctcggtgtcgtggtctcgtaggacagtcgatccaccgtatctcctgccacgtacggaaccacgcgtaggtggtacggtttgggggttaatgaacttagtcgttccgtccgttaggtaccaaggtactaagtacgtaccgacggaccaacccgacccgtaaccccctaactctaatcttaatttagtaggtacgtaccgtaaggttaccgtacccgggtacccgttacggttacgggtttacctaacggttccgttctaccgttcgtcggtacctacgtaacgttcgacgaccgtaccgtaccgcccttaccgcgtaaccgtccgttccgtaccggtcgggtcccaccggtagggtaccggtagggaccggtaaggcggttaccgttaagttacgtttaacgtcgtgtaccctcggttaacttacgttaccttaaggccttaagtccggtaggtacggtagttcgtttaacgtggttaaccggttaggacccggggttacgagttaccgtacgttacgtacccggttacggtaccggaaccgccgtaacccgaaccccg

SEQ ID NO: 233707 - DNA, 769 bp, Homo sapiens
  misc_feature: GYAE6OF01BQ9EZ.39.86.H09.1.454.CMB.1.raw
  modified_base (237)..(237): a, c, t, g, unknown or other
  misc_feature (237)..(237): n is a, c, g, or t
  modified_base (558)..(558): a, c, t, g, unknown or other
  misc_feature (558)..(558): n is a, c, g, or t
  modified_base (566)..(566): a, c, t, g, unknown or other
  misc_feature (566)..(566): n is a, c, g, or t
  modified_base (579)..(579): a, c, t, g, unknown or other
  misc_feature (579)..(579): n is a, c, g, or t
  modified_base (589)..(589): a, c, t, g, unknown or other
  misc_feature (589)..(589): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacgaggtcctcgggccagtctgccctgctcaggctgcctcgtgtcgtggtctcgtaggactacgtcgactcacctacttcctcctgcacgtacggaaccngctaggtggtacgggtttgggggttatcgtacttagtcgttaccttccgtcgtaaccagactaatactccgaggccgaccaccgaccccgaatctacttcttaagttacgtagtacggtactaaagttacgtccggttacccggttacggttaacgggggttttacctaacggtttccttcctttaccgtacgtttaccgggtaccttaacccgtaaggttccgtaacggtacccaaaccggtacccgtcccttcccgtacgtacctacgtccgtccggttcggaccctccggtacgtcggtagaccgggtaagtccggtnttaacgtnttttaaccgtacncgtacgtacncgtttaccgttattacccggtattaacggtacgttaaggttaccgtcggttttaacttagggttttacccggtaccgggtttaaggggacgggttacggtaaacccgggtaagtttaccgtaaccggttccgggttaaaccgtttacggaacccaccccggggttaaccgaaacccccgg

SEQ ID NO: 233708 - DNA, 834 bp, Homo sapiens
  misc_feature: GYAE6OF01AHLVY.39.86.H09.1.454.CMB.1.raw
  modified_base (512)..(512): a, c, t, g, unknown or other
  misc_feature (512)..(512): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcgacgggcacacgggtcctcgggcccagtctcgccctgtactcgaggtctcgtccgtccggttcggtccgtcgggtcctacgtaacggtacctaggtccgactaccacctacgtcctccgtgactacgtacggaaccagcgtacggtacggtacgggttaggggttaactaggtactagttcgtaccgttacggtacgtacctacgacctaatctacggacgtcaaccgtaccaaccctatactaacgtacttaacgtttagaccggtagtacctaacggtaaccgttccgtaccgtacggttacgttaccgtacgtcgtactcgtacgtcgtcctaagtacgtcgtaccgtaacgaacgtaccggtcccacggtactaacccgngtttaccgtccgggttacgttaccctaaccgggaggttaacccgttacgggaaacgggtacgtacccggtaaggttttccctaaaggttttcgaaccggtttcggaacctacggtttacccgttaaggtttaaacccttacgggtaaaccggttacttaacccgggacccgggtttaaagtccggtttttaactaaacgggtttcccggggtttaaagtaacccggggggtactaaaacccgggttcgtaaaaggttccccgtttacgtaacccggtttaccggaccggtttcccgaaacccgggttaaccccaaacccggg

SEQ ID NO: 233709 - DNA, 899 bp, Homo sapiens
  misc_feature: GYAE6OF01E36BH.39.86.H09.1.454.CMB.1.raw
  modified_base (125)..(125): a, c, t, g, unknown or other
  misc_feature (125)..(125): n is a, c, g, or t
  modified_base (500)..(500): a, c, t, g, unknown or other
  misc_feature (500)..(500): n is a, c, g, or t
tcagtcgcactagtcacgaccggtgctcgatttagtgctatagacttgggttgggggtctcagggaggcagcgctctcaggacatctccaccatggcctgggctctgctgctcctcaccctcctnactcagggcacgagggtcctcgggcccagtccgtgccccgttgaccgtcaggtcctcgcccgttcggtcggttcgtggggtacctctacgggtacaggttccgactccgtaacctacttcccgttccgtacgcccgaacgttacggggaaacccaacgtctacgggttacgggtaccggggttttaggggggtttaacacgggtaccttaagtccggtcccttacccggtaccgttaaccacggtaccttaagttaaccaccggtaggacccaacctacccggaaacccccctaaacgttcctaacttccttaaagttttcgaggtaccgtttacacgggttaacctcccggccgttaggttacggttaccttancgtctttcgtacgtcgtaccctaacgtagtccgtacggacctaccgtacccggtccccgtaacgtccctactaccgttccgtaacggtcgggtaccgtaccggtacgggtacggttaccgggtacgggtacccggtagggttaccgttaccggttaacctttagtttaaccgtcggggaacctttcgggttaaccctaacgttcgttaaaccgttaaggtaacttaaaccgtacgggtttaacgttcggaacccgtttccggtaaggttccgggtttccggttaccggggttacccgggggttacggggaaaccccggttaaacccggggtttacgggttccccgtaaacccgggtttcccggtaaaccggggttaccccggtaaccgtacccccgggg

SEQ ID NO: 233710 - DNA, 775 bp, Homo sapiens
  misc_feature: GYAE6OF01C0004.39.86.H09.1.454.CMB.1.raw
  modified_base (201)..(201): a, c, t, g, unknown or other
  misc_feature (201)..(201): n is a, c, g, or t
  modified_base (623)..(623): a, c, t, g, unknown or other
  misc_feature (623)..(623): n is a, c, g, or t
tcagtcgcactagtcacgaccggtgctcgatttagtgctatagacttgggttgggggtctcaggaggcagcgctctcaggacatctccaccagtggcctgggctctgctgctctcaccctcctcactcagggcacagggtcctgggcccagtctcgccctagactcaggctcgcctccgtgtcgtcggtctcgtaggaccngtacgatccacctactcctcctcgacctacgtacgaaccgacgcgtaggtacgggtacgggtttagggggttatcggtaacttagtcgttccttccgtacggtaccagactaacttacgccgacggtaccctaacgaccccggaaccccctaacgtactaataccttaagttttaacgcggtaacgggttaaccgacgtaacggtcccggtacccggttacggttaacgggttttccttaaacgttccggttcttttacccgtcggtcggtaaccctttccgtaaacgggttccggtacggtacctaaccggtccccgttaccctaccgttaccgtaaccctacggtttcgtacccgggtagggtcccgtacggtacggacggtagggacgggtaccggaggttcctagtttaacgtttacncggttaccgactaccgtcttaattcgttaccgactacgtacgtaggtcgtagggttactcggttccggttacggtacggaacgggttaccggaacgttcgttaccgtagttcccgggtacgacccgggtaccgaacgccccgggtaaacccg

SEQ ID NO: 233711 - DNA, 698 bp, Homo sapiens
  misc_feature: GYAE6OF01DRSMC.39.86.H09.1.454.CMB.1.raw
  modified_base (227)..(227): a, c, t, g, unknown or other
  misc_feature (227)..(227): n is a, c, g, or t
  modified_base (390)..(390): a, c, t, g, unknown or other
  misc_feature (390)..(390): n is a, c, g, or t
tcagtcgcactagtcacgaccggtgctcgatttagtgctatagacttgggtgggggtctcaggaggcagcgctctcaggacatctccacatggcctgggctctgctgcctcctcaccctcctcactcgacgggcacgacgggtcctggggcccagtctcgaccctgactcaggtctcgcctcgtgtcgtgggtcctacgtagacagtcgactccacctactcctccncgacctacgtacggaaccaggcgtaggtaggtcgggttaggggttactagtaacgttagtcgtccgtaccgttagaacccagtaactaagtactaccgaggtacccaaccgaccccgaacccctaactcacttactatttaggacgtacggtacacggttacnccggtaccgttcgttaacggttactacgttccgttacctcgttacgcgtaccttacggtaacggtccacggaacctacccggtaccctccccgtaccgtacgtacctcgtaccgtaccggtcgtacccgtcgtacggtacggtacggacgggtacgtacggtacgttacgttaacgttacgtactacgtcgtactccttacgttactcgtaactctagtcgtagtcgttagtacgttgtacgggtaacgtagggtacgtaacgtagtacgtacgttcgtaacgacgtaccaccgtaaccgtaaccccg

SEQ ID NO: 233712 - DNA, 742 bp, Homo sapiens
  misc_feature: GYAE6OF01EKQ2N.39.86.H09.1.454.CMB.1.raw
  modified_base (137)..(137): a, c, t, g, unknown or other
  misc_feature (137)..(137): n is a, c, g, or t
  modified_base (235)..(235): a, c, t, g, unknown or other
  misc_feature (235)..(235): n is a, c, g, or t
  modified_base (237)..(237): a, c, t, g, unknown or other
  misc_feature (237)..(237): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacgnggtcctgggcccagtctcgccctgactcgaggctcgccttccgtgtcgtgggtctctaggacagtcgactcacctatcctcctgctacgtcggaaccngnagtggtacgggtttaggggttactgacttatcgttccgtaccgttacggtaccaaggtactaacgttactcccgacggaccaaccgaccccgaacccccctaaaattcctaacttaccgtaattttaacggcgtaaggttaacaaggttaaccgtccgggtacccgttaggttaacgggtttactacgtcgttcttccgtcgtcgtacctacgtacgtcgaggaccacgaccgtccctactacgaacctgttccgtacggttcgacccgtacgtggacgtacgggacgtacggtacgtcttaaacgttactttaacgttccacgggttacacgttacccttacggttaaacgtttcgaaactaacgggtttccgaagggtttacggtaccgtttagtttaccggttagtttaccggggtacggtaaacgggttcgaaacgggttaaccgtctaaccgggtttccacggttaacccgggtccaacccgggtacccccgtaaaacgg

SEQ ID NO: 233713 - DNA, 680 bp, Homo sapiens
  misc_feature: GYAE6OF01BIJRP.39.86.H09.1.454.CMB.1.raw
  modified_base (212)..(212): a, c, t, g, unknown or other
  misc_feature (212)..(212): n is a, c, g, or t
  modified_base (644)..(644): a, c, t, g, unknown or other
  misc_feature (644)..(644): n is a, c, g, or t
tcagtcgcactagtcacgaccggtgctcgatttagtgctatagacttggggttgggggtctcagggaggcagcgctctcaggacatctccaccatggcctgggctctgctgcctcctcaccctcctcactcgagggcacgtagggtcctgggcccagtctcggccctgactcgaggctcgcccgtccgtcgttcgttgggtctcgtaggacnggtacgatccactcttcctccttcgcacgtacgggaaccacggtactacgggttggtaacggggtttggggttactaggtacttgtcgttaccgttccgtacgtaccgagactaactaccgtacgaccggtaccaaccgtacccgtacccctaaactctacttaccttatttagtcgtagtacgtaagtaccgtcggtccgtacggttacgggttactacgtcgtcttaccgtgtacgtctcgtaacgtcgtacgaccacgtacccgctcccgacaccttactcgtcgccggtccgtaccggcgtacggtagggacggtacggacggttactacgttagttacgttcgatacgtcgtctacttaacgttctacgtactaggagtacggttgtacgtgttacgtcggttaagggtacggacgtacggacgttnaccggttactcggagtaccggacctaccggtacccg

SEQ ID NO: 233714 - DNA, 680 bp, Homo sapiens
  misc_feature: GYAE6OF01DADUB.39.86.H09.1.454.CMB.1.raw
  modified_base (167)..(167): a, c, t, g, unknown or other
  misc_feature (167)..(167): n is a, c, g, or t
  modified_base (199)..(199): a, c, t, g, unknown or other
  misc_feature (199)..(199): n is a, c, g, or t
  modified_base (234)..(234): a, c, t, g, unknown or other
  misc_feature (234)..(234): n is a, c, g, or t
tcagtcgcactagtcacgaccggtgctcgatttagtgctatagacttggggggggggtctcaggaggcagcgctctcaggacatctccaccatggcctgggctctgctgctcctcacccctctcactcagggcacgagggtcctgggcccagtctcgccctgactcnggctgcctccgtgtcgtgggtctcgtaggacngtcgatcaccatcctcctgacctagtcggaaaccngacgaggttcggacgggttttgggggattaggacttagtccggttctccgtacggtaaccagtacctaagtacaccggagaccaccgacccgaacccaaactcacttatatttagcgtaacggtactaacgtacgtcccggtaccgtagttaacgggtttcaagttcctcgttcgtcgtggtaccctagtacgttcgacggtacaaccgtacccggtcctaccgagtaacctcttccgcggtccgacgtagcggtcagggacgacggacgttacttagtaactttacgtacgtgacctagttcctagttccttagactaagtacgtaggttacgagtttcgtttaggccgtttacggtaaacgggtaggttaccggaaacttgggacccttacggttaccgttaccgtaacgggtccaacccgggacctaaacccgggaacccccc

SEQ ID NO: 233715 - DNA, 838 bp, Homo sapiens
  misc_feature: GYAE6OF01CUZHI.39.86.H09.1.454.CMB.1.raw
  modified_base (573)..(573): a, c, t, g, unknown or other
  misc_feature (573)..(573): n is a, c, g, or t
  modified_base (653)..(653): a, c, t, g, unknown or other
  misc_feature (653)..(653): n is a, c, g, or t
  modified_base (680)..(680): a, c, t, g, unknown or other
  misc_feature (680)..(680): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcgaggcacgagggtcctgggcccagtctcgcctgactcaggcctgcctcgtgtcgtcgggtctcgtaggacgacgtcgactacacccatccttccgtacgacgtaccgtacggtaaaccaggtacacggttcgggtacggggttttgggggttaattacggtaacttaacgttccgttaccgttcccggttagggtaaacccagtaccgaacgttaacaccgacgacgtaacccgaaccccaaccccgtaaacttcacttaaccgtaattttaacggacggttaacggagttaacggttaccggtcccggttaaccgttaccgggtttaacgggtttttccttaaaccgttccgtttccgttccgtttaacggtcggtaccctaacgttaacgtacgttacgggaacccctaaccggtaaccccgtcccgtaccctagtacccgtnttcccggtacggtaccgggtacccgtacggtacggacgggttaccgacgggtacgacgggtacttaggttaactttacgntaccgaacgtttcgaccttaaccgttnttaacgacgttaacgtagtcggtaaggtacctttccggttaacgtttcggggttaaccgtttaacgggaacggttaaccgggccgttaaacggttccgtaacgtttacccgggttaacgtccggtaacccgtaaaaccggtccccgggtaaaaccccg

SEQ ID NO: 233716 - DNA, 785 bp, Homo sapiens
  misc_feature: GYAE6OF01EYQA3.39.86.H09.1.454.CMB.1.raw
  modified_base (206)..(206): a, c, t, g, unknown or other
  misc_feature (206)..(206): n is a, c, g, or t
  modified_base (247)..(247): a, c, t, g, unknown or other
  misc_feature (247)..(247): n is a, c, g, or t
  modified_base (292)..(292): a, c, t, g, unknown or other
  misc_feature (292)..(292): n is a, c, g, or t
tcagtcgcactagtcacgaccggtgctcgatttagtgctatagacttggggttgggggtctcaggaggcagcgctctcaggacatctccaccatggcctgggctctgctgctcctcaccctcctcactcgagggcacgacgggtcctcgggcccagtctcgccctgacctcaggctcgccctcgtgtcgtgggtctcgtagggacnggtcgactcacctatccgtcctgacctacgtacgggaaccngtaccgaggttagggtacggggtttaggggttaatcgtaacgttnttcggttcctaccgttaggaccagtacctaagcgtccggaacggtccaacccgaacccggaacccccttaaatccgaattaccgttaagttttacggaggtaacgtacgtaacggttaaccgtccggtacccgttagggtttacggggtttaactacgttccgtcgtttaccgcggttaccggtaccgtaaccgtacggtaccgtacggaacccgtaaccggtacccgttccccgtacccgtaacggtacccttacggttccgttacggtccgggtacctacggtacggtacggtacgggacggggtacggtacggttacgttaacgttaagtttacctacgggtacgacgtcgttaacctcgttaacgttacggtaacttaccgtaggtacgtacggtacggtttactttacgttcgggttaggtacggtaacggggtaccacggtacgttacgtacgttccgaacgtccggaacgcgtaacccgtaacccg

SEQ ID NO: 233717 - DNA, 729 bp, Homo sapiens
  misc_feature: GYAE6OF01C4U2A.39.86.H09.1.454.CMB.1.raw
  modified_base (286)..(286): a, c, t, g, unknown or other
  misc_feature (286)..(286): n is a, c, g, or t
  modified_base (320)..(320): a, c, t, g, unknown or other
  misc_feature (320)..(320): n is a, c, g, or t
  modified_base (346)..(346): a, c, t, g, unknown or other
  misc_feature (346)..(346): n is a, c, g, or t
tcagtcgcactagtcacgaccggtgctcgatttagtgctatagacttgggttgggggtctcaggaggcagcgctctcaggacatctccaccatggcctgggctctgctgcctcctccaccctcctcactcgagggcacgacgggtcctcgggccctagtcctcgccctgactcgagctcgcctcgtgtcgtggtctcgtaggacagtcgactaccacctacttccttctcggacctaccgtaacggaaccagcgtaggtggtacgggtttggggtactagtacttnttcgtccgttacgtagtaccagactaacgtaccncgagaccaaccgaccaaccctactanacgttactagtttacgcggtaagtcgtaacgtacgtcccggtaccgttaggttacggttactacgttccgttctaccgttcgtacgtaccgtacgtacggtccaacgacccaacgtcccgtacccgttactaccttaccgtacgttccggttcgtccggtacctacgggtacgtacggtacgacgggagttacgcgttaatacgtttcacgcgttacacgttacttacttgttaacacgttacgtacgtaggttacgttacggttttacctaggttaccggttacgggtaaacgggtaccgggttaccggtaaacggttacgttaaccgttccggttaccgggttactacccgggaacgtaacccccgacggtaaaccccccg

SEQ ID NO: 233718 - DNA, 796 bp, Homo sapiens
  misc_feature: GYAE6OF01AM8YH.39.86.H09.1.454.CMB.1.raw
  modified_base (242)..(242): a, c, t, g, unknown or other
  misc_feature (242)..(242): n is a, c, g, or t
tcagtcgcactagtcacgaccggtgctcgatttagtgctatagacttgggttggggggggtcgtcaggaggcagcgctcgtcaggacatctccaccatggcctgggctctcgctgctcctcacctcctcactcaggcacgaggtcctggcccagtctgcctgactcacggtctgcctccgtgtcctgggtcctcgtaggacaggtcgactccaccacgtccttaccgtgcacgtcggaaccngacctaaggtggtacggtttgggggttactcggtacgtaatgtccttccgtacggttaaccgaggtactaacttacttccggaacggtacaacgaaccggtacccccaaaactactaactcgtaatttaacgacggtaacggtccaacggttaacgtaccggtccgtacggtaacggggtttacctaaagttccggttaaccttcgtaccttacggccgtaccgtaacgtcccgtacgggaaccttaaccgacccgggtacccttcccgtacggacctaacgttccgtcggtaccgggtacccgttaccggacggtaccggttcggaaacgggtaccgggtaaacggttcgttaaggttaacgtttaacgttttaccgacggtacgttaccggtacttacttacgggttactaaccgtaaacgttcgtacgggttacgtaccggttacgttacgttaccggtacggttaccgggtaggttccgggaacccgttaacggtcgtaacccggttcgaacccggttaggtaccctacccgggtaacctaaaccccggg

SEQ ID NO: 233719 - DNA, 719 bp, Homo sapiens
  misc_feature: GYAE6OF01A6S7D.39.86.H09.1.454.CMB.1.raw
tcagtcgcactagtcacgaccggtgctcgatttagtgctatagacttgggtttgggggggggtctcaggaggcagcgctctcaggacatctccaccatggcctgggctctgctcgctccctcaccctcctcacctcgagggcacgagggtcctagggcccagtctcgccctgctacgaggctcgcctcgtgtctggtcctcgtaggactagtcgatccactatcctcgtagcaacgtagaaccgacgacaggtcggtaacgggtttggggttactgtaactacgttcgttcctaccgtaggtaccagactaaatctaccgaggtaccaaaccggacccgtaacccctaaactcctattccgtaaattttaccgtggaacgttaacgaaggttaaccgtcccggtacccgttaacggtaggggttttaactaagtccgtttaactccgtagtacccgtccttaacgttacgacgtacggaacctaaccggaccggtcctacccacgtaccgactacggtaccgttacggccctaacgaggacgtttacgggacgaaccgggtagactaagttacttaacgttactacggaacgtctaccttacgtacgttaactacgtaacttacgtagttacgacggttatttacggtagtacggttaccgtaagggacgtaacgtagtacgtagtaccggtacgtagttcaaccgtcccgaaaccccg

SEQ ID NO: 233720 - DNA, 817 bp, Homo sapiens
  misc_feature: GYAE6OF01EIBFZ.39.86.H09.1.454.CMB.1.raw
  modified_base (203)..(203): a, c, t, g, unknown or other
  misc_feature (203)..(203): n is a, c, g, or t
  modified_base (237)..(237): a, c, t, g, unknown or other
  misc_feature (237)..(237): n is a, c, g, or t
  modified_base (298)..(298): a, c, t, g, unknown or other
  misc_feature (298)..(298): n is a, c, g, or t
tcagtcgcactagtcacgaccggtgctcgatttagtgctatagacttgggttgggggtctcaggaggcagcgctctcaggacatcctccaccatggcctggctctgctgctcctcaccctcctcactcgagggcacgagggtcctcgggcccagtctcgccctgactcgaggtctcgccctcgtgtcgtgggtctctaggacngtcgatcaccatcctctgaccacgtacggaaccngcgtacggtaggtacgggttggggtatacggtacttacgttcgtcctccgtacggtaaccngtaactaactacgtacgacgaccaaccgacccgtaacccctaatctacttacgttattttaggcggtaacgttactaacgttaccggttaccgggtacccgtttacgggttacgggttttacctaaccgggttccttactttccgtcggtacccgtaccgttacgtaaacgtttcggacggaaaccaacccggttccccgtccccttaccgtacgtaaccttacccgttccgggtcggttcccggaccgttaccgacgggtaccggtaacgggtacccggggtacgtaggttaaccttagggttaactttacggtaaccgtccgtaacgtccgttacgttacgttaaccgttcgaaaccgttttaccgacgggtattcggtaacggtttccgtttagggtttacccggttaccgggttaacggtacccggggtaaacgtaccgggttacggtacccttaaccggttacccggttaaccgtacccgggtacccgtaacccggtaccccggtaaacccccg

SEQ ID NO: 233721 - DNA, 680 bp, Homo sapiens
  misc_feature: GYAE6OF01DY2EB.39.86.H09.1.454.CMB.1.raw
  modified_base (252)..(252): a, c, t, g, unknown or other
  misc_feature (252)..(252): n is a, c, g, or t
  modified_base (255)..(255): a, c, t, g, unknown or other
  misc_feature (255)..(255): n is a, c, g, or t
  modified_base (430)..(430): a, c, t, g, unknown or other
  misc_feature (430)..(430): n is a, c, g, or t
tcagtcgcactagtcacgaccggtgctcgatttagtgctatagacttgggttgggggtctcaggaggcagcgctctcaggacatctccaccatggcctgggctctgctgcctcctccaccctcctcactcagggcacgacggggtcccgtggggccccaggtcctcgccccttgaacctcagggctcgcccttcgtgttcgtggggtcttctacggactagtcgactcacctatctcctgcactcggaaccngcngttacggtacggggttgggggttatacgtacgttatcggttaccttccgtacgggtacccaagtactaagtactccgaggacccaccacccgaaccccctaatcactacgttattagtggagtactaacgtacggtccgtccttaacggtcggtttactacgccgttacttccgngtcggtcctacgtaacgtcgtacgaaccgtaaccgccggtccccttaccgacgtaccctattcccgttacggtcggtcctaccgggacgcgtacggagggtaccgtaggtacctttagttacttacgttacgacgcttacgtcttactttagtgtaacctgtaacgtcggttagtacgttcttagttcggttacgtcgggtaggtaccggcgtacgtctacgtcgtacgtagcccgcgtcccggaacccg

SEQ ID NO: 233722 - DNA, 869 bp, Homo sapiens
  misc_feature: GYAE6OF01EOV3S.39.86.H09.1.454.CMB.1.raw
tcagtcgcactagtcacgaccggtgctcgatttagtgctatagacgttggggggggggtctcaggaggcagcgctctcaggacatctccaccatggcctgggctctgctgctcctcaccctctcactcagggcacgagggtcctgggcccagtctgccctgactcaggtctcgcctccgtgtcgtgggtctcgtaggacaggtcgatccaccattcctcctgccacgtaggaaccagctaggtcgtacggttgggggttatacgacttagtcgtccttccgtacggtaccagactaagtacgtccgaggtaccaccaaccgaacccccctaaattaccgtaacttacttaacgttttacgacggggtaacggttacgtaaaggttacccgttcccggggtacccctttacggggtttaacggggttttacctaacggttccgttcccgtttccgtcgttacgggtaccctacggtaaccgtcgttaccggaccgtaaacccgtccggttcccctacccgtacggtaaccctacgtttcccggtccggtcgggtacccgtacccggaaggttccgaagggtaccgggacgggtacgtacgttaagtttaccgttagtccggtacgtaccggtcgttaccttacgttaccggtttcgtaaacccttagggttaccgttaacgggtaacgggttttccgggttacctttttaaggggtttacccggttacccgggtttaaacgggggaaaccggggtttacccggggaaacggttttacgggtaaccccttacgggtacccccggtttttaaacggaccggggttaaccccaacccgggttaaacccccggtaaccgggttaaaaccccccc

SEQ ID NO: 233723 - DNA, 689 bp, Homo sapiens
  misc_feature: GYAE6OF01B95QW.39.86.H09.1.454.CMB.1.raw
  modified_base (231)..(231): a, c, t, g, unknown or other
  misc_feature (231)..(231): n is a, c, g, or t
  modified_base (348)..(348): a, c, t, g, unknown or other
  misc_feature (348)..(348): n is a, c, g, or t
  modified_base (570)..(570): a, c, t, g, unknown or other
  misc_feature (570)..(570): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacgagggtcctgggcccagtctcgccctgactcaggctgcctccgtgtcgtgggtctcgtaggacagtcgatcacatcctcctgcacgtacggaaccngcaggtggtacggtttgggggttatggtaccttagtcgtcctccgtacggttaaccagtactaactacgtccgagggccaaccgaccgacccccctaaaactcaacttctaatttanaggtacgtacgtagttaaccgtccggtacccttaggtaacggggttttactaacgtccgtctttacgtccgtcgggtacctaccgtaagttcggtacgaacctaacccggaccggtaccccttacccgtacgaccctacggttccgtccggtgggtaccctaccggtagggtaccgtagggaccgggtaggacggtacgtagttactttacgtctcggtacncggtcttacgtacttgaacgttatcgaggtcgtagttacttgtacgttacgttagggtaggtaacggtactacggtactcggtaccgtacgttaggaccctacgggtaccgaaccccgg

SEQ ID NO: 233724 - DNA, 620 bp, Homo sapiens
  misc_feature: GYAE6OF01AI7UE.39.86.H09.1.454.CMB.1.raw
  modified_base (259)..(259): a, c, t, g, unknown or other
  misc_feature (259)..(259): n is a, c, g, or t
  modified_base (319)..(319): a, c, t, g, unknown or other
  misc_feature (319)..(319): n is a, c, g, or t
  modified_base (355)..(355): a, c, t, g, unknown or other
  misc_feature (355)..(355): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgccctccgtgtcgtgggtctcgtaggacagtcgatccaccatctcctgcactggaaccagcagtgacggttgggggttatgaactntgtcctcctggtaccagcaatatccgagccaccacgacccccaatcatctattatgagtnagtatccggcctagtacgggttctaagcgtctcgtntcggctcgaagtctcggacaaccgtccggtccctaccgacgtaccagttccgtcgtcgggtaccctccgacgggtccgtaggaaccgggtacggtaggtccgttaggttactttacgttacctggacctagtaccgtagttacgttcgacttaagtcgtacggtcgtaggttctttagtcggtttacggtagggtaggtttacggaaccgttacggtactacgtaccggtaccgttacggccgtaaccgtccccgtaaacccggg

SEQ ID NO: 233725 - DNA, 1120 bp, Homo sapiens
  misc_feature: GYAE6OF01BZ85B.39.86.H09.1.454.CMB.1.raw
tcagtcgcactagtcacgaccggtgctcgatttagtgctatagactttggggtttgggggggggtctcaggaggcagcgctctcaggacatctccaccatggccgtgggctctgctgcctcctccaccctcctcactcgacgggcacggacgggttccgtcgggccctacggtcctcgcccgtcgacctcgaggctcgccgtccggttggttcgtcgggtctacgtaggacgtacgtcgtactacctaccgtacttcctccgtcgactaccggtaccggaaccgacggtacggtagggttacggggttacgggggtttaggggttataccggttaaccgttcgttccggtttcccgtacccgggttaaccggtaacctaaccggtaacttaaacgttacccggtccccggaacggtacccccgtaaacccacccccggtaaaacccccctttaacggttacctaacgttttaacgtttaacggtttttacgggaacgggtaaccgtttaccggtaaaacgggttttaccccgtcccccggggtttaaacccggttttaacggggtttaaccccgggttttttaaacgtcctttccgggttttaacccccgtttcgggttacccggttaaccccggtttaaccccggtttaccggtaaacgttttcccccggtaacccggggtaaaccccccgtccccggttaacccccggtttcccccttttaaaccgggcccccgtttaaaccgtttaccccgggtttaccccggggttcccgggggttaaccccggttccccggttaaaccgggggtcgggttaaccggggggttacgggttaaaccccgggggaacgggggttttacgttacccgggttttacggtttaaccgttttaaacccccgggttcgtaaccggggttaccccttacgttacccgttttaacggttacgtttaacggttaaccgtaagggttaccggttaccggggtttacgtttccggttttacctacggggtttaccgggttaaccgggtacggggtaccgggaaccgttaccgggtaacgttccttaccgggtaaccttacgggtacccgcccggtaaaccgtaccccgggtaaccccg

SEQ ID NO: 233726 - DNA, 263 bp, Homo sapiens
  misc_feature: GYAE6OF01BDUHW.39.86.H09.1.454.CMB.1.raw
  modified_base (247)..(247): a, c, t, g, unknown or other
  misc_feature (247)..(247): n is a, c, g, or t
  modified_base (253)..(263): a, c, t, g, unknown or other
  misc_feature (253)..(263): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggcccaaccccactgtcactctcgttcccgccctcctcactagtgccgactggaggtcgggcctggcaaggcncatagnnnnnnnnnnn

SEQ ID NO: 233727 - DNA, 883 bp, Homo sapiens
  misc_feature: GYAE6OF01BNHKB.39.86.H09.1.454.CMB.1.raw
  modified_base (716)..(716): a, c, t, g, unknown or other
  misc_feature (716)..(716): n is a, c, g, or t
tcagtcgcactagtcacgaccggtgctcgatttagtgctatagacttggggtttggggggggtctcaggaggcagcgctctcaggacatctccaccatggcctgggctctgctgctcctccaccctcctcactcagggcacgacgggtcctgggcccagtctgccctgactcaggctgcctcgtgtcgtcgggtctacgtaggactacgtcgactccactacttctcccgtgacctacgtacggaacccaggcgtaggttcggtacggggttttagggggttaatcgtaacgttacgttcgttccgttaccgtacgggtaacccaagtactaaacttacgacccggtaaggcccaaccgaacccccggaacccccctaaaagttcctaactttaacgttaacgttttacggacggtaacggttacggtaaacgttaccggttaccccggtcccgtttacggtaacggggtttttacctaacggttcccgtttccgtttaccgtacggtttcccggttaccgtaaaccggttaccgtttaccgggtacgggtaaacccgtaaacccggtacccggttacccccttaacccgttaacccgacccgtttaaccgttcccgttccgggttaccgggtaccccttaccgggtaggggtacccggttacgggtaacggaacccgggttagggtacctttaagggtaacttttacgtaccgtnacggttaccgtccttagtttacgttaccgtaacgtacgttacggtacgtgttaaaccgtgtttacggttccggttaacggtagggttaaacggcgggtaacggttaacgtccgttaacccgttcggggttaaccgtaggtacccgaacgggtaaccctaaccccggg

SEQ ID NO: 233728 - DNA, 792 bp, Homo sapiens
  misc_feature: GYAE6OF01B01MK.39.86.H09.1.454.CMB.1.raw
tcagtcgcactagtcacgaccggtgctcgatttagtgctatagacttggggggggggtctcaggaggcagcgctctcaggacatctccaccatggcctggctctgctgctcctcaccctcctcactcagggcacgacgggtcctgggcccagtcctcgccctgactcgaggctcgcctccgtgtcgtggtctcgtaggactgtcgactacaccatcctcctcgacctacgtacggaaacccagacgtaaggtcgggtacgggtttaggggggttactcggtacttagttcgttccctccggttcggtaacccagtactaaacttacgaccgacggaccacccgaacccgaccccctaaacgtcaacgttacttacgttttagacgggtaactacgtaacggttaaccgtccccggtacccgtttacgggtacggtttactacgtcctaccttcgtccgtcgtcctaccgtagtcggtacgaccgtaaccgccggttccctacccgtacgtacctacgtccgttcgggtaccgtccgtaccgcggtacggtacggaccgggacggtacgttgttaacgttaacgtttaccgtcgttacgccgtaacgttcctttacggtttaccttacgtaacgttaccttacggtaaggttacggtacgtttaacgttacggttccggttaacggggttacgggtaacggggtaacccggtaacggttacgggtaccgtacggtttaaccgtacccggttacggtaacccgtacccggaacccgtaccccggtaaacccccg

SEQ ID NO: 233729 - DNA, 756 bp, Homo sapiens
  misc_feature: GYAE6OF01ELY8X.39.86.H09.1.454.CMB.1.raw
  modified_base (223)..(223): a, c, t, g, unknown or other
  misc_feature (223)..(223): n is a, c, g, or t
tcagtcgcactagtcacgaccggtgctcgatttagtgctatagacttgggttggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcacatctctgcactggaaccngcgagtggtacgggttgggggttatgtacttagttcgtcctccgtaggtaccagacaattactccgaaggcaaccgtaccgaccccctaaacgtctacttacctaatttacggtaggtacggtactaacggttacgtcccgggtaccgttacgggttacggggtttactaacgttccgtcctttcctcggttcgggtaccttaccgtaacgttccggtacggacctaaacccggacccggtccccttacccgtacgaaccccttagtcccgttcggtaccgggtccctaccggaagggtccgtagggacgggacggtacggtcgttaacgttactttaacgttaccgtacgtacgtacgttaccgttaacttacggttacgtaacgttacgtacggtaacggtcggtaacggttactttacgggttacggtttccggggttaaacgggtaacgggtacggtaaaccgtacgggttacttaccgggttacccgtacggtacggttacccgaacccggtaacccggtaaacccgg

SEQ ID NO: 233730 - DNA, 821 bp, Homo sapiens
  misc_feature: GYAE6OF01BLBXT.39.86.H09.1.454.CMB.1.raw
  modified_base (238)..(238): a, c, t, g, unknown or other
  misc_feature (238)..(238): n is a, c, g, or t
tcagtcgcactagtcacgaccggtgctcgatttagtgctatagacttggggtttggggggggtctcaggaggcagcgctctcaggacatctcccaccatggcctgggctctgctgctcctcaccctcctcacgtccagggcacgtagggtccgtcgggccctagtccgtcgcccttagccgtacgacggtctcgtccgtccgtgtcgttcgggtcctcgtaggacagtccgatccacnctccgtctacgctacgtacgaaccgcgtacgtaggttcgggtacggtttggggttactacggtatacgttccgtccttaccggtaacgtaccgtaacggtataaactaccttcgaaccggtcccaaccgaacccccgtaaccccccttaaatcccgtaacgtttacttaacggtttttacgaaccgggttaaggtaccctaacgggttaacccggttcccggttacccgtaccggggttttaacggtttaccttaaccgttcccgtttacccgtttacggtccgtttaccgggttaccctaaaggttcccgggttacccgacggtaacccccgtaaacgggtcccccctttccgacccgtacgaccttacgtcgtaccggtaccgtcccgtacgtcggttcgacgggtacgtcggtaaccggttcgtattaccgttagttctacgtcgtacgtcctacgttcggtacctatacgtgtaggtactcggttaactttcgtacggttacggacggttacggtaaccggtacgtacggtaaacctccgtttacgggtcctaacgcccggcgtaaacccgtaccccgg

SEQ ID NO: 233731 - DNA, 784 bp, Homo sapiens
  misc_feature: GYAE6OF01CXCSI.39.86.H09.1.454.CMB.1.raw
  modified_base (253)..(253): a, c, t, g, unknown or other
  misc_feature (253)..(253): n is a, c, g, or t
tcagtcgcactagtcacgaccggtgctcgatttagtgctatagacttggggtttgggggggggtctcaggaggcagcgctctcaggacatctccaccatggcctgggctctgctgcctcctcaccctcctcactcgagggcacgacgggtcctgggcccagtctcgccctagactcgaggctcgccctcgtgtcgtggtctacgtaggacagtcgaactccacctagttcctctcgaccacgtaccggaaccngacgtaggttgggtacggggtttaggggtatacgtattagtcgttcctaccgtacggtaaccataactaactacgtccgaacggaccaaccgaaccccgaaccccctaatactacttaccgttaagttttacgacggttaacggtactaaaccggtacgtccccgggttacccgttagggtttacggtttaaccacgttccgttcttcgtacgtcggtcctaacggtacggtctacggaccacggtcccgtcctcctacgtcctactccgtacggtccggtctaccggaggtacgacggacgggtacggtacggtacgttaacttagtttaccgtacgtacgtacgttacctaccttaagttacgttacgaacttaacgtacgtacggttaacgttaccgttttacgttcggtttaaccggtacgggttaacggggtaacggttaacccgggaaccgttacgttaccgtaccggtttaccccggttacggttaacccgggaccgaaaccccgggtcccgtaaaacccccgg

SEQ ID NO: 233732 - DNA, 281 bp, Homo sapiens
  misc_feature: GYAE6OF02JJS15.39.86.H09.1.454.CMB.1.raw
  modified_base (262)..(281): a, c, t, g, unknown or other
  misc_feature (262)..(281): n is a, c, g, or t
tcagtcgcactagtcacgaccggtgctcgatttagtgctatagacttgggtttggggtttgggtggtctccactcccgccttgacgaggctgattattactgcagctctatttgcaatcagtgaggcttatgtcttcggaaggtgggaccgaaggtcatcgtcctaggtcacgacccgaacggaccaacccacctcgtcactctcgttcccgtccctcctccactagtgcgactgaggcgggcgcggcgaacggcgcatagnnnnnnnnnnnnnnnnnnnn

SEQ ID NO: 233733 - DNA, 428 bp, Homo sapiens
  misc_feature: GYAE6OF02GTZD7.39.86.H09.1.454.CMB.1.raw
  modified_base (412)..(412): a, c, t, g, unknown or other
  misc_feature (412)..(412): n is a, c, g, or t
  modified_base (418)..(428): a, c, t, g, unknown or other
  misc_feature (418)..(428): n is a, c, g, or t
tcagtcgcactagtcacgaccggtgctcgatttagtgctatagacttgggtttgggggctgtgcctggatattgctggaaccagcagtgacgttggggttatgactatgtctcctggtaccagcaatatccaggcacagcccccaaactcatcatttatgaggtcagtaatcggccctcaggggtttctaatcgcttctctggctccaagtctggcaacacggcctccctgaccatctctgggctccaggctgaggacgaggctgattattactgcagctcatttgcaatcagtgaggcttatgtcttcggaagtgggaccaaggtcatcgtcctaggtcagcccaaggccaacccactgtcactctgttcccgccctcctcactagtgcgactgagcgggctggcaaggcncatagnnnnnnnnnnn

SEQ ID NO: 233734 - DNA, 248 bp, Homo sapiens
  misc_feature: GYAE6OF02JAP91.39.86.H09.1.454.CMB.1.raw
  modified_base (245)..(248): a, c, t, g, unknown or other
  misc_feature (245)..(248): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccgcctcctcactagtgcgactgagcgggctggcaaggcgcatagnnnn

SEQ ID NO: 233735 - DNA, 251 bp, Homo sapiens; identical to SEQ ID NO: 233377
  misc_feature: GYAE6OF02I9XVS.39.86.H09.1.454.CMB.1.raw
  modified_base (246)..(251): a, c, t, g, unknown or other
  misc_feature (246)..(251): n is a, c, g, or t

SEQ ID NO: 233736 - DNA, 248 bp, Homo sapiens
  misc_feature: GYAE6OF02JHFSM.39.86.H09.1.454.CMB.1.raw
  modified_base (244)..(248): a, c, t, g, unknown or other
  misc_feature (244)..(248): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaacccactgtcactctgttcccacctcctcactagtgcgactgagcgggctggcaaggcgcatagnnnnn

SEQ ID NO: 233737 - DNA, 529 bp, Homo sapiens
  misc_feature: GYAE6OF02H4QLO.39.86.H09.1.454.CMB.1.raw
  modified_base (308)..(308): a, c, t, g, unknown or other
  misc_feature (308)..(308): n is a, c, g, or t
  modified_base (413)..(413): a, c, t, g, unknown or other
  misc_feature (413)..(413): n is a, c, g, or t
  modified_base (425)..(425): a, c, t, g, unknown or other
  misc_feature (425)..(425): n is a, c, g, or t
  modified_base (454)..(454): a, c, t, g, unknown or other
  misc_feature (454)..(454): n is a, c, g, or t
tcagtcgcactagtcacgaccggtgctcgatttagtgctatagacttgggttgggggtctcaggaggcagcgctctcaggacatctccaccatggcctgggctctgctgctccctccaccctcctcactcagggcacgagggtccgtgggcccagtcgtcgccctgactcaggctgcctccgtgtctgggtctctaggacagtcgatcaccatctcctgcactggaaccagcagtgacgttgggggttatgactatgtctcctggtaccagcaatatccaggcaccacgcccccaaatcatcatttangagtcagtaatcggccctgtaggggtttctaagtcgcttctctggctcaagtctggacacgacggccctcctgacctatctctgggctccgaggctggaggacgngctgattatacngcagctctatttgactaatcagtgacgtnttagtcgttcgttacgggaaggtcgggaacctaaggtctagtccggtaccgtaggtcaccggtacccgaacccgg

SEQ ID NO: 233738 - DNA, 246 bp, Homo sapiens
  misc_feature: GYAE6OF02I81GI.39.86.H09.1.454.CMB.1.raw
  modified_base (245)..(246): a, c, t, g, unknown or other
  misc_feature (245)..(246): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccgcctcctcactagtgcgactgagcgggctggcaaggcgcatagnn

SEQ ID NO: 233739 - DNA, 493 bp, Homo sapiens
  misc_feature: GYAE6OF02FUN8B.39.86.H09.1.454.CMB.1.raw
tcagtcgcactagtcacgaccggtgctcgatttagtgctatagacttgggtttggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgaggtcagtaatcggcctcaggggtttctaatcgcttctctggctccaagtctggcaacacggcctcctgaccatctctgggctccaggctgaggacgaggctgattattactgcagctcatttgcaatcagtgaggcttatgtcttcggaagtgggaccaaggtcagtcgtcctaggtcagcccaacgg

SEQ ID NO: 233740 - DNA, 494 bp, Homo sapiens
  misc_feature: GYAE6OF02IQ7ZC.39.86.H09.1.454.CMB.1.raw
  modified_base (434)..(434): a, c, t, g, unknown or other
  misc_feature (434)..(434): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgaggtcagtaatcggccctcaggggtttctaatcgcttctctggctcaagtctggcaacacggcctcctgaccatctctgggctccgaggctggaggacgaggctgatttattactgcagctacattanacaagcagcagcactcttgtgtagtcggcggaggaccagctgacccgtctaggtcaccgg

SEQ ID NO: 233741 - DNA, 513 bp, Homo sapiens
  misc_feature: GYAE6OF02IVIBG.39.86.H09.1.454.CMB.1.raw
  modified_base (300)..(300): a, c, t, g, unknown or other
  misc_feature (300)..(300): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaatcatcatttangaggtcagtaatcggcctcaggggtttcaatcgcttctctgctccaagtctggcacacggcctcctgacccatctcgtgggcctccgaggctggaggacgaggctgatttatactgcagctcatttgctaatcgagtgagtccttagtcgttcgttacgggaagttgggaaccctaagggtccagttcgtacctaggtcacggccctaaccgg

SEQ ID NO: 233742 - DNA, 504 bp, Homo sapiens
  misc_feature: GYAE6OF02I0NQ0.39.86.H09.1.454.CMB.1.raw
  modified_base (305)..(305): a, c, t, g, unknown or other
  misc_feature (305)..(305): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttangaggtcagtaatcggccctcaggggtttcaatcgcttctctggctcaagtctggcacacggcctcctgaccatctctgggctccaggctgaggacgaggctgattacttactgcagctcatttgctaattcagtgaggcttatcgtcgttcgggaagttgggaacctaggtccagttcgtccgtaggcacgcccaacgg

SEQ ID NO: 233743 - DNA, 499 bp, Homo sapiens
  misc_feature: GYAE6OF02FJ5O2.39.86.H09.1.454.CMB.1.raw
  modified_base (169)..(169): a, c, t, g, unknown or other
  misc_feature (169)..(169): n is a, c, g, or t
  modified_base (420)..(420): a, c, t, g, unknown or other
  misc_feature (420)..(420): n is a, c, g, or t
  modified_base (456)..(459): a, c, t, g, unknown or other
  misc_feature (456)..(459): n is a, c, g, or t
  modified_base (462)..(463): a, c, t, g, unknown or other
  misc_feature (462)..(463): n is a, c, g, or t
  modified_base (474)..(474): a, c, t, g, unknown or other
  misc_feature (474)..(474): n is a, c, g, or t
  modified_base (476)..(478): a, c, t, g, unknown or other
  misc_feature (476)..(478): n is a, c, g, or t
  modified_base (480)..(481): a, c, t, g, unknown or other
  misc_feature (480)..(481): n is a, c, g, or t
  modified_base (483)..(486): a, c, t, g, unknown or other
  misc_feature (483)..(486): n is a, c, g, or t
  modified_base (488)..(489): a, c, t, g, unknown or other
  misc_feature (488)..(489): n is a, c, g, or t
  modified_base (491)..(495): a, c, t, g, unknown or other
  misc_feature (491)..(495): n is a, c, g, or t
  modified_base (497)..(498): a, c, t, g, unknown or other
  misc_feature (497)..(498): n is a, c, g, or t
tcagtcgcactagtcacgaccggtgctcgatttagtgctatagacttggggtttggggctgtcgcctggatattgctggaaccagcagtgacgttcggggttatgactatcgtcgtcctggtaccgagcaatattccaggccacagcccccaaaacttcatcattttangaggtcacgtaatcggcccctcacggggtttctaatcgcttctctggcgtccaagtctggcaacacggcctccctgacccatctctgggcttccaggtctgacggacgaggctgattagttaacctggacacgctcatttgctaagtcagtgtaggcttagtggtcctggaagtgggaccaaggtcatcgtcctaggtcaggcccaaggcccacccatgtccactctcgttccccgcctcctcactagtcncgactggacgtcgggctcggactaagggcacatagnnnntcnnctcgctagcangnnnanngnnnncnncnnnnncnnc

SEQ ID NO: 233744 - DNA, 250 bp, Homo sapiens; identical to SEQ ID NO: 233301
  misc_feature: GYAE6OF02ID2ZD.39.86.H09.1.454.CMB.1.raw
  modified_base (246)..(250): a, c, t, g, unknown or other
  misc_feature (246)..(250): n is a, c, g, or t

SEQ ID NO: 233745 - DNA, 247 bp, Homo sapiens; identical to SEQ ID NO: 233293
  misc_feature: GYAE6OF02HZQ7Z.39.86.H09.1.454.CMB.1.raw
  modified_base (245)..(247): a, c, t, g, unknown or other
  misc_feature (245)..(247): n is a, c, g, or t

SEQ ID NO: 233746 - DNA, 272 bp, Homo sapiens
  misc_feature: GYAE6OF02GPHZU.39.86.H09.1.454.CMB.1.raw
  modified_base (249)..(272): a, c, t, g, unknown or other
  misc_feature (249)..(272): n is a, c, g, or t
tcagtcgcactagtcacgaccggtgctcgatttagtgctatagacttgggtttgggggtttggtaggtctccactcccgccttgacgaggcctggattattactgcagctcatttgcaatcagtgaggcttatgtcttcggaagtgggaccaaggtcatcgtcctaggtcagcccaaggccaaccccactgtcactctgttcccaccctcctcactagtgcgactgagcgggctggcaaggcgcatagnnnnnnnnnnnnnnnnnnnnnnnn

SEQ ID NO: 233747 - DNA, 248 bp, Homo sapiens; identical to SEQ ID NO: 233246
  misc_feature: GYAE6OF02JGPIS.39.86.H09.1.454.CMB.1.raw
  modified_base (246)..(248): a, c, t, g, unknown or other
  misc_feature (246)..(248): n is a, c, g, or t

SEQ ID NO: 233748 - DNA, 494 bp, Homo sapiens
  misc_feature: GYAE6OF02HOK6W.39.86.H09.1.454.CMB.1.raw
  modified_base (303)..(303): a, c, t, g, unknown or other
  misc_feature (303)..(303): n is a, c, g, or t
  modified_base (373)..(373): a, c, t, g, unknown or other
  misc_feature (373)..(373): n is a, c, g, or t
tcagtcgcactagtcacgaccggtgctcgatttagtgctatagacttgggtttggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttangaggtcagtaatcggccctcaggggtttctaatcgcttctctggctccaagtctggcaacacggcctccngacccatctctgggctccaggctgaggacgaggctgattatactgcagctcgatttgcaatcagtgagcttatgtcttcggaattgggaccaaggtcagtcgtcctaggtcagcccaacgg

SEQ ID NO: 233749 - DNA, 253 bp, Homo sapiens
  misc_feature: GYAE6OF02HHTMK.39.86.H09.1.454.CMB.1.raw
  modified_base (246)..(253): a, c, t, g, unknown or other
  misc_feature (246)..(253): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccgccctcctcactagtgcgactgagcgggctggcaaggcgcatagnnnnnnnn

SEQ ID NO: 233750 - DNA, 248 bp, Homo sapiens; identical to SEQ ID NO: 233246
  misc_feature: GYAE6OF02IJ7WS.39.86.H09.1.454.CMB.1.raw
  modified_base (246)..(248): a, c, t, g, unknown or other
  misc_feature (246)..(248): n is a, c, g, or t

SEQ ID NO: 233751 - DNA, 494 bp, Homo sapiens
  misc_feature: GYAE6OF02GRV2Q.39.86.H09.1.454.CMB.1.raw
  modified_base (302)..(302): a, c, t, g, unknown or other
  misc_feature (302)..(302): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttangagtcagtaatcggccctcaggggtttctaatcgcttctctggctccaagtctggcaacacggcctccctgaccatctctgggctccaggctgaggacgaggctgattatactgcagctcatttgctaatcagtgaggtcttagtgtcttcggaagtgggaaccaggtcatcgtcctaggtcagcccaacgg

SEQ ID NO: 233752 - DNA, 501 bp, Homo sapiens
  misc_feature: GYAE6OF02JBO1H.39.86.H09.1.454.CMB.1.raw
  modified_base (318)..(318): a, c, t, g, unknown or other
  misc_feature (318)..(318): n is a, c, g, or t
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacagcccccaaactcatcatttatgagtcagtaatcggccctnagggtttctaatcgcttctctggctcaagtctgcaacacggcctccctgaccatctctgggcctccaggctggacggacgaggctggatttattactgcagctctatttgcaatcagtgagcttatgttcttcggaagtcggacctaaggtctatcgtccgtaggtcacgacccgtagacccc

SEQ ID NO: 233753 - DNA, 249 bp, Homo sapiens; identical to SEQ ID NO: 233247
  misc_feature: GYAE6OF02F4NHX.39.86.H09.1.454.CMB.1.raw
  modified_base (246)..(249): a, c, t, g, unknown or other
  misc_feature (246)..(249): n is a, c, g, or t

SEQ ID NO: 233754 - DNA, 251 bp, Homo sapiens
  misc_feature: GYAE6OF02HW0GM.39.86.H09.1.454.CMB.1.raw
  modified_base (249)..(251): a, c, t, g, unknown or other
  misc_feature (249)..(251): n is a, c, g, or t
tcagtcgcactagtcacgaccggtgctcgatttagtgctatagacttgggtttgggggtttggtggtctccactcccgccttgacgaggctgattattactgcagctcatatacaagcagcagcactcttgtggtattcggcggagggaccaagctgaccgtcctaggtcagcccaaggctgccccctcggtcactctgttcccaccctcctcactagtgcgactgagcgggctggcaaggcgcatagnnn

SEQ ID NO: 233755 - DNA, 563 bp, Homo sapiens
  misc_feature: GYAE6OF02HPPTW.39.86.H09.1.454.CMB.1.raw
  modified_base (300)..(300): a, c, t, g, unknown or other
  misc_feature (300)..(300): n is a, c, g, or t
tcagtcgcactagtcacgaccggtgctcgatttagtgctatagacttggggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtacagcaatatccaggcacacgacccccaaatcatcatttangagtcagtatcgcctgtagggttacaatcgtcttctctcggtctaccaagtctagaccaacgaccggtcctccctgacctactctcgtgggcctcgaggtcgtaggaggacgaggtctagtatttactacgtgacgagtctactagtttcgactaactcgtagtgagtcttagtcgttacggttacggtaaggtcgggtaacgtaacggttacgtacgttccgtaccggtacggtaccgaccggtaccccgaacggtaacccc

SEQ ID NO: 233756 - DNA, 499 bp, Homo sapiens
  misc_feature: GYAE6OF02GS81Q.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgagtcagtaatcggcctcaggggtttctaatcgcttctctgctcaagtctggcaacacggcctccctgaccatctctgggctccagctgaggacgaggctgattattactgcagctcatttgctaatcagtgagcttatgttcgttcggaagttcgggaacctaaggtacacgtcgtaccgtaggtcagcccgaacgg

SEQ ID NO: 233757 - DNA, 523 bp, Homo sapiens
  misc_feature: GYAE6OF02HFDV7.39.86.H09.1.454.CMB.1.raw
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttatgaggtcagtaatcggccctcgaggggtttctaatcgtcttctctggctcaagtctggcaacacggcctccctgaccatctcgtgggcctcgaggctggaggacgaggctgtattattactgacagtctctatttgactaatcaggtgaggtcttagtcgtcgttcgggaagttcgggaaccaaggttcagttccggtacgtaggtccacgcccaacgg

SEQ ID NO: 233758 - DNA, 247 bp, Homo sapiens
  misc_feature: GYAE6OF02F7GJI.39.86.H09.1.454.CMB.1.raw
  modified_base (245)..(247): a, c, t, g, unknown or other
  misc_feature (245)..(247): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaacccactgtcactctgttcccgccctcctcactagtgcgactgagcgggctggcaaggcgcatagnnn

SEQ ID NO: 233759 - DNA, 251 bp, Homo sapiens; identical to SEQ ID NO: 233265
  misc_feature: GYAE6OF02F6OUV.39.86.H09.1.454.CMB.1.raw
  modified_base (246)..(251): a, c, t, g, unknown or other
  misc_feature (246)..(251): n is a, c, g, or t

SEQ ID NO: 233760 - DNA, 784 bp, Homo sapiens
  misc_feature: GYAE6OF02J3QSV.39.86.H09.1.454.CMB.1.raw
  modified_base (217)..(217): a, c, t, g, unknown or other
  misc_feature (217)..(217): n is a, c, g, or t
  modified_base (241)..(241): a, c, t, g, unknown or other
  misc_feature (241)..(241): n is a, c, g, or t
tcagtcgcactagtcacgaccggtgctcgatttagtgctatagacttgggtttgggggggtctcaggaggcagcgctctcaggacatctccaccatggcctgggctctgctgctcctcaccctcctcactcgagggcacgagggtcctgggcccagtctcgccctgactcgaggctcgcctcgtgtcgtggtctcgtaggacagtcgactccacctntcctcctgaccacgtacggaaccngtaccgtaggtcgggtacggtttggggttatcggtaactgtcgtcctccgtacggtaacccagtacaacgttaccgaccgacggtacccaaaccgacccgtaaccccctaaaattctaattcctaagtttacgcggtaacgttacaacgttaccgtcccggtaccttacggttacggtttacctaacgttccgtcttcgtcgtacggtacctaccgaagtccgacgaaccctaccgccgtaccctccgtagaccctgtccgtcggtacggtcctaccggagttaccgaggacggtacgttagtaccgttagtacttaccgtagtcgtaccgtagtccttacgttaacgttacgacttaaacggttcgtaagggttaccgttacgggtaccttttacggtaccgggtttaaccggggtaaaccgggtaacggggttaaccccggaaaccgttttaccggggtaaccctttaaccggggttacccccgggttaaaccgtacccgggtaaccccggtaaccccggtaacccccgttaaacccccgg

SEQ ID NO: 233761 - DNA, 502 bp, Homo sapiens
  misc_feature: GYAE6OF02ISWR1.39.86.H09.1.454.CMB.1.raw
  modified_base (360)..(360): a, c, t, g, unknown or other
  misc_feature (360)..(360): n is a, c, g, or t
  modified_base (421)..(421): a, c, t, g, unknown or other
  misc_feature (421)..(421): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgagtcagtaatcggccctcaggggtttctaatcgcttctctgctcagtctgcacncgcctcctgaccatctctgggctccgagctgacggacgaggctgattatactgcagccttnatttgacaattcgagtgagtcttatgttcgttcggaaggtcggaacctaaggtctagtcgtcctaggtcacggccaaccgg

SEQ ID NO: 233762 - DNA, 537 bp, Homo sapiens
  misc_feature: GYAE6OF02GHA8S.39.86.H09.1.454.CMB.1.raw
  modified_base (302)..(302): a, c, t, g, unknown or other
  misc_feature (302)..(302): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttangaggtcagtaatcggccctgaggggtttctaatcgcttctctggctcaagtctggcaacacgcctccctgaccatctctgggctccaggctgaggacgaggctgattatactgcagctctatttgactaatcgagtgacggtcttagtgttacgttcgggaagttcggggaacccgtaagggttcctaacgttcccggttacccgttaagggtccaccggtacccctaaaccggg

SEQ ID NO: 233763 - DNA, 496 bp, Homo sapiens
  misc_feature: GYAE6OF02IX272.39.86.H09.1.454.CMB.1.raw
  modified_base (353)..(353): a, c, t, g, unknown or other
  misc_feature (353)..(353): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaatcatcatttatgaggtcagtaatcggccctcaggggtttctaatcgcttctctgctccaagtcnggcaacaccggcctcctgaccatctcgtgggctccaggctgaggacgaggctgattattactgcagtctctatttcgctaatcagtgagtcttatgtcttcggaagtcgggaactagtcatcgtctaggtcacgccgaaccgg

SEQ ID NO: 233764 - DNA, 248 bp, Homo sapiens; identical to SEQ ID NO: 233246
  misc_feature: GYAE6OF02F5Q4K.39.86.H09.1.454.CMB.1.raw
  modified_base (246)..(248): a, c, t, g, unknown or other
  misc_feature (246)..(248): n is a, c, g, or t

SEQ ID NO: 233765 - DNA, 251 bp, Homo sapiens; identical to SEQ ID NO: 233377
  misc_feature: GYAE6OF02GNU7J.39.86.H09.1.454.CMB.1.raw
  modified_base (246)..(251): a, c, t, g, unknown or other
  misc_feature (246)..(251): n is a, c, g, or t

SEQ ID NO: 233766 - DNA, 496 bp, Homo sapiens
  misc_feature: GYAE6OF02GIIIG.39.86.H09.1.454.CMB.1.raw
  modified_base (397)..(397): a, c, t, g, unknown or other
  misc_feature (397)..(397): n is a, c, g, or t
  modified_base (409)..(409): a, c, t, g, unknown or other
  misc_feature (409)..(409): n is a, c, g, or t
  modified_base (416)..(416): a, c, t, g, unknown or other
  misc_feature (416)..(416): n is a, c, g, or t
tcagtcgcactagtcacgaccggtgctcgatttagtgctatagacttgggtttggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaatcatcatttatgaggtcagtaatcggcctcaggggtttctaatcgcttctctggctcaagtctggcaacacgcctcctgaccatctctgggctcagctgaggacgngctgattatacngcagctntattgactaatcagtgagtcttatgtcgttacggaagtgggaccaggtcagttccgtacgtaggtcacgtacccgaacgg

SEQ ID NO: 233767 - DNA, 250 bp, Homo sapiens; identical to SEQ ID NO: 233301
  misc_feature: GYAE6OF02HH8CY.39.86.H09.1.454.CMB.1.raw
  modified_base (246)..(250): a, c, t, g, unknown or other
  misc_feature (246)..(250): n is a, c, g, or t

SEQ ID NO: 233768 - DNA, 514 bp, Homo sapiens
  misc_feature: GYAE6OF02IDR6P.39.86.H09.1.454.CMB.1.raw
  modified_base (367)..(367): a, c, t, g, unknown or other
  misc_feature (367)..(367): n is a, c, g, or t
  modified_base (413)..(413): a, c, t, g, unknown or other
  misc_feature (413)..(413): n is a, c, g, or t
  modified_base (420)..(420): a, c, t, g, unknown or other
  misc_feature (420)..(420): n is a, c, g, or t
tcagtcgcactagtcacgaccggtgctcgatttagtgctatagacttggggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaaatcatcatttatgagtcagtaatcggccctgagggtttcaatcgcttctctgctccaagtctggcaacacgcctcccngaccatctcgtgggctcgaggctggaggacgaggctgattattacngcagctntatttgctaatcagtgaggtcttagtcgttcgttacggaagtcgggaccaaggttccagttccgtcgtaggtacacgtaccccgaaggtacccc

SEQ ID NO: 233769 - DNA, 252 bp, Homo sapiens
  misc_feature: GYAE6OF02HWJJJ.39.86.H09.1.454.CMB.1.raw
  modified_base (246)..(252): a, c, t, g, unknown or other
  misc_feature (246)..(252): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttccccacctcctcactagtgcgactgagcgggctggcaaggcgcatagnnnnnnn

SEQ ID NO: 233770 - DNA, 259 bp, Homo sapiens
  misc_feature: GYAE6OF02GDW9L.39.86.H09.1.454.CMB.1.raw
  modified_base (246)..(259): a, c, t, g, unknown or other
  misc_feature (246)..(259): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccaccctcctcactagtgcgactgagcgggctggcaaggcgcatagnnnnnnnnnnnnnn

SEQ ID NO: 233771 - DNA, 497 bp, Homo sapiens
  misc_feature: GYAE6OF02HOMOP.39.86.H09.1.454.CMB.1.raw
  modified_base (301)..(301): a, c, t, g, unknown or other
  misc_feature (301)..(301): n is a, c, g, or t
  modified_base (369)..(369): a, c, t, g, unknown or other
  misc_feature (369)..(369): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttangaggtcagtaatcggcctcgaggggtttcaatcgcttctctggctcaagtctggcaacacgcctcccngaccatctctgggcctccaggctgaggacgaggctgtattattactgcagtctcatttgctaatcagtgagtcttatgttcgttggaagtgggaccaaggtcagttccgtcgtaggtcagcccaacgg

SEQ ID NO: 233772 - DNA, 252 bp, Homo sapiens; identical to SEQ ID NO: 233257
  misc_feature: GYAE6OF02IONOM.39.86.H09.1.454.CMB.1.raw
  modified_base (246)..(252): a, c, t, g, unknown or other
  misc_feature (246)..(252): n is a, c, g, or t

SEQ ID NO: 233773 - DNA, 515 bp, Homo sapiens
  misc_feature: GYAE6OF02G8M0Y.39.86.H09.1.454.CMB.1.raw
  modified_base (365)..(365): a, c, t, g, unknown or other
  misc_feature (365)..(365): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaaactccatcatttatgaggtcagtaatcggccctcgaggggtttctaatcgcttctctggctcaagtctggcaacncgcctcctgaccatctctgggctcgaggctgaggcgaggctgattattactgcagtctacgtatttgactaatcgagtgagtcttagtgttacgttcggaagttcgggaacctaggtcacgttcgtccgtaggtccacgaccctaaccgg

SEQ ID NO: 233774 - DNA, 251 bp, Homo sapiens
  misc_feature: GYAE6OF02IJDY3.39.86.H09.1.454.CMB.1.raw
  modified_base (245)..(251): a, c, t, g, unknown or other
  misc_feature (245)..(251): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccgcctcctcactagtgcgactgagcgggctggcaaggcgcatagnnnnnnn

SEQ ID NO: 233775 - DNA, 249 bp, Homo sapiens; identical to SEQ ID NO: 233250
  misc_feature: GYAE6OF02IURK2.39.86.H09.1.454.CMB.1.raw
  modified_base (246)..(249): a, c, t, g, unknown or other
  misc_feature (246)..(249): n is a, c, g, or t

SEQ ID NO: 233776 - DNA, 532 bp, Homo sapiens
  misc_feature: GYAE6OF02HJX72.39.86.H09.1.454.CMB.1.raw
  modified_base (359)..(359): a, c, t, g, unknown or other
  misc_feature (359)..(359): n is a, c, g, or t
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgaggtcagtaatcggccctcgagggtttctaatcgcttctctgctcaagtctggcaacncggcctccctgaccatctcgtggcctccgagctgaggacgaggctgatttatactgcagctactatttgactaattcctagtagaggtctttatgttcgtttacgggaaggtcgggaaccgtaaggtctagttccggtaccgtaggttaccacggtacccgaaggaacccccg

SEQ ID NO: 233777 - DNA, 426 bp, Homo sapiens
  misc_feature: GYAE6OF02F7XLV.39.86.H09.1.454.CMB.1.raw
  modified_base (410)..(410): a, c, t, g, unknown or other
  misc_feature (410)..(410): n is a, c, g, or t
  modified_base (416)..(426): a, c, t, g, unknown or other
  misc_feature (416)..(426): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacagcccccaaactcatcatttatgaggtcagtaatcggccctcaggggtttctaatcgcttctctggctccaagtctggcaacacggcctccctgaccatctctgggctccaggctgaggacgaggctgattattactgcagctcatttgcaatcagtgaggcttatgtcttcggaagtgggaccaaggtcatcgtcctaggtcagcccaaggcccaacccatgtcactctgttcccacctctcactagtgcactgagcggctggcaagggcncatagnnnnnnnnnnn

SEQ ID NO: 233778 - DNA, 295 bp, Homo sapiens
  misc_feature: GYAE6OF02IFBEA.39.86.H09.1.454.CMB.1.raw
  modified_base (247)..(247): a, c, t, g, unknown or other
  misc_feature (247)..(247): n is a, c, g, or t
  modified_base (253)..(255): a, c, t, g, unknown or other
  misc_feature (253)..(255): n is a, c, g, or t
  modified_base (257)..(259): a, c, t, g, unknown or other
  misc_feature (257)..(259): n is a, c, g, or t
  modified_base (261)..(263): a, c, t, g, unknown or other
  misc_feature (261)..(263): n is a, c, g, or t
  modified_base (265)..(265): a, c, t, g, unknown or other
  misc_feature (265)..(265): n is a, c, g, or t
  modified_base (267)..(295): a, c, t, g, unknown or other
  misc_feature (267)..(295): n is a, c, g, or t
tcagtcgcactagtcacgaccggtgctcgatttagtgctatagacttggggtttaggggggtttggtggtctccactcccgccttgacgaggctgattattacctgcagatcatttgcaatcagtgaggcttatcgtcttcggaagtgggaccaaggtcatcgtcctaggtcagcccaaggccaaccccactgtcactctgttcccgccctccgtcactacgtgcgactgagcgggctggcaaggcncatagnnncnnngnnncngnnnnnnnnnnnnnnnnnnnnnnnnnnnnn

SEQ ID NO: 233779 - DNA, 254 bp, Homo sapiens
  misc_feature: GYAE6OF02FIMA1.39.86.H09.1.454.CMB.1.raw
  modified_base (246)..(254): a, c, t, g, unknown or other
  misc_feature (246)..(254): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccaccctcctcactagtgcgactgagcgggctggcaaggcgcatagnnnnnnnnn

SEQ ID NO: 233780 - DNA, 489 bp, Homo sapiens
  misc_feature: GYAE6OF02FY8WF.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagccccaaactcatcatttatgagtcagtaatcggcctcaggggtttctaatcgcttctctggctccaagtctggcaacacggctccctgaccatctctgggctccaggctgaggacgaggctgattatactgcagctcatttgcaatcagtgaggtcttatgtcttcggaagtgggaccaggtcagtcgtctaggtccagccctaacgg

SEQ ID NO: 233781 - DNA, 556 bp, Homo sapiens
  misc_feature: GYAE6OF02HPV06.39.86.H09.1.454.CMB.1.raw
  modified_base (309)..(309): a, c, t, g, unknown or other
  misc_feature (309)..(309): n is a, c, g, or t
  modified_base (375)..(375): a, c, t, g, unknown or other
  misc_feature (375)..(375): n is a, c, g, or t
tcagtcgcactagtcacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatgactatgtctcctggtaccagcaatatccaggcacacgaccccaaactcatcatttangagtcagtaagtcggcctcgtagggtttcaatcgtcttctctgctcaagtctgacacgcgcctccngaccatctcgtggctcgaggctagaggacgagtctagtacttagttactcgacagtcctacgtattttcgactaaattcgaggttcgacgggttactttagtcggttaccgtttacgggaaggttaccgggaaccgtaaggttcctaacgttccggttaccgttacgggtacctaaccggg

SEQ ID NO: 233782 - DNA, 522 bp, Homo sapiens
  misc_feature: GYAE6OF02HHRI2.39.86.H09.1.454.CMB.1.raw
  modified_base (304)..(304): a, c, t, g, unknown or other
  misc_feature (304)..(304): n is a, c, g, or t
  modified_base (323)..(323): a, c, t, g, unknown or other
  misc_feature (323)..(323): n is a, c, g, or t
  modified_base (354)..(354): a, c, t, g, unknown or other
  misc_feature (354)..(354): n is a, c, g, or t
  modified_base (361)..(361): a, c, t, g, unknown or other
  misc_feature (361)..(361): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggtatgactatgtctcctggtaccagcaatatccaggcacacgcccccaaactcatcatttangaggtcagtaatcggcctnaggggttctaatcgcttctctgctcaagtcnggcaacncgcctcctgaccatctcgtcgggctccgaggctgacggacgaggcctagtattattactgctagtctactatttcgactaatcagtgagtcttagtcgttcgttacgggaagtcgggaacctaggtcacgttccgtaccgttaggccacgacccgaaccgg

SEQ ID NO: 233783 - DNA, 500 bp, Homo sapiens
  misc_feature: GYAE6OF02I49AY.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgagtcagtaatcggcctcaggggtttctaatcgcttctctgctccaagtctggcaacacgcctccctgaccatctctggctccaggctgaggacgaggctgattattactgcagctcatttgacatcagtgagtcttatgttcgttcggaagtgggaacctaaggtcagtcgtccgtaggtccagacccaaccgg

SEQ ID NO: 233784 - DNA, 498 bp, Homo sapiens
  misc_feature: GYAE6OF02GSKKS.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgaggtcagtaatcggccctgaggggtttcaatcgcttctctgctcagtctgcacacggcctccctgaccatctcgtgggctccgaggctgaggacgaggctgattattacgtgcagtctctatttgctaatcagtgaggtcttagtgttcgttggaagttgggaccaagtcagttcgtcgtagtcgacgcccaacgg

SEQ ID NO: 233785 - DNA, 499 bp, Homo sapiens
  misc_feature: GYAE6OF02JZI64.39.86.H09.1.454.CMB.1.raw
  modified_base (302)..(302): a, c, t, g, unknown or other
  misc_feature (302)..(302): n is a, c, g, or t
  modified_base (358)..(358): a, c, t, g, unknown or other
  misc_feature (358)..(358): n is a, c, g, or t
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
  modified_base (408)..(408): a, c, t, g, unknown or other
  misc_feature (408)..(408): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcaacagcccccaaactcatcatttangaggtcagtatcggcctcgtaggggttctatcgcttctctggctcaagtctgcacncgcctccngaccntctcgtggctcgagctgagacgaggctagattctacngcagctcgtatttgctaatcagtgagtcttagtgtcgttgggaagtgggaaccctaaggtcacgttcgacctaggtcacggtcccgaacgg

SEQ ID NO: 233786 - DNA, 572 bp, Homo sapiens
  misc_feature: GYAE6OF02HT35S.39.86.H09.1.454.CMB.1.raw
  modified_base (307)..(307): a, c, t, g, unknown or other
  misc_feature (307)..(307): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatatccaggcacacgcccccaaactcatcatttangagtcagtaatccgcctgtagggtttactaatcgcttctctggctccaagtctggacaaccgacggccctccctcgaccatcctcgtgggcctccgacggctaggaggacgaggtctagtactttattactgcagtcttctatttcgactaatcgtaagtggacgtctttagttcggttaccgtttacgggaacggttacgggaaccgtaagggtccgtagttcccggtacccgttaggtaccgaccgtaccccgtaaacccggg

SEQ ID NO: 233787 - DNA, 248 bp, Homo sapiens; identical to SEQ ID NO: 233246
  misc_feature: GYAE6OF02FY8NH.39.86.H09.1.454.CMB.1.raw
  modified_base (246)..(248): a, c, t, g, unknown or other
  misc_feature (246)..(248): n is a, c, g, or t

SEQ ID NO: 233788 - DNA, 506 bp, Homo sapiens
  misc_feature: GYAE6OF02F6L4U.39.86.H09.1.454.CMB.1.raw
  modified_base (366)..(366): a, c, t, g, unknown or other
  misc_feature (366)..(366): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgagtcagtaatcggccctcgtaggggtttctaatcgtcttctctggctcaagtctgcaacncggcctcctgaccatctcgtgggctccgaggctgaggacgaggctgattatactgcagctctatttgctaatcagtgagtcttatgtcgttcggaagtcgggacctaggtcagtcgtccgtaggtcacgcccgtaaccgg

SEQ ID NO: 233789 - DNA, 501 bp, Homo sapiens
  misc_feature: GYAE6OF02IXZJ7.39.86.H09.1.454.CMB.1.raw
  modified_base (360)..(360): a, c, t, g, unknown or other
  misc_feature (360)..(360): n is a, c, g, or t
  modified_base (416)..(416): a, c, t, g, unknown or other
  misc_feature (416)..(416): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgaggtcagtaatcggccctcgaggggtttctaatcgcttctctgctcaagtctgcaacncgcctcctgacccatctctgggctccgaggctggaggacgaggctgatttattacngcagctcatttgctaatcagtgaggtcttagtgtacgtcggaagtcgggactaaggtcagttcgtacctaggtcacgcccaacgg

SEQ ID NO: 233790 - DNA, 251 bp, Homo sapiens; identical to SEQ ID NO: 233336
  misc_feature: GYAE6OF02GTLSL.39.86.H09.1.454.CMB.1.raw
  modified_base (247)..(251): a, c, t, g, unknown or other
  misc_feature (247)..(251): n is a, c, g, or t

SEQ ID NO: 233791 - DNA, 499 bp, Homo sapiens
  misc_feature: GYAE6OF02HCVFP.39.86.H09.1.454.CMB.1.raw
  modified_base (305)..(305): a, c, t, g, unknown or other
  misc_feature (305)..(305): n is a, c, g, or t
  modified_base (364)..(364): a, c, t, g, unknown or other
  misc_feature (364)..(364): n is a, c, g, or t
  modified_base (419)..(419): a, c, t, g, unknown or other
  misc_feature (419)..(419): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttangagtcagtaatcggccctcaggggtttctaatcgcttctctgctccaagtctggcaacncggcctccctgaccatctctgggctccgaggctgaggacgaggctgattattacngcagctcatttgctaatcagtgagtcttatgtcttcggagtcgggaactaggtcacgtcgtcgtaggtcacgcccaacgg

SEQ ID NO: 233792 - DNA, 495 bp, Homo sapiens
  misc_feature: GYAE6OF02FGLY8.39.86.H09.1.454.CMB.1.raw
  modified_base (300)..(300): a, c, t, g, unknown or other
  misc_feature (300)..(300): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctctggtaccagcaatatccaggcacagcccccaaactcatcatttangagtcagtaatcggcctcaggggtttctaatcgcttctctggctcaagtctggcaacacggcctcctgaccatctctgggctccgaggctgaggacgaggctgattattactgcagctcatttgctaatcagtgagtcttatgtcttcgggaagttcgggaacctaggtcagtcgtcctaggtccagcccaacgg

SEQ ID NO: 233793 - DNA, 751 bp, Homo sapiens
  misc_feature: GYAE6OF02IT42T.39.86.H09.1.454.CMB.1.raw
tcagtcgcactagtcacgaccggtgctcgatttagtgctatagacttggggttgggggtctcaggaggcagcgctctcgaggacatctccaccatggcctgggctctgctgctcctcaccctcctcactcagggcacagggtcctggccctagtctgccctgactcaggctgcctccgtgtctgggtctctaggacacggtcgatcaccatccgtcctgactactcggaaccagcagtgacgttgggggtatgactatgtctccgtggtaccagcaatactccgaggccaacgacgacccccaaactcgacgtcctagtttagcgaggtcagtaactccggaccctacgaggggtttctaaagtccgtcttacgttcgtcggtctaccgtaagtccgtacggacctaaccgtaccgggtcccttacccgtacgaaccctattcccgttacggtcggggtcccttacccggaggtaccgttacgggaacgggtaaccggtagggtaccgttaggttaactttaacgtttaacccgtggtacgtaacggttaccgttaccgttaacgtttttaccggaaccttaaacgtttacggacggtttaacgggtaccgggttaaccgttttacgtttacgggttaccggttttaacggggtaaaccggttaccgggggtaaacccttaacgggttacttaacggttacccggtttaccggttacggttacccggtacccggtaccccggtaaacccgg

SEQ ID NO: 233794 - DNA, 504 bp, Homo sapiens
  misc_feature: GYAE6OF02GQWKK.39.86.H09.1.454.CMB.1.raw
  modified_base (302)..(302): a, c, t, g, unknown or other
  misc_feature (302)..(302): n is a, c, g, or t
  modified_base (362)..(362): a, c, t, g, unknown or other
  misc_feature (362)..(362): n is a, c, g, or t
tcagtcgcactagtcacgaccggtgctcgatttagtgctatagacttggggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatatccaggcacagcccccaaactcatcatttangaggtcagtaatcggccctcgtagggtttctaatcgcttctctggctcagtctggcaacncgcctcctgaccatctcgtcgggctccgaggctggacggacgaggtctagattacttactgcagctacatttgctaatcagtgagtcttatgtctcggaagtcggacaggtcagtcgtcgtaggtcacgacccaggtacccc

SEQ ID NO: 233795 - DNA, 441 bp, Homo sapiens
  misc_feature: GYAE6OF02GYWKY.39.86.H09.1.454.CMB.1.raw
  modified_base (422)..(441): a, c, t, g, unknown or other
  misc_feature (422)..(441): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacagccccccaaactcatcatttatgaggtcagtaatcggccctcaggggtttctaatcgcttctctggctccaagtctggcaacacggcctccctgaccatctctgggctccaggctgaggacgaggctgattatactgcagctcatttgcaatcagtgaggtcttatgtcttcggaagtgggaccaaggtcatcgtcctaggcagcccaaggcccaaacccatgtacactctcgttcccgccctcctcactagtgcgactgagcgggctggcaaggcacatagnnnnnnnnnnnnnnnnnnnn

SEQ ID NO: 233796 - DNA, 508 bp, Homo sapiens
  misc_feature: GYAE6OF02JERZW.39.86.H09.1.454.CMB.1.raw
  modified_base (305)..(305): a, c, t, g, unknown or other
  misc_feature (305)..(305): n is a, c, g, or t
  modified_base (364)..(364): a, c, t, g, unknown or other
  misc_feature (364)..(364): n is a, c, g, or t
  modified_base (419)..(419): a, c, t, g, unknown or other
  misc_feature (419)..(419): n is a, c, g, or t
  modified_base (446)..(446): a, c, t, g, unknown or other
  misc_feature (446)..(446): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttangaggtcagtaatcggccctcaggggtttctaatcgcttctctggctcaagtctgcaacncggcctccctgaccatctcgtggcctccaggctgaggacgaggctgattattacngcagctctatttgctaatcagtgagtnttagtgtcgttcggaagtcgggaccaaggttcagttcgtccgtaggtcacggccctaaccgg

SEQ ID NO: 233797 - DNA, 592 bp, Homo sapiens
  misc_feature: GYAE6OF02HUBY5.39.86.H09.1.454.CMB.1.raw
  modified_base (300)..(300): a, c, t, g, unknown or other
  misc_feature (300)..(300): n is a, c, g, or t
  modified_base (360)..(360): a, c, t, g, unknown or other
  misc_feature (360)..(360): n is a, c, g, or t
tcagtcgcactagtcacgaccggtgctcgatttagtgctatagacttggggggggggtctcaggaggcagcgctctcaggacatctccaccatggcctgggctctgctgctcctcaccctcctcactcagggcacagggtcctgggcccagtctgcccttgactcaggctgcctccgtgtctgggtctctaggacagtcgatcaccatctcctgcactggaaccagcagtgacgttgggggttatgatatgtctctggtaccagcaatatccaggcacacgcccccaaatcatcatttangagtcagtaagtcggcctgagggtttactaatcgtcttctcgtggctcaagtctgcaacncggcctccctgaccactctcgtcgggcctccgagctaggacggacgaggtctagatttattacgtgcagtcttactagttttcgactaactcgaacggttaggacggttactttagttcgtttacccggttacggggtaaaggttaccggggtaaccgtaaacgggttacctacgttacccggttccgttaacgggtaccgtaacccggtacccggtaaccgggtaaccccc

SEQ ID NO: 233798 - DNA, 250 bp, Homo sapiens; identical to SEQ ID NO: 233301
  misc_feature: GYAE6OF02FH1CR.39.86.H09.1.454.CMB.1.raw
  modified_base (246)..(250): a, c, t, g, unknown or other
  misc_feature (246)..(250): n is a, c, g, or t

SEQ ID NO: 233799 - DNA, 535 bp, Homo sapiens
  misc_feature: GYAE6OF02G33H7.39.86.H09.1.454.CMB.1.raw
  modified_base (369)..(369): a, c, t, g, unknown or other
  misc_feature (369)..(369): n is a, c, g, or t
tcagtcgcactagtcacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacacgcccccaaactcatcatttatgaggtcagtaatcggccctcgaggggtttctaatcgcttctctggctcaagtctggcaacnccggcctccctgacccatcctcgtcgggcctccgaggctggaggacgaggctagtattattactgcagctactatttcgctaatcagtgaggtcttagtcgttcgttacgggaaggttcgggtaacctaagggttcctaagttccggtaccttagggtcaacccgg

SEQ ID NO: 233800 - DNA, 511 bp, Homo sapiens
  misc_feature: GYAE6OF02I3UWQ.39.86.H09.1.454.CMB.1.raw
  modified_base (360)..(360): a, c, t, g, unknown or other
  misc_feature (360)..(360): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaatcatcattatgagtcagtaatcggcctgagggtttctaatcgtcttctctggctccaagtctggcaacnccggcctccctgaccatctcgtcgggctccgaggctagaggacgagctagattattactgcagctctatttgactaatcagtgagtcttatcggtcgttacggaggtacgggaccaaggtcagttccgtaccgtaggccacgacccaacgg

SEQ ID NO: 233801 - DNA, 642 bp, Homo sapiens
  misc_feature: GYAE6OF02GTA4D.39.86.H09.1.454.CMB.1.raw
tcagtcgcactagtcacgaccggtgctcgatttagtgctatagacttgggttgggggtcgtcaggaggcagcgctctcaggacatctccaccatggcctgggcgtctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctctggtaccagcaatatccaggcacacgcccccaaatcaatctatttatgagtcaagtaatccggaccctcgtaggggtttctaaactcgtctttcctcgtcggtcctaccaagttcgtacggcaaaccgaccggccctccctgaaccctattcgtactggggccctaccgtagggcttggaagggaccgtaggggcctttagggaaactttaagtttacgtggactaacgtccttactattttcggacttaaagtcgtaaggttgacgggtactttagttggttccggtttaacgggaaaggtttcggggaaaacctttaagggggtccctaacggtttccgttaacccggttacggttacccgaaccggtccccgaaaacccggg

SEQ ID NO: 233802 - DNA, 498 bp, Homo sapiens
  misc_feature: GYAE6OF02GSMTU.39.86.H09.1.454.CMB.1.raw
tcagtcgcactagtcacgaccggtgctcgatttagtgctatagacttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaatcatcatttatgaggtcagtaatcggccctcgaggggtttctaatcgctttctctggctccaagtctggcaacacggcctccctgaccatctctgggcctccgaggctggaggacgaggctgattattactgcagctctatttgctaatcagtgagtcttatgtcttaggaagtgggacaggtcagtcgtctaggtcacgcccaggacccc

SEQ ID NO: 233803 - DNA, 430 bp, Homo sapiens
  misc_feature: GYAE6OF02FUSO4.39.86.H09.1.454.CMB.1.raw
  modified_base (358)..(358): a, c, t, g, unknown or other
  misc_feature (358)..(358): n is a, c, g, or t
  modified_base (413)..(413): a, c, t, g, unknown or other
  misc_feature (413)..(413): n is a, c, g, or t
  modified_base (419)..(430): a, c, t, g, unknown or other
  misc_feature (419)..(430): n is a, c, g, or t
tcagtcgcactagtcacgaccggtgctcgatttagtgctatagacttgggtttgggggctgtgcctggatattgctggaaccagcagtgacgttggggttatgactatgtctcctggtaccagcaatatccaggcacagcccccaaactcatcatttatgaggtcagtaatcggccctcaggggtttctaatcgcttctctggctccaagtctggcaacacggcctccctgacccatctctgggctccaggctgaggacgaggctgattattactgcagctcatttgcaatcagtgaggcttatgtcttcggaagtgggaccaaggtcatcgtcctaggtcagcccaaggccaacccntgtcactctgttcccaccctcctcactagtcgcgactgagcgggctggcaaggcncatagnnnnnnnnnnnn

SEQ ID NO: 233804 - DNA, 544 bp, Homo sapiens
  misc_feature: GYAE6OF02IDQZ6.39.86.H09.1.454.CMB.1.raw
  modified_base (411)..(411): a, c, t, g, unknown or other
  misc_feature (411)..(411): n is a, c, g, or t
tcagtcgcactagtcacgaccggtgctcgatttagtgctatagacttggggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctctggtaccagcaatatccagcacacgcccccaaactcatcatttatgaggtcagtaatcggcctcgtagggtttctaatcgtctttctctggctcaagtctggcaacaccggccctccctgaccatcctcgtcgggcctccgaggcgtagacggacgnggctgactttatactgctagctctatttcgactaatctaggtgaggtcttaagtcgtacgttacgggaagttcgggaacctaaggtcctagttaccggttccgtaggtccgaacgtaccccgaacggtacccc

SEQ ID NO: 233805 - DNA, 632 bp, Homo sapiens
  misc_feature: GYAE6OF02IV2HU.39.86.H09.1.454.CMB.1.raw
tcagtcgcactagtcacgaccggtgctcgatttagtgctatagacttgggtttgggggggtctcaggaggcagcgctctcaggacatctccaccatggcctgggctctgctgctcctcaccctcctcactcgagggcacgagggtcctgggcccagtctcgccctgactcaggctcgcctccgtgttctgggtctctaggacagtcgatcaccatcctcctgcactcggaaccagcagtggtacggttgggggttatgactagttcgtcctccgtcggtaccagacaatactaccgaggacacaccgacccccaaactcactctatttatgagtcagtacgtcggcctcgtacgggtttctaatcgtcttctcgtcgctacagtcgtcgacaacgccgtcctcccgtacgacctatctcgtcgggcctccgacggcgtaggacggacggacggtcgttagttaactttaacgttaccgtgacgtacgtccttaccttagtttacgtaactaacgttccgaggttcggacggttctttagttcggtttaccggttaagggtaacggtacgggtaaccgtaaggtacctacggttcccgttaccgtacgggtacctaccggacccgtaacccgg

SEQ ID NO: 233806 - DNA, 250 bp, Homo sapiens
  misc_feature: GYAE6OF02GR8PY.39.86.H09.1.454.CMB.1.raw
  modified_base (247)..(250): a, c, t, g, unknown or other
  misc_feature (247)..(250): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccaccctcctcactagtgcgactgagcgggctggcaaggcgcatagnnnn

SEQ ID NO: 233807 - DNA, 519 bp, Homo sapiens
  misc_feature: GYAE6OF02HF0VA.39.86.H09.1.454.CMB.1.raw
  modified_base (304)..(304): a, c, t, g, unknown or other
  misc_feature (304)..(304): n is a, c, g, or t
  modified_base (375)..(375): a, c, t, g, unknown or other
  misc_feature (375)..(375): n is a, c, g, or t
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttangaggtcagtaatcggccctcgaggggtttctaatcgcttctctggctcaagtctggcaacacggcttcccngaccatctctgggctccgaggctgaggacgaggctgattattactgcagctctatttgactaatcagtgaggtcttagtgtacgttcggaagttcgggaacctaaggtcagttccgtaccgttaggtccacggcccgtaaacgg

SEQ ID NO: 233808 - DNA, 675 bp, Homo sapiens
  misc_feature: GYAE6OF02IFSV0.39.86.H09.1.454.CMB.1.raw
tcagtcgcactagtcacgaccggtgctcgatttagtgctatagacttggggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggtatgactatgtctcctggtaccagcaatatccaggccaacacggaccccccaaaatcctaatacctattttactggaggttcaagtaactccggccctcgtaggggtttactaagtccgtactttcctcgtcggtcctccgtaaaggtcctaggaccaaaccgtacccggcccttcccgtacgaccctaacgttcctccgttacgggccctccgtacgggcgtggaacgggacgaggtccgttaggattttaacttaacgtcgacgtaacgtccgttagttaacgtttcgactaagttccgtaaggttggtacggttacttttagttcggtttaccgtttacggggaaacggttccggggtaaaccgtaacgggttactacggtttcccgtaccgttaacggtaccgtaacccgccccgtaaacggtaacccccc

SEQ ID NO: 233809 - DNA, 250 bp, Homo sapiens; identical to SEQ ID NO: 233258
  misc_feature: GYAE6OF02GJRCY.39.86.H09.1.454.CMB.1.raw
  modified_base (246)..(250): a, c, t, g, unknown or other
  misc_feature (246)..(250): n is a, c, g, or t

SEQ ID NO: 233810 - DNA, 522 bp, Homo sapiens
  misc_feature: GYAE6OF02JJTFP.39.86.H09.1.454.CMB.1.raw
  modified_base (303)..(303): a, c, t, g, unknown or other
  misc_feature (303)..(303): n is a, c, g, or t
  modified_base (313)..(313): a, c, t, g, unknown or other
  misc_feature (313)..(313): n is a, c, g, or t
  modified_base (354)..(354): a, c, t, g, unknown or other
  misc_feature (354)..(354): n is a, c, g, or t
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
  modified_base (387)..(387): a, c, t, g, unknown or other
  misc_feature (387)..(387): n is a, c, g, or t
tcagtcgcactagtcacgaccggtgctcgatttagtgctatagacttgggtttgggggggtctcaggaggcagggctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgccccaaatcatcatttangagtcagtancgcctgagggttcaatcgcttctctgctcagtctggcaacncgctccngcatcnctggctcgagctagagacgngctgtattattctgctagtcctacgtatttagacctaagtcgtagtcggacgtctttaagtcgttacgttacggaacggttcggaacctaaggttcacgttccgtacgtaggtaccacgtacccgaaggtacccc

SEQ ID NO: 233811 - DNA, 509 bp, Homo sapiens
  misc_feature: GYAE6OF02GZ13D.39.86.H09.1.454.CMB.1.raw
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttatgagtcagtaatcggccctgaggggtttctaatcgcttctctggctccaagtctggcaacncggcctccngaccatctcgtggctccgaggctggaggacgaggctgtatttattctgcagtctctatttgctaatcagtgagtcttatcgtcgttcggaagtcgggaacctaggtcagttccgtaccgtaggtccacgcccaaccgg

SEQ ID NO: 233812 - DNA, 504 bp, Homo sapiens
  misc_feature: GYAE6OF02F8BB1.39.86.H09.1.454.CMB.1.raw
  modified_base (324)..(324): a, c, t, g, unknown or other
  misc_feature (324)..(324): n is a, c, g, or t
  modified_base (362)..(362): a, c, t, g, unknown or other
  misc_feature (362)..(362): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgagtcagtaatcggccctnaggggtttcaatcgcttctctggctcaagtctgcaacncggcctcctgaccatctctgggctccaggctgaggcgaggctgattatactgcagctcatttgctaatcagtgacggtcttagtgtcgttcggaaggtcgggaccctaaggtccagtcgtacctaggtcacgacccaaccgg

SEQ ID NO: 233813 - DNA, 423 bp, Homo sapiens
  misc_feature: GYAE6OF02GW2R9.39.86.H09.1.454.CMB.1.raw
  modified_base (358)..(358): a, c, t, g, unknown or other
  misc_feature (358)..(358): n is a, c, g, or t
  modified_base (411)..(411): a, c, t, g, unknown or other
  misc_feature (411)..(411): n is a, c, g, or t
  modified_base (416)..(423): a, c, t, g, unknown or other
  misc_feature (416)..(423): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacagcccccaaactcatcatttatgaggtcagtaatcggccctcaggggtttctaatcgcttctctggctccaagtctggcaacacggcctccctgaccatctctgggctccaggctgaggacgaggctgattattactgcagctcatttgcaatcagtgaggcttatgtcttcggaagtgggaccaaggtcatcgtcctaggtcagcccaaggccaacccntgtcactctgttcccgccctcctcactagtgcgactgagcgggctggcaggcncatgnnnnnnnn

SEQ ID NO: 233814 - DNA, 500 bp, Homo sapiens
  misc_feature: GYAE6OF02J15SA.39.86.H09.1.454.CMB.1.raw
  modified_base (300)..(300): a, c, t, g, unknown or other
  misc_feature (300)..(300): n is a, c, g, or t
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttangaggtcagtaatcggccctcaggggtttcaagtcgcttctctggctccaagtctgcaacacggcctcccgtgaccatctctcggctccgaggctgaggacgagctgattatactgcagctctatttgctaatcagtgaggtcttatcgtcgttacggaagtggacaaggtcagttcgtctaggtcacgccgaagtacccc

SEQ ID NO: 233815 - DNA, 570 bp, Homo sapiens
  misc_feature: GYAE6OF02HZ2JL.39.86.H09.1.454.CMB.1.raw
  modified_base (305)..(305): a, c, t, g, unknown or other
  misc_feature (305)..(305): n is a, c, g, or t
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctctggtaccagcaatatccaggcacacgacccccaaactcaatcatttangagtcagtaatcggcctcgtaggggttactaagtcgtcttctcgttggctacctaagtcgtaggacaaccgacgtcccctcccgtcgaaccctactcctcgtcgggctccgaggcctggacggacggacggtctagtaactttacgtactcgcacgtctactagtttgactaatcgagtcgagtcttagtggtttcgtacgggaaggttcgggaaccgtaacggtcgtaacgttccgtaccgttaggtccacggtacccaaccgg

SEQ ID NO: 233816 - DNA, 495 bp, Homo sapiens
  misc_feature: GYAE6OF02IM0IS.39.86.H09.1.454.CMB.1.raw
  modified_base (367)..(367): a, c, t, g, unknown or other
  misc_feature (367)..(367): n is a, c, g, or t
  modified_base (395)..(395): a, c, t, g, unknown or other
  misc_feature (395)..(395): n is a, c, g, or t
  modified_base (407)..(407): a, c, t, g, unknown or other
  misc_feature (407)..(407): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttatgagtcagtaatcggcctcgagggttctaatcgtcttctctggctcaagtctgacacacgcctccngaccatctctgggctcgagctgagacgngctgattatacngcagtctactattgactaatcgagtgagtcttatgtcgtcggaagtcggaactaggtcagtccgtacgtacggtcacgtccgaaccgg

SEQ ID NO: 233817 - DNA, 562 bp, Homo sapiens
  misc_feature: GYAE6OF02G32YK.39.86.H09.1.454.CMB.1.raw
  modified_base (307)..(307): a, c, t, g, unknown or other
  misc_feature (307)..(307): n is a, c, g, or t
  modified_base (369)..(369): a, c, t, g, unknown or other
  misc_feature (369)..(369): n is a, c, g, or t
  modified_base (383)..(383): a, c, t, g, unknown or other
  misc_feature (383)..(383): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatatccaggcacacgcccccaaatcatcaatttangagtcagtaatccggccctgtagggtttctaatcgtcttctctgctacaagtctggacaacncggcctcctgaccntcctcgtgggcctccgacggtctaggacggtacgaggtcttaggtaatttacgttacgtgactaggtccttactatttcggactaatcgagtagagtcttagtcgttacgttacgggaaggttacgggaacctaaggtcctacgttccgtaccgtaggtccgacggacccgtaacccgg

SEQ ID NO: 233818 - DNA, 515 bp, Homo sapiens
  misc_feature: GYAE6OF02GKXQU.39.86.H09.1.454.CMB.1.raw
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttatgagtcagtaatcggcctcaggggtttctaatcgtcttctctgctcagtctggcaacacgcctcctgacctatctcgtgggcctccgaggctaggacggacgaggtctgtattattactgcagtctctatttgactaatcagtgagtcttagtgtcgttacggaagttcgggacctaaggtcagttcgtaccgtaggtctacgcccgtaacgg

SEQ ID NO: 233819 - DNA, 495 bp, Homo sapiens
  misc_feature: GYAE6OF02GDZR4.39.86.H09.1.454.CMB.1.raw
tcagtcgcactagtcacgaccggtgctcgatttagtgctatagacttgggggggggtctcaggaggcagcgctctcagaacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatgactatgtctcctggtaccagcaatatccaggcacagcccccaaatcatcatttatgagtcagtaatcggccctcaggggtttctaatcgcttctctggctcaagtctgcaacacggcctcctgaccatctctgggctccgaggctgaggacgaggctgattattactgcagctctatttgacaatcagtgagtcttatgtctcggaagtggaacaaggtcagttcgtacgtagtcacgacccgaagacccc

SEQ ID NO: 233820 - DNA, 525 bp, Homo sapiens
  misc_feature: GYAE6OF02IAW33.39.86.H09.1.454.CMB.1.raw
  modified_base (366)..(366): a, c, t, g, unknown or other
  misc_feature (366)..(366): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgaggtcagtaatcggccctcaggggtttctaagtcgcttctctgctccaagtctggcaacncggcctccctgaccatctcgtgggcctccaggctggaggacgaggctgatttacttactgcagtcctcattttgactaatcgagtgagtctttagtgttcgttcggaaggttgggaacccaaggtcattccggtaccgttaggtccacgccctaaccgg

SEQ ID NO: 233821 - DNA, 505 bp, Homo sapiens
  misc_feature: GYAE6OF02F72K2.39.86.H09.1.454.CMB.1.raw
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgaggtcagtaatcggccctcaggggtttctaatcgcttctctgctccaagtctggcacacggcctcctgaccatctctgggctccaggctgaggacgaggctgattattactgacagctctagtttgctaatcagtgaggtcttatgttcgttcgggaagttcggggactaaggtcagtcgtcctaggtcaggcccaacgg

SEQ ID NO: 233822 - DNA, 531 bp, Homo sapiens
  misc_feature: GYAE6OF02F86HW.39.86.H09.1.454.CMB.1.raw
  modified_base (301)..(301): a, c, t, g, unknown or other
  misc_feature (301)..(301): n is a, c, g, or t
  modified_base (424)..(424): a, c, t, g, unknown or other
  misc_feature (424)..(424): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaatcatcatttangagtcagtaatcggccctcgtaggggtttctaatcgcttctctggctcaagtctggcaacacgcctccctgaccatctctgggcctccgaggctaggacggtacgaggctagtattacttacngacagctctatttgactaatcagtgacgtcttagtcggtcgttacgggaaggttcgggaaccgtaaggttccacgttccggtaccgtaggtcacggccctaaaccgg

SEQ ID NO: 233823 - DNA, 573 bp, Homo sapiens
  misc_feature: GYAE6OF02HT4JU.39.86.H09.1.454.CMB.1.raw
  modified_base (315)..(315): a, c, t, g, unknown or other
  misc_feature (315)..(315): n is a, c, g, or t
tcagtcgcactagtcacgaccggtgctcgatttagtgctatagacttgggtttgggggggggtctcacggaggcagcgtctctcaggactatcggtccaccgatcggcctgggctctgctgctcctcacccgtcctcactcgagggcacagggtcctgggcccagtctgccctgactcaggctgcctccgtgtctgggtctctaggacagtcgatcaccatctcctgcactggaaccagcagtgacggttgggggttatgactatgtctctggtaccagcaatatccaggcacacgccccaaactcatcatttangaggtcagtaatcggccctgaggggtttacaagtcgcttctcgtggctaccaagtctggacaacgacggcctccctgacctatcctcgtgggctccgaggcctaggacggacgacgctagtattattactgctagactctatttcgactaatcgtaggtagtacgtactttagtcgttaccgttaacggaaggttacgggaaccgtaacggtcaacgttccgtaccgttaagggtacctaccggaccctaaacccggg

SEQ ID NO: 233824 - DNA, 513 bp, Homo sapiens
  misc_feature: GYAE6OF02I6RB4.39.86.H09.1.454.CMB.1.raw
  modified_base (299)..(299): a, c, t, g, unknown or other
  misc_feature (299)..(299): n is a, c, g, or t
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacagcccccaaactcatcatttangagtcagtaatcggcctcgagggttctaagtcgcttctctggctccaagtctggcaacacggtcctccctgaccatctcgtgggctccaggctgacggacgaggctgaattattactgctagctcatttgactaatcagtgagtcttagtcgtcttacgggaagttgggaacctaaggttcagttccgtctaggtccacgcccgaaggaccccc

SEQ ID NO: 233825 - DNA, 249 bp, Homo sapiens; identical to SEQ ID NO: 233250
  misc_feature: GYAE6OF02GHU0A.39.86.H09.1.454.CMB.1.raw
  modified_base (246)..(249): a, c, t, g, unknown or other
  misc_feature (246)..(249): n is a, c, g, or t

SEQ ID NO: 233826 - DNA, 493 bp, Homo sapiens
  misc_feature: GYAE6OF02IE8IL.39.86.H09.1.454.CMB.1.raw
  modified_base (340)..(340): a, c, t, g, unknown or other
  misc_feature (340)..(340): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaagcagcagtgacgttggtggttataactatgtctcctggtaccaacagcacccaggcaaagcccccaaaactcatgatttatgaggtcagtaatcggccctcagggtttctaatcgcttntctggctcaagtctggcacacggcctccctgaccatctctgggctcgaggctgaggacgaggctagattattactgcagctcatatacaagcagcagcactcttgtggtattcggcggaggaccaagcgtgacccgtcgtaggtccagacccg

SEQ ID NO: 233827 - DNA, 526 bp, Homo sapiens
  misc_feature: GYAE6OF02GCTQC.39.86.H09.1.454.CMB.1.raw
  modified_base (308)..(308): a, c, t, g, unknown or other
  misc_feature (308)..(308): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatggactatgtctcctggtaccagcaatatccaggcacacgacccccaaactcatcatttangaggtcagtaatcggccctgtaggggtttcaatcgtcttctctggctccaagtctgcacacggcctccctgaccatctcgtcgggcctccgaggctgaggacgaggctgatttatactgcagctctattgactatcagtgagtcttagtgtcgttacggaaggttcgggaacctaaggtcctagttccgtaccgtagggtcctacggaccctaaccgg

SEQ ID NO: 233828 - DNA, 546 bp, Homo sapiens
  misc_feature: GYAE6OF02H7QMD.39.86.H09.1.454.CMB.1.raw
tcagtcgcactagtcacgaccggtgctcgatttagtgctatagacttgggtttggggggggcctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttatgagtcagtaatcggcctcaggggtttctaatcgcttctctggctcaagtctggcaacacgccctcctgaccatcctctcgggctccgaggctggaggacgaggctgattatactgcagtctctatttcgactaatcagtgacgtctttagtcggttacgttacgggtaaggtacggggaaccttaagggtaccttagttccggtaccttaacgggtccaccggtaccccgtaaacccggg

SEQ ID NO: 233829 - DNA, 525 bp, Homo sapiens
  misc_feature: GYAE6OF02HYMJ0.39.86.H09.1.454.CMB.1.raw
  modified_base (366)..(366): a, c, t, g, unknown or other
  misc_feature (366)..(366): n is a, c, g, or t
  modified_base (381)..(381): a, c, t, g, unknown or other
  misc_feature (381)..(381): n is a, c, g, or t
  modified_base (431)..(431): a, c, t, g, unknown or other
  misc_feature (431)..(431): n is a, c, g, or t
  modified_base (443)..(443): a, c, t, g, unknown or other
  misc_feature (443)..(443): n is a, c, g, or t
  modified_base (464)..(464): a, c, t, g, unknown or other
  misc_feature (464)..(464): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaacccagcagtgacggttgggggttatgactatgtctccgtggtaccagcaatatccaggcacacgcccccaaactcatctatttatgaggtcagtaatcgccctgtagggtttctatcgtcttctctggctccagtctggacaacnccggcctcctgaccntctcgtcgggctccgaggctggacggacgacggctaggtatttagttacnggacagtccttntatttgactatcgagtgagtnttagtgtcgtacgggtagtcgggacctaggtcagtccgtccgtaggtcacggaccaaccgg

SEQ ID NO: 233830 - DNA, 248 bp, Homo sapiens; identical to SEQ ID NO: 233251
  misc_feature: GYAE6OF02G7DN9.39.86.H09.1.454.CMB.1.raw
  modified_base (246)..(248): a, c, t, g, unknown or other
  misc_feature (246)..(248): n is a, c, g, or t

SEQ ID NO: 233831 - DNA, 517 bp, Homo sapiens
  misc_feature: GYAE6OF02H7QZN.39.86.H09.1.454.CMB.1.raw
  modified_base (304)..(304): a, c, t, g, unknown or other
  misc_feature (304)..(304): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaatcatcatttangagtcagtaatcggcctcaggggtttctaatcgcttctctggctccaagtctggcaacacggcctcctgaccatctctgggcctcgaggctggaggacgagctgatttatactgcagctctatttgctaatcagtgaggtcttagtgttacgttcggaaggtcgggaaccgtaaggtcagttccgttaccgtaggtacacggaccctaaccgg

SEQ ID NO: 233832 - DNA, 496 bp, Homo sapiens
  misc_feature: GYAE6OF02FOKOY.39.86.H09.1.454.CMB.1.raw
  modified_base (320)..(320): a, c, t, g, unknown or other
  misc_feature (320)..(320): n is a, c, g, or t
  modified_base (361)..(361): a, c, t, g, unknown or other
  misc_feature (361)..(361): n is a, c, g, or t
  modified_base (402)..(402): a, c, t, g, unknown or other
  misc_feature (402)..(402): n is a, c, g, or t
  modified_base (416)..(416): a, c, t, g, unknown or other
  misc_feature (416)..(416): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctctggtaccagcaatatccaggcacagcccccaaactcatcatttatgaggtcagtaatcggccctnaggggtttctaatcgcttctctggctccaagtctggcaacncggcctcctgaccatctctgggcctccgaggctgaggacgnggctgattattacngcagctctatttgctaatcagtgagtcttatgtcgttggaagtcgggaactaggtcacgtcgtctaggtcagcccaacgg

SEQ ID NO: 233833 - DNA, 250 bp, Homo sapiens; identical to SEQ ID NO: 233301
  misc_feature: GYAE6OF02FIVU5.39.86.H09.1.454.CMB.1.raw
  modified_base (246)..(250): a, c, t, g, unknown or other
  misc_feature (246)..(250): n is a, c, g, or t

SEQ ID NO: 233834 - DNA, 616 bp, Homo sapiens
  misc_feature: GYAE6OF02JQNXM.39.86.H09.1.454.CMB.1.raw
  modified_base (303)..(303): a, c, t, g, unknown or other
  misc_feature (303)..(303): n is a, c, g, or t
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgccccaaatcatcatttangagtcaagtatcggcctcgtagggtttctaatcgtcttctctggctcaagtctggacacacggcctcctgacctatcctcgtcgggcccttcgaggtctacgggacggacgacggtcttaggtaacttttacttacgtgaccgtagtccttactaacgttttgaccctaagttccgtaaggttacggtacggttacctttagttccggtttaccggtttaacggggaacggttacggggtaaccctaaggggtttaccacgtttccgggttaacccgtagggttacccgtaccggtaccccctaaacccgggg

SEQ ID NO: 233835 - DNA, 541 bp, Homo sapiens
  misc_feature: GYAE6OF02F53I1.39.86.H09.1.454.CMB.1.raw
  modified_base (302)..(302): a, c, t, g, unknown or other
  misc_feature (302)..(302): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttangaggtcagtaatcggccctgtaggggtttctaatcgtcttctctggctacaagtctgacaacgaccggcctcctcgacctatcctcgtcgggctccgaggtctaggacgggacgaggcttagtaactttattacgtgaccgagtcttactatttgactaatcagtgagtctagtgtcgttacggaaggttcgggaacctaggtctacgttccgtaccgtaggtccacgacccgaaccgg

SEQ ID NO: 233836 - DNA, 511 bp, Homo sapiens
  misc_feature: GYAE6OF02HI86U.39.86.H09.1.454.CMB.1.raw
  modified_base (305)..(305): a, c, t, g, unknown or other
  misc_feature (305)..(305): n is a, c, g, or t
  modified_base (339)..(339): a, c, t, g, unknown or other
  misc_feature (339)..(339): n is a, c, g, or t
  modified_base (418)..(418): a, c, t, g, unknown or other
  misc_feature (418)..(418): n is a, c, g, or t
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttangagtcagtaatcggcctgaggggtttctaatcgnttctctggctccaagtctggcaacacggcctcctgaccatctctgggcctccgaggctgaggacgaggctgattatacngacagctcatttgactaatcagtgagtcttatgttacgttcggaagtcgggaacctaaggtcagttccggtctaggtaccacggacccaacgg

SEQ ID NO: 233837 - DNA, 583 bp, Homo sapiens
  misc_feature: GYAE6OF02GIO9L.39.86.H09.1.454.CMB.1.raw
tcagtcgcactagtcacgaccggtgctcgatttagtgctatagacttggggggggggtctcaggaggcagcgctctcaggacatctccaccatggcctgggctctgctgctcctcaccctcctcactcagggcacagggtcctgggcccagtctgccctgactcaggctgcctcgtgtctgggtctctaggacagtcgatcaccatctcctgcactggaaccagcagtgacggttggggttatgactatgtctcctggtaccagcaatatccaggcacacgacccccaaatcactctatttatgagtcaagtaactcggcctgtagggtttctaatcgtctttctcgtgctacagtctggaccaacgccggccctccctagacctacttctactacgtaccctcgaggtctaggacggacgaggtctagtacttattatcgctacgtctactattaacttacgtagtaacgttactaaagttcggttactcctacgtcggtaccgttcgggttccgggacgggtaacgggaccgttaaggttcgtacccggttaccgtacggtccgtaccggacccgtaacgg

SEQ ID NO: 233838 - DNA, 523 bp, Homo sapiens
  misc_feature: GYAE6OF02IMY6E.39.86.H09.1.454.CMB.1.raw
  modified_base (308)..(308): a, c, t, g, unknown or other
  misc_feature (308)..(308): n is a, c, g, or t
  modified_base (344)..(344): a, c, t, g, unknown or other
  misc_feature (344)..(344): n is a, c, g, or t
  modified_base (438)..(438): a, c, t, g, unknown or other
  misc_feature (438)..(438): n is a, c, g, or t
tcagtcgcactagtcacgaccggtgctcgatttagtgctatagacttgggtttgggggggtcgtcaggaggcagcgctctcaggacatctccaccatggcctgggctctgctgctcctcaccctcctcactcagggcacagggtcctgggcccagtctgccctgactcaggctgcctccgtgtctgggtctctaggacagtcgaatcaccatctcctgcactggaaccagcagtgacgttgggggttatgactatgtctctggtaccagcaatatccaaggcacagcccccaaaatcaatcaatttangaaggtcaagtaatcggcctctaaggggttctaaancgcttctctggctccaaagtcctggacaacgacggcctcccctgacctatcttctcgggcttccaggctgaggacgaaggctgattacttactncagctcatttgctaatcagtgaggcttagtgtcttacgggaatgggaaccaaggtcaagttccgccttaggctagcccaaaccgg

SEQ ID NO: 233839 - DNA, 576 bp, Homo sapiens
  misc_feature: GYAE6OF02GFV6M.39.86.H09.1.454.CMB.1.raw
tcagtcgcactagtcacgaccggtgctcgatttagtgctatagacttggggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggtatgactatgtctcctggtaccagcaatatccaggcacacgacccccaaactcactcatttatgagtcagtaactcggccctcgtagggtttactaatcgcttctctggctcaagtctggcaacgacggccctcctgacctactctcgtcggcctccgaggcgtagacgggacgaggcgtgtaattattacgtcgcgacgtctacttagtttacgactaacgttcaagtggtaagtctttagtcgttacgttacgggtaaggtcggaaccgtaaggtaccgtacgttaccggttaccgtaacgggttaccaccggtaccccgaacggtaacccccg

SEQ ID NO: 233840 - DNA, 719 bp, Homo sapiens
  misc_feature: GYAE6OF02JZNQ6.39.86.H09.1.454.CMB.1.raw
  modified_base (360)..(360): a, c, t, g, unknown or other
  misc_feature (360)..(360): n is a, c, g, or t
tcagtcgcactagtcacgaccggtgctcgatttagtgctatagacttgggggggggtcgtcgaggaggcagcgctctcaggacatctccaccatggcctgggctctgctgctcctcaccctcctcactcagggcacagggtcctgggcccagtctgccctgactcaggctgcctcgtgtctgggtctcgtaggacagtcgatcaccatctcctgcactggaaccagcagtgacgttggggtatgactatgtctctggtacacgcaatatcgaggcaacgcgaccccaaactcactaccatttatggtacgtacgtaagtaaacgtccggaccctagtacgggtttactaacgttccggtntttccgtctacgggtcctacccgtaaggttccgttacgggacctaaaccgtccggaccctttccccgtacggaccctacgttcctaccggtcgggtacctaccgtacggtcttacggacgggtacgagggtccttagtacgtttaacttcctaaggtcccgtaggttcctacggtaccttttagacccgtaaagtttcccgtaaggttaggaacccggtttcctttaaggttccggtttaacgtttacggggaacggggttttaccgggaaaccgttaacgggttaccgtaaccgtttacccggttacccggtagggttttaacccgaccgggtttacccccaacgggtaacccccccg

SEQ ID NO: 233841 - DNA, 688 bp, Homo sapiens
  misc_feature: GYAE6OF02JTSL2.39.86.H09.1.454.CMB.1.raw
  modified_base (318)..(318): a, c, t, g, unknown or other
  misc_feature (318)..(318): n is a, c, g, or t
tcagtcgcactagtcacgaccggtgctcgatttagtgctatagacttggttgggggtcgttcgtaggaggcgagcggctctcaggacatctccaccatggcctggcgtctgctgctcctcaccctcctcactcaggcacaggtcctggcccagtctgccctgactcaggctgcctccgtgtctgggtctctaggacagtcgatcaccatctcctgtcactggaccagcagtgacgttgggggttatgtatatgtctccgttggtaccagtcaatatccgagtcacgaccgaccccctaaactccgaactactatttanacggtaggtcaagttaacgtccggacccttacgtaacggggtttctaaacgttcggttccttaccgtcgtttcgggtaccctccgtaaaggttccgtaggggtaccctaaacgacccgggtccctaacccggtcgaaccctacttcgtccgtcgggtcctccgtaacgggtccttacggaaccggacggtaacggtccttaggtaactttaacgttacgtcgtaccgtacggtcctacttacgtttagccttaaagttccgaaagttcgaagtccgtttagtcggtttaccgttaacgggtaggtaaccgggtacccgtaaaggttctaacgtttcggtcccgttaagggtcaccggacccggtaaccgg

SEQ ID NO: 233842 - DNA, 500 bp, Homo sapiens
  misc_feature: GYAE6OF02F19B8.39.86.H09.1.454.CMB.1.raw
  modified_base (303)..(303): a, c, t, g, unknown or other
  misc_feature (303)..(303): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaaactcatcattttangaggtcagtaatcggccctcaggggtttctaatcgcttctctggctcaagtctggcaacacggcctccctgacccatctctcgggctccaggctggaggacgaggctgattattactgcagctcatttgcaatcagtgaggctttatgtcttgggaagtcgggtaaccaaggtcatcgtcctaggcacgcccaacgg

SEQ ID NO: 233843 - DNA, 251 bp, Homo sapiens; identical to SEQ ID NO: 233265
  misc_feature: GYAE6OF02FGIAE.39.86.H09.1.454.CMB.1.raw
  modified_base (246)..(251): a, c, t, g, unknown or other
  misc_feature (246)..(251): n is a, c, g, or t

SEQ ID NO: 233844 - DNA, 563 bp, Homo sapiens
  misc_feature: GYAE6OF02F9HYL.39.86.H09.1.454.CMB.1.raw
  modified_base (305)..(305): a, c, t, g, unknown or other
  misc_feature (305)..(305): n is a, c, g, or t
  modified_base (402)..(402): a, c, t, g, unknown or other
  misc_feature (402)..(402): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttangagtcagtaatcggccctcgaggggtttctaagtcgcttctctggctccaagtctggcaacgacgcctccctgaccatctctgggcctcgacgtcgnggacggacggacgcgtagttattacttcgtcgacgtagtctacttagttacaacttacgtacgtagtagacgttacttagttcggttacggtaacggtaacggtacgggaacgtacggtactacgttccgttacgtacgtaccgaccgtacccgaacccgg

SEQ ID NO: 233845 - DNA, 249 bp, Homo sapiens
  misc_feature: GYAE6OF02INXS3.39.86.H09.1.454.CMB.1.raw
  modified_base (195)..(195): a, c, t, g, unknown or other
  misc_feature (195)..(195): n is a, c, g, or t
  modified_base (246)..(249): a, c, t, g, unknown or other
  misc_feature (246)..(249): n is a, c, g, or t
tcagtcgcactagtcacgaccggtgctcgatttagtgctatagacttgggtttgggggtttggtggtcgtccactcccgccttgacgaggctgattattactgcagctcatttgcaatcagtgaggcttatgtcttcggaagtgggaccaaggtcatcgtcctaggtcagcccaaggccaacccatgtccattcngttcccgcctcctcaactagtgcgactgagcgggtctggcaaggcgcatgnnnn

SEQ ID NO: 233846 - DNA, 532 bp, Homo sapiens
  misc_feature: GYAE6OF02JFGQ6.39.86.H09.1.454.CMB.1.raw
  modified_base (306)..(306): a, c, t, g, unknown or other
  misc_feature (306)..(306): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggcagtcgatcaccatctcctgcactggaaccagcagtgacgttgggggttatgactatgtctcctggtaccagcaatatccaggcacacgcccccaaactccatcatttangaggtcagtaatcggccctcgaggggtttctaagtcgcttctctggctccaagtctggacaacgacgcctccctgaccatctcgtcgggctccgaggctcgaggacgaggctgattattactgcagctctatttcgactaatcagtgacgtcttagtcgttcgttcggacggtagggtacctaaggtccacgttcgttaccgtaggttccacggtaccccgaacgg

SEQ ID NO: 233847 - DNA, 498 bp, Homo sapiens
  misc_feature: GYAE6OF02HZKKO.39.86.H09.1.454.CMB.1.raw
  modified_base (411)..(411): a, c, t, g, unknown or other
  misc_feature (411)..(411): n is a, c, g, or t
tcagtcgcactagtcacgaccggtgctcgatttagtgctatagacttgggtttggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttatgagtcagtaatcggcctcgagggtttctaatcgcttctctgctcaagtctgcacacggcctcctgaccatctctgggctccgaggctgagacgaggctgattatacngcagctcatttgacaattcagtgagtcttatggtcttcgggaagttgggaacctaaggtctagtcgtcctaggtcacggcccaacgg

SEQ ID NO: 233848 - DNA, 631 bp, Homo sapiens
  misc_feature: GYAE6OF02IRMPI.39.86.H09.1.454.CMB.1.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (301)..(301): a, c, t, g, unknown or other
  misc_feature (301)..(301): n is a, c, g, or t
tcagtcgcactagtcacgaccggtgctcgatttagtgctatagacttggggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacggttggggttangactatgtctctggtaccagcaatactcaggcacacgaccccaaatcactcatttangaggtcagtaactccggtcctacgtacgggtttacaacgttcgtctttctcgtcgtcctacctaaggttctacggacctaaaccgccggtcccttcccgtacggacctacgttcctccggtcgggtccttaccggacggtccgtaggaacggacgacggtcgtagttaatttaacgttacgtcgtaccgtaacgtcttaccttagtttcgactaacgttcgtaacggtgtaacgtctttaacgtcgttacggttacggaaggtacgggtaaccgtaaggttactaacgttccgttacgtacggttacgacgtacccgaacgtaacccccg

SEQ ID NO: 233849 - DNA, 532 bp, Homo sapiens
  misc_feature: GYAE6OF02IUB80.39.86.H09.1.454.CMB.1.raw
  modified_base (301)..(301): a, c, t, g, unknown or other
  misc_feature (301)..(301): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaatcatcatttangaggtcagtatcggccctgagggtttctaatcgtcttctctggctcaagtctggcaacgaccgcctccctgacctactctcgtgggctccgagctgacggtacgaggtctgtattactacgtgacagtcttacgtatttgactaatcgagtgacgtcttagtcgttcgttgggaagttcgggaacctaaggtctagttccggtaccgttaggtcacgtaccccgtaaccgg

SEQ ID NO: 233850 - DNA, 442 bp, Homo sapiens
  misc_feature: GYAE6OF02GEE11.39.86.H09.1.454.CMB.1.raw
  modified_base (359)..(359): a, c, t, g, unknown or other
  misc_feature (359)..(359): n is a, c, g, or t
  modified_base (419)..(419): a, c, t, g, unknown or other
  misc_feature (419)..(419): n is a, c, g, or t
  modified_base (425)..(442): a, c, t, g, unknown or other
  misc_feature (425)..(442): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacagcccccaaactcatcatttatgaggtcagtaatcggccctcaggggtttctaatcgcttctctggctccaagtctggcaacacggcctccctgaccatctctgggctccaggctgaggacgaggctgattattactgcagctcatttgcaatcagtgaggcttatgtcttcggaagtgggaccaaggtcatcgtcctatgtcagcccaaggcccaacccnctgtccactctcgtttccccgccctcctcactagtcgcgactgagcgggctggcaaggcncatagnnnnnnnnnnnnnnnnnn

SEQ ID NO: 233851 - DNA, 639 bp, Homo sapiens
  misc_feature: GYAE6OF02GT3WC.39.86.H09.1.454.CMB.1.raw
  modified_base (314)..(314): a, c, t, g, unknown or other
  misc_feature (314)..(314): n is a, c, g, or t
  modified_base (422)..(422): a, c, t, g, unknown or other
  misc_feature (422)..(422): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcaggtgacggttgggggttatggactatgtcctccgtaggtaccagacaatatccgaggcaacaccgacccccaaactcatctatttangagtacagtaacgtccggccctgtaggggtttactaagtccgtcttctcgtggtcctaccgtaagtccgtcggaccaaacggacccgtcccctacccgtcgaaccctnttccgtacgtcgggtcctacgacggtcgtagggaacggacggaggtaccttaggtaatttacgttacgtcggacctagtaccttactagtttacggacttaacgtcgtaaggtcgtacggtactttagtcgttacggttaacggtaacggttacgggtaaccgtaaggtcgtaacgttccggttaccgtaacggtacgtaccggacccgtaacccgg

SEQ ID NO: 233852 - DNA, 628 bp, Homo sapiens
  misc_feature: GYAE6OF02HCA3P.39.86.H09.1.454.CMB.1.raw
tcagtcgcactagtcacgaccggtgctcgatttagtgctatagacttgggttgggggtactcacggaggcagcgcctctcaggacatctccaccatggcctgggctctgctgctcctcaccctcctcactcagggcacagggtcctgggcccagtctgccctgactcaggctgcctccgtgtctgggtctctaggacgagtcgatcaccatctcctgcactggaaccagcagtgacgttggggttatgactatgtctctggtaccagcaatactccaggcacgacgacccccgaaagtcactctatttagtgtacggtacagtaatcggtccctacgtacggggtttactaagtccggtcttcgtcgtcggtctaccgtaagttccgtacggaccaaaccgtaccggccctacccgtacgaccctattccttcgtcgggtcctccgaggtccgtaggacggtaccggacggtactaggtatttacttacgtcgactaacggtccttcgtattgactaagttctaggtgtacgtactttagtcgttacgttacggaaggttacggggtaacctaggttaccgtaacgttccggttaccgtacgggtacctacggtaccccgtaaccggg

SEQ ID NO: 233853 - DNA, 249 bp, Homo sapiens; identical to SEQ ID NO: 233247
  misc_feature: GYAE6OF02F2S6M.39.86.H09.1.454.CMB.1.raw
  modified_base (246)..(249): a, c, t, g, unknown or other
  misc_feature (246)..(249): n is a, c, g, or t

SEQ ID NO: 233854 - DNA, 154 bp, Homo sapiens
  misc_feature: GYAE6OF02IJKEU.39.86.H09.1.454.CMB.1.raw
tcagtcgcactagtcacgaccggtgctcgatttagtgctatagacttgggtttgggggaagaggaagactgacggtcctgccacagcggccctgggctgcctggtcaaggactacttccactagtgcgactgagcgggctggcaaggcgcatag

SEQ ID NO: 233855 - DNA, 521 bp, Homo sapiens
  misc_feature: GYAE6OF02G3IOA.39.86.H09.1.454.CMB.1.raw
  modified_base (300)..(300): a, c, t, g, unknown or other
  misc_feature (300)..(300): n is a, c, g, or t
  modified_base (337)..(337): a, c, t, g, unknown or other
  misc_feature (337)..(337): n is a, c, g, or t
  modified_base (354)..(354): a, c, t, g, unknown or other
  misc_feature (354)..(354): n is a, c, g, or t
  modified_base (362)..(362): a, c, t, g, unknown or other
  misc_feature (362)..(362): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacacgcccccaaatcatcatttangagtcagtaatcggcctgagggtttcaatcgcttctntggctcaagtctgcacncgcctccngaccatctctggctccgaggctgaggacgtaggcttgtatttacttactggacagtactctagtttgactatccgtagtgtagtccttagtcggttacgttcggaaggttcgggacctaagggttcacgttcggttcctaggtacacggaccctaacgg

SEQ ID NO: 233856 - DNA, 251 bp, Homo sapiens; identical to SEQ ID NO: 233377
  misc_feature: GYAE6OF02I9N1N.39.86.H09.1.454.CMB.1.raw
  modified_base (246)..(251): a, c, t, g, unknown or other
  misc_feature (246)..(251): n is a, c, g, or t

SEQ ID NO: 233857 - DNA, 249 bp, Homo sapiens; identical to SEQ ID NO: 233247
  misc_feature: GYAE6OF02HO4LX.39.86.H09.1.454.CMB.1.raw
  modified_base (246)..(249): a, c, t, g, unknown or other
  misc_feature (246)..(249): n is a, c, g, or t

SEQ ID NO: 233858 - DNA, 557 bp, Homo sapiens
  misc_feature: GYAE6OF02GYF0M.39.86.H09.1.454.CMB.1.raw
  modified_base (371)..(371): a, c, t, g, unknown or other
  misc_feature (371)..(371): n is a, c, g, or t
  modified_base (423)..(423): a, c, t, g, unknown or other
  misc_feature (423)..(423): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatatccaggcacacgacccccaaactcatcatttatgaggtcagtaatcggccctgacggggtttctaagtcgtcttctctggctcaagtctgcaaccncggcctccctgaccctattcctcgtcgggcctccgaggtctaggacggacgnggtctgtatttacttactgctacgtctctactttgactaatccgaggtagacggtcttagttcgttcgtttacgggaggttacgggaaccgtaggtcacgttccgttaccgtaggtccgacgtaccctaaccgg

SEQ ID NO: 233859 - DNA, 509 bp, Homo sapiens
  misc_feature: GYAE6OF02FIV8C.39.86.H09.1.454.CMB.1.raw
  modified_base (300)..(300): a, c, t, g, unknown or other
  misc_feature (300)..(300): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaatcatcatttangaggtcagtaatccggcctcgaggggtttctaatcgcttctctggctccaagtctggcaacacggcctccctgaccatctctgggctccgaggctggaggacgaggctgattattactgcagtctcatttgctaatcagtgagtcttatcgtcgttacggaaggttcgggacctaaggtcagtccgtaccgtaggtcacgccctaacgg

SEQ ID NO: 233860 - DNA, 578 bp, Homo sapiens
  misc_feature: GYAE6OF02JFKHV.39.86.H09.1.454.CMB.1.raw
  modified_base (372)..(372): a, c, t, g, unknown or other
  misc_feature (372)..(372): n is a, c, g, or t
  modified_base (441)..(441): a, c, t, g, unknown or other
  misc_feature (441)..(441): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctccgtggtaccagcaatactccaggcacgacgcccccaaactcatctattatgaggtcagtaatccggcctcgtaggggtttctaatcgcttctctggctccaagtctggacacncggcctcctgaccatcctcgtggctccgaggctggaggacgaggtctagtattattactgcagtcctanacttacgtactagaagttactaagtcggttactccgtacgtacggtccgtttacgggttccgggaccgggttaacgggtaaccgtaacggtttaccggtacccggttaccggaacggttaccgaccggtaaccccgg

SEQ ID NO: 233861 - DNA, 535 bp, Homo sapiens
  misc_feature: GYAE6OF02G9QSV.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaatcatcatttatgagtcagtaatcggcctgagggtttctaatcgtacttctctggctccaagtctggcaacacgccctcctgaccatctcgtgggcctaccgaggctggacggacgaggtctagattattactgctagcctacgtatttgactaatcgagtgaggtcttagtcgttacgttacggaaggttcgggaacctaaggtctacgttccgtaccttaggtccacgacccgtaaccgg

SEQ ID NO: 233862 - DNA, 666 bp, Homo sapiens
  misc_feature: GYAE6OF02GD0EP.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacaggtcctgggcccagtctgccctgactcaggctgcctccgtgtctgggtctctaggacagtcgatcaccatctcctgcacgtcggaaccagcaggtcgtacggtttgggggttatcggtactagtgtcctcgtcggtaccagcaatctccgagccaaccaccgaccccctaaatcattcatttagtggacgtctaacgtacgtccggtacctcggttagggtttctatccgtcttacgtcgtcgtctacagtcgtacggccacgccgtccctaccgtcgacctacgtccgtcgtcggacctccgaggtccggtaggtacggacggttagtccgttagtaccgttttaacgtcgtcgtaccttacggttcctacgttactttacgaccgttaaacgttcggtaggtacggtacgtttcgttacgttaccggtttacgggtacgggtaaccggttcggggtaaacccgtaggtttaccctcggttacccggtaccgttaccgggacccgttacccggaccccggtaaccccgg

SEQ ID NO: 233863 - DNA, 250 bp, Homo sapiens; identical to SEQ ID NO: 233806
  misc_feature: GYAE6OF02GB6WS.39.86.H09.1.454.CMB.1.raw
  modified_base (247)..(250): a, c, t, g, unknown or other
  misc_feature (247)..(250): n is a, c, g, or t

SEQ ID NO: 233864 - DNA, 248 bp, Homo sapiens; identical to SEQ ID NO: 233734
  misc_feature: GYAE6OF02H3ZJZ.39.86.H09.1.454.CMB.1.raw
  modified_base (245)..(248): a, c, t, g, unknown or other
  misc_feature (245)..(248): n is a, c, g, or t

SEQ ID NO: 233865 - DNA, 576 bp, Homo sapiens
  misc_feature: GYAE6OF02FNWOC.39.86.H09.1.454.CMB.1.raw
  modified_base (325)..(325): a, c, t, g, unknown or other
  misc_feature (325)..(325): n is a, c, g, or t
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatcccaggcacagcccccaaactcatcatttatgaggtcagtaatcggccctnaggggtttctaatcgcttctctggctcaagtctgcaacgacgcctccctgaccatctcgtgggcctccgagggctcggagggacgaggctgaatttacgttacgtgcaacgtcctactagtttcgactaattcgaggttcgagggtactttatcggttaccgtttacggggtaaagttcgggggaaaccctaagggttcctaacgttccggttacccgtacgggttaccgaccggtaccccgaaacccggg

SEQ ID NO: 233866 - DNA, 682 bp, Homo sapiens
  misc_feature: GYAE6OF02JCM0X.39.86.H09.1.454.CMB.1.raw
tcagtcgcactagtcacgaccggtgctcgatttagtgctatagacttggggttgggggtctcaggaggcagcgctctcaggacatctccaccatggcctgggctctgctgctcctcaccctcctcactcgagggcacgagggtcctgggcccagtctgccctgactcaggctgcctccgtgtcgtggtctctaggacagtcgatcacatctcctgcactacggaaccagcagtgacggttggggttatgactatgtctccgtggtaccagacaatatccaggcacaccgacccccaactcatcctattatagacgtacagtaacgtccggtacctcggtaggggtttctaacgtccgtacttctcgtggtcctaccgtaagtccgtacggaccaaaccgtacccggtccccttacccgtacgaaccctacttccgttaccggtcgggtcctaccgacggtcgttacggacggtacggacggtacgtagttatttacgttacgtgtacgtacgttaccttacgttacgtttacggaccgttaattaccggtaggttacggaacgggtttccttaggtttccgttaccggtttacggggtaacggttacggggaaccgttaacgggttctaccggtttaccgttaccggttacggtacccgacccggtaccccgtaaaccccgg

SEQ ID NO: 233867 - DNA, 714 bp, Homo sapiens
  misc_feature: GYAE6OF02JCW1R.39.86.H09.1.454.CMB.1.raw
  modified_base (184)..(184): a, c, t, g, unknown or other
  misc_feature (184)..(184): n is a, c, g, or t
  modified_base (281)..(281): a, c, t, g, unknown or other
  misc_feature (281)..(281): n is a, c, g, or t
  modified_base (312)..(312): a, c, t, g, unknown or other
  misc_feature (312)..(312): n is a, c, g, or t
tcagtcgcactagtcacgaccggtgctcgatttagtgctatagacttgggttgggggtctcaggaggcagcgctctcaggactatctcctaccatggcctgggctctgctgctcctcaccctcctcactcagggcacagggtcctgggcccagttctgccctgactcaggctgcctccgtgtcngggtctctaggacagtcgatcgaccgattcctcctgccacgtcggaaccagcagtcgacggttggggtatgactatgtctcctggtaccagcaatcnccaggtcacgacgccccaatcatcatttagngaggtcagtaactcggcctgtagggtttctaagtcgtcttctcgtggctaccgaagtctacggactaaccgaccgggtccctacccgtcgaaccctacttacgttccggtcgggcccttcccggaacggtaccgttacggaaacgggaccggtacgggtaccgttaggtaactttacgtttaaccgcggtaccgtaacggtcccttacgttacgttttacgaacgttaacgttaccgaacgggttcgtaaccgggttcctttaacgttcggtttacccggtttaacgggggtaacgggttaaccggggtaaacccgttaacgggttacccgtaaccggtttacccgggttacccgttaaaccggggtacccctaacccgggtacccccgtaaaaccccgggg

SEQ ID NO: 233868 - DNA, 586 bp, Homo sapiens
  misc_feature: GYAE6OF02JLEFN.39.86.H09.1.454.CMB.1.raw
  modified_base (271)..(271): a, c, t, g, unknown or other
  misc_feature (271)..(271): n is a, c, g, or t
  modified_base (303)..(303): a, c, t, g, unknown or other
  misc_feature (303)..(303): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatntccaggcacacgacccccaaatcatcatttangagtcagtaactccggcctgtagggttactatcgtcttctctggctacaagtctaggaccaacgccggtcccttccgtacgacctaactcgtaccgtcgggcctaccgagggtcctacggacggacggagtcgtagtaattacttacgtggactacgtccttacgtaatttcggactaatcggtagtacggacggttcttagtcgttcggttacggaaggttcgggtaaccgtacggttactacgtccggttaccgtaggtacctaccggacccgtaacccgg

SEQ ID NO: 233869 - DNA, 603 bp, Homo sapiens
  misc_feature: GYAE6OF02HB0LH.39.86.H09.1.454.CMB.1.raw
  modified_base (436)..(436): a, c, t, g, unknown or other
  misc_feature (436)..(436): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatggactatgtctcctggtaccagcaatatccaggcacacgacccccaaactcatcatttatgaggtcagtaactcggaccctgtaggggtttctaagtcgtcttctcgtggctcaagtctggcaacacggcctcctgaccatctcgtcgggctccgaggctggaggacgacggcctagtattattacncgtacagtccgttactagttttcgacttaagtcgtaaggttcgaacgggttcctttaaggtcgtttaccggttaacgggtaacgggtttaccgggaaccgttaacggttccgtaaccgtttcccggttaccgttaacgggtacctaccggaaccccgtaaacccggg

SEQ ID NO: 233870 - DNA, 593 bp, Homo sapiens
  misc_feature: GYAE6OF02GWLMT.39.86.H09.1.454.CMB.1.raw
  modified_base (224)..(224): a, c, t, g, unknown or other
  misc_feature (224)..(224): n is a, c, g, or t
  modified_base (303)..(303): a, c, t, g, unknown or other
  misc_feature (303)..(303): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacgttgggggtatgactatgtctcctggtaccagcaatatccaggcacacgacccccaaactcatctatttangagtcagtaatccggcctcgtaggggtttactaacgtcgtcttctcttggcctaccgaagttcgtaggaccaacgaccggtcccttcccgtcgaacctatccgtcgtcgggcctcgaggtctaggacggacgtacggtcgtagtaattacttacgtcgacgtacgtcttacgttatttcgactaattccgaggttgagttctttagttcggttacgttacgggtaaggttacggggtaacctaaggtcacgttccggtaccgttacgggtacaccggtacccgaacccgg

SEQ ID NO: 233871 - DNA, 539 bp, Homo sapiens
  misc_feature: GYAE6OF02GU0TS.39.86.H09.1.454.CMB.1.raw
  modified_base (306)..(306): a, c, t, g, unknown or other
  misc_feature (306)..(306): n is a, c, g, or t
  modified_base (442)..(442): a, c, t, g, unknown or other
  misc_feature (442)..(442): n is a, c, g, or t
  modified_base (446)..(446): a, c, t, g, unknown or other
  misc_feature (446)..(446): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttangagtcagtaactcggccctcgaggggtttctaatcgtcttctcgtggctccaagtctggacaacgaccggccctccctgacctatcctcgtcgggcctccgaggctggacggacgaggtctgatttactactgcancctntatttgactaatcgagttagagtcttatgtcgttacgggaagtcgggaacctaaggtctaacgttcggtacctaggtccacgcccgtaaccgg

SEQ ID NO: 233872 - DNA, 595 bp, Homo sapiens
  misc_feature: GYAE6OF02II2EC.39.86.H09.1.454.CMB.1.raw
  modified_base (300)..(300): a, c, t, g, unknown or other
  misc_feature (300)..(300): n is a, c, g, or t
  modified_base (482)..(482): a, c, t, g, unknown or other
  misc_feature (482)..(482): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatcaggcacacgcccccaaatcatcatttangaggtcagttaatccggccctgtagggtttctaagtcgtcttctctggtctaccgaagttccgtacggaccaaaccgtacccgggccccttaccccgtacggaccctaacttccgttcgtcgggggtccttacccgaagggtcttagggaacgggaccgagggtcctgttaatttacttacngtacacggtcttctagtttcgactaactcgagtgagtacttagtgttacgttacggaggtacgggtaacctacggtacgacgtccgttcgtaggtacaccggacccgaaccgg

SEQ ID NO: 233873 - DNA, 655 bp, Homo sapiens
  misc_feature: GYAE6OF02HT4T1.39.86.H09.1.454.CMB.1.raw
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatactccaggcacacgccccaaactcatcatttatgacggtcagtaatccgcctcgtaggggtttctaagtcgtcttctctcggctaccgaagtcctagggaccaaaccgtaccggtcccttaccccgtacgaacccctattacccgttccgtcggggtacccgttcccgaacgggtccgttagggaaccgggaaccgggtacgggtaccgttaggttaactttaacgtttaccgttcggacgtacgtaccttaccgtaagttttcgacgtaaacttccgagttggacggtactttacgttcgttaccggttacggtaacggtacgggtaaccgtaaggttcctacgttccggtaccgttacggtaccgacgacccgtaaacccgg

SEQ ID NO: 233874 - DNA, 542 bp, Homo sapiens
  misc_feature: GYAE6OF02G9RD6.39.86.H09.1.454.CMB.1.raw
  modified_base (274)..(274): a, c, t, g, unknown or other
  misc_feature (274)..(274): n is a, c, g, or t
  modified_base (383)..(383): a, c, t, g, unknown or other
  misc_feature (383)..(383): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatntccaggcacacgcccccaaatcatcatttatgaggtcagtaatccggccctgtaggggtttctaatcgtcttcctctcggttcaagtctgcaacacggcctcctgaccntctcgtggctccgagctgaggacgaggctgattactactgcagctctagttgactaatctaagtggacgtcttagttcgttcgtacgggaacgttgggaaccgaaggttccgaattccggtaccgttaaggtccgtaacgtacccgaacggtaaccccc

SEQ ID NO: 233875 - DNA, 601 bp, Homo sapiens
  misc_feature: GYAE6OF02IJ5BA.39.86.H09.1.454.CMB.1.raw
  modified_base (307)..(307): a, c, t, g, unknown or other
  misc_feature (307)..(307): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctcgtgtctgggtctctaggacagtcgatcaccatctcctgcactggaaccagcagtgacggttgggggttatgactatgtctcctggtacagctaatatcgaggcacacgacccccaatcatctatttacngagtcagtactcggcctcgtaggggtttctaatcgtcttctctgctaccgaagtcgtcgacaaccgaccggtccctcccgtacgaccctactccgttcgtacgggtcctacgtacggtcgtacggacggacggaggtaccttaggtaactttacgttacgtcgcgacgtccttacgtagttttacgacgtaaacgttcgaaggtgtaacgtctttagtcgttacgtttacgggaacggttgggaaccgtaggtactaccgttccgtcggttacgtacgaccgacccgaacccgg

SEQ ID NO: 233876 - DNA, 547 bp, Homo sapiens
  misc_feature: GYAE6OF02FNFQ2.39.86.H09.1.454.CMB.1.raw
  modified_base (311)..(311): a, c, t, g, unknown or other
  misc_feature (311)..(311): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagttgacgttgggggtatgactatgtctcctggtaccagcaatatccaggccaacacgacccccaaactccatctatttangagtcagtaactcggccctgacgggtttctaatcgcttctctggctccgaagtctggacaacaccggccctacccgtcgacctatcctcgtcgggctccgaggctggaggacgaggctgtacttatacgtgctagtcttactatttgactaatcgagtgagtctttagtgtaccgttacgggtaagtcgggtaacctaaggtctacgtcgttcctaggctacgacccgtaacccgg

SEQ ID NO: 233877 - DNA, 576 bp, Homo sapiens
  misc_feature: GYAE6OF02HINWS.39.86.H09.1.454.CMB.1.raw
  modified_base (308)..(308): a, c, t, g, unknown or other
  misc_feature (308)..(308): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggccacacgaccccccaaatcatcatttangaggtcagtaatccggccctcgtaggggtttctaatcgtcttctctgctccaagtctggacacgacggtcctcctcgaccatctctcgggctccgaggtctggaggacgaggctgtaattacttactgctagtcctcgtatttgctaagttcaaggttgtaacgtctttagttcgttaccggtttcgggtaacgttcggggtaacctaaagggttcctaacggttccggttacccgtaacgggtcctaccggaccccgtaaacccggg

SEQ ID NO: 233878 - DNA, 602 bp, Homo sapiens
  misc_feature: GYAE6OF02H2ZC4.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatactccaggcaccacgacccccaaactcatctatttatgtaggtcagtaactcgcctcgtaggggtttctaacgtcgtcttctcgtcggctactaagtctggacaacgaccggtccctccctgacctactctcgtcgggctccgaggtcgtggaacgggacgacggtctaggtactttaacgtacgtcgacgtacgtacttacgtacttttagacctaatcgtaggtacgtagtacctttagttcggtttcgttacgggtaacggtcgggtaaccgtaaggttcgtacggttccggttaccggttaacggtaccaccggtacccgtaaacccgg

SEQ ID NO: 233879 - DNA, 510 bp, Homo sapiens
  misc_feature: GYAE6OF02F8A30.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctctggtaccagcaatatccaggcacagcccccaaactcatcatttatgagtcagtaatcggccctcgagggtttctaatcgtcttctctggctccaagtctggcaacacgcctcctgaccatctctggctccaggctgaggacgagctgattatactgcagctcatttgactaatcagtgaggtctttagtcgtcgttcgggaagttcggggaacctaaggttcacgttcggtacctaggtccacgacccgaaccgg

SEQ ID NO: 233880 - DNA, 566 bp, Homo sapiens
  misc_feature: GYAE6OF02IUOU0.39.86.H09.1.454.CMB.1.raw
  modified_base (302)..(302): a, c, t, g, unknown or other
  misc_feature (302)..(302): n is a, c, g, or t
  modified_base (357)..(357): a, c, t, g, unknown or other
  misc_feature (357)..(357): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgacccccaaatcatcatttangagtcagtaatccggccctcgaggggtttctaatcgtcttctctggctcaagtcncggacaacgccgtcctccctgaccatctcgtgggcctcgaggctaggacggacgacggcttgtattacttacgtgcgagtccttatatttgactaagtccgtagtgacggttacttagttcggttacgttacggggtaagttacgggtaaccgtaacggttactacgttccggttaccgtacgggtacctaccggaccccgtaacccgg

SEQ ID NO: 233881 - DNA, 614 bp, Homo sapiens
  misc_feature: GYAE6OF02HC0XB.39.86.H09.1.454.CMB.1.raw
  modified_base (314)..(314): a, c, t, g, unknown or other
  misc_feature (314)..(314): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcgaccatctcctgcacgtggaaccagcagtgacggttgggggttatgtactatgtcctcctggtaccagacaatatccaggcacgcgacccccaatccagtcaatttangaggtcagtaactcggccctcgtacgggtttctaagtcgtcttctctgtacctctaagtcgtgaccaacgaccgccgtccctacgacctactcctcgtcgggcctaccgacggtctacggaaggaccggacggtcttacgaatttacttacgtacgacacgtcctacgttagttacgacgtaacgttcgtagtacggtaggtaacttacgttcggttacggttaacgggtaacggtacggtaaccgtaacggttcgtaacgttccggtaccgtaggtaccgtaccgacccgtaacccggg

SEQ ID NO: 233882 - DNA, 763 bp, Homo sapiens
  misc_feature: GYAE6OF02FYC5W.39.86.H09.1.454.CMB.1.raw
tcagtcgcactagtcacgaccggtgctcgatttagtgctatagacttggggtttgggggtctcaggaggcagcgctctcaggacatctccaccatggcctgggctctgctgctcctcaccctcctcactcagggcacagggtcctgggcccagtctggccctgactcaggctgcctccgtgtctgggtctctaggacagtcgatcgaccactcgtcctggccacgtcggaaccagccagtggacggtttgggggttatggacctatcggtccttcccgtggtaccacgtctaatactcccgaggaccaccgacggaccccccaaaactccgaacttcctaagttttacgtacggtacggttaccaaggttaacgtcccggggtaccccttaccggtaacgggggttttcctaacgtccgtctttccgtacgtcgggtctaccgaacggtccgtcgggtaccaaacgtacccgggtcccttcccgtgtaacccagttccctcggttacggggtcctcccgaggtccgtaggaacgggtaccgacgggtactagttaacgtttaacgttaccgtcggtacctagtcccttatacgttttcgaaccttaagttcaacggttacggtacgttcctttaggttcgtttaaccgggtttaaccggggaacggttaccggggtaaacccgttaaacggggtttacctaacggttttcccgggttacccggttaagggtaccccgtaacgggtacccccgtaaaccccggg

SEQ ID NO: 233883 - DNA, 277 bp, Homo sapiens
  misc_feature: GYAE6OF02HTGS9.39.86.H09.1.454.CMB.1.raw
  modified_base (249)..(277): a, c, t, g, unknown or other
  misc_feature (249)..(277): n is a, c, g, or t
tcagtcgcactagtcacgaccggtgctcgatttagtgctatagacttgggtttggggggtttggtggtctaccactcccgccttgacgaggctgattattactgcagctcatttgcaatcagtgaggcttatgtctttcggaagtgggaccaaggtcatcgtcctaggtcagcccaaggccaaccccactgtcactctgttcccaccctcctcactagtgcgactgagcgggctggcaaggcgcatagnnnnnnnnnnnnnnnnnnnnnnnnnnnnn

SEQ ID NO: 233884 - DNA, 648 bp, Homo sapiens
  misc_feature: GYAE6OF02GPCQI.39.86.H09.1.454.CMB.1.raw
  modified_base (306)..(306): a, c, t, g, unknown or other
  misc_feature (306)..(306): n is a, c, g, or t
tcagtcgcactagtcacgaccggtgctcgatttagtgctatagacttgggttgggggtcgtcgaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttaatgacgtatgtctctgtaccagcaatatcaggcacacgccccaaactcaactccaatttancgtaggtcagtaatcggcctcgtaggggtttcaagtcgtcttctcgtggtctacaacgtctacggacaacaccggtcctacccgtggaaccctactcgtcgtcgggtacctccgacggtctacggaagggccggaaggccttaggtaactttacgtttaacgtggacctaaggtcctcgtaacgttttggaactaaacttcggaaacgttgggtaacgtacctttagttaccgttacggtttaacggggtaaacggtttccgggggaaacccgttaaagggtcccgtaacgtttccggttaacccgtacggttaacggttaccgaaccccggttaaacccgg

SEQ ID NO: 233885 - DNA, 576 bp, Homo sapiens
  misc_feature: GYAE6OF02IZQ9J.39.86.H09.1.454.CMB.1.raw
  modified_base (228)..(228): a, c, t, g, unknown or other
  misc_feature (228)..(228): n is a, c, g, or t
  modified_base (268)..(268): a, c, t, g, unknown or other
  misc_feature (268)..(268): n is a, c, g, or t
tcagtcgcactagtcacgaccggtgctcgatttagtgctatagacttgggttgggggtcgtcaggaggcagcgctctcaggacgatctccaccatggcctggctctgctgcttcctcaccctcctcactcagggccacagggtcctgggcccagtctgccctgactcaggtctgcctccgtgtctgggtctctaggacagtcgatcaccatctcctgcactggaaccngccagtgacgttgggggtatgactatgtctcctggtaccngcaatatccaggcacacgccccaaatcatcatttatgaggtcagtaatcggccctcgagggtttcaatccgtcttctctggctaccgtaagtctggccaaacgccggcctccctgaaccctatcgtcgtacgggcctccagggtctaggacggacgaggtcctagactttagtacctggaccagcttcgtaagttgacctaagttccaggttacgagggttcctttagttcggtacgtttcggaacgtacggggtaaccaagggttccagttcccgtacgtagggtaccgtacggaccccgtaaacgg

SEQ ID NO: 233886 - DNA, 721 bp, Homo sapiens
  misc_feature: GYAE6OF02IKXFO.39.86.H09.1.454.CMB.1.raw
  modified_base (307)..(307): a, c, t, g, unknown or other
  misc_feature (307)..(307): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatactccaggcacacgacccccaaactcatctatttangagtcagtaactcggccctgtacggggtttactaacgtcgtcttctcgtcgtctaccgaacgtcgtacggaccaacgtacccgggtcccttcccgtacgaaccctacgttccttcggttcgggtacccttaccggaacgggtccgttacgggaacgggaccggtaacgggtcttacgggtaacttttaaacgttaccgtcggtaccgtacggtacccttaccgttacgttttacgacgttaaaccgttcgtaaggttaacgggttaagggttaccgttttaacgttccgggtttacgtttaaccgggggtaaacggttaacgggggtaaaccccgtaaagggtttacccgttaacggttcccggtttaaccggtaacgggtttacccgacccggtaaccccggtaaaccccggg

SEQ ID NO: 233887 - DNA, 590 bp, Homo sapiens
  misc_feature: GYAE6OF02II8W4.39.86.H09.1.454.CMB.1.raw
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctccgtggtaccagcaatatccaggcacaccgacccccaaactcatctatttatgagtacagtaactcggcccttgtaggggtttctaacgtcgtcttctcgtggctactaagtctaggacaaccgtaccgggtccctaccctacgaaccctacttccgtcgtcgggtccttaccggacgggtccgtagggacgggtacggaacgggtctagttaagtttacttaacgcgtacgacgtctactatttcgactaagtcaggtgtagtactttagtcgttgtaacggtaggtcggaacctaggtcacgtcgtacgtaggacacggaccaaccgg

SEQ ID NO: 233888 - DNA, 678 bp, Homo sapiens
  misc_feature: GYAE6OF02IGGVJ.39.86.H09.1.454.CMB.1.raw
  modified_base (320)..(320): a, c, t, g, unknown or other
  misc_feature (320)..(320): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcacgtggaaccagcaggtgtacggttgggggttatgactatcgtctccgtggtaccagacaatactccgaggacaccgaccgacccccaaactcactctatttagngtagtcaagtactccggcctcgtagggtttctacgtcgtcttcctcgtcggccttacgtaagtcctacggaccaaccgtacccggtccccttacccgtcgaaccctacgttaccgtcgtcgggtcccttccgagggtccgtagggacggaccggtacggtcgttagtaatttaacgttcgtacggcgtagtccttacgttagtttcgaacctaagttacgaacggttcgtaacggttactttacgttcggtttaccggttacgggtaacgggttaccggggtaaccctaagggttacccgtacggttacccggtttaccggtaccgggtacccgtacccggtaccccgtaaccccggg

SEQ ID NO: 233889 - DNA, 563 bp, Homo sapiens
  misc_feature: GYAE6OF02IOPIZ.39.86.H09.1.454.CMB.1.raw
  modified_base (305)..(305): a, c, t, g, unknown or other
  misc_feature (305)..(305): n is a, c, g, or t
  modified_base (450)..(450): a, c, t, g, unknown or other
  misc_feature (450)..(450): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatgactatgtctcctggtacagcaatatccaggccacacgacccccaaactcatactatttangagtacagtaactcggcctcgtagggtttctaagtcgtcttctctggctaccgtaagtctacggacaacctacccgggcctcccgtcgacccgtactccgtcgtcggccttccgaggctaggacggacgaggctgtacttattcngcgtactctctagtttgactaacttcagtgagtctttatcggttcgttacgggtaagtcgggtaaccgtaaggttcagttccgtaccgttacggtaccaccgaccgaaccccg

SEQ ID NO: 233890 - DNA, 648 bp, Homo sapiens
  misc_feature: GYAE6OF02IR8ML.39.86.H09.1.454.CMB.1.raw
  modified_base (258)..(258): a, c, t, g, unknown or other
  misc_feature (258)..(258): n is a, c, g, or t
  modified_base (308)..(308): a, c, t, g, unknown or other
  misc_feature (308)..(308): n is a, c, g, or t
  modified_base (495)..(495): a, c, t, g, unknown or other
  misc_feature (495)..(495): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctcgtaggacagtcgatcaccatctcctgcactggaaccagcagtggtacggttggggtatgactagtntctcgtggtaccagcaatatccaggcacacgaccccaaatcatctattancgagtcaagtaacgtccgtacctcgtagggtttactaacgtcgtcttcgtcgtcggtactaccgtaacgtcgtacgtaccgaaaccgtccgtcccgttccgtacgtaaccctacttcgttaccgtcgggtcccttacgacggtaccgtaggaacggcggacgtctacgtaattacgttacgcgtacncgttctacgtagtttcgactacgtacgtaagtcggtacgttacgtagttaccgttacggtaaccgggttaacggtacgggtaaccggtaacggttccgtaacggttcggttaccccgttaacgggtactaccccggtaaccgtaaacccccgg

SEQ ID NO: 233891 - DNA, 687 bp, Homo sapiens
  misc_feature: GYAE6OF02F4AZP.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggtatgactatgtctcctggtacagcaatatccaggcacgacgcccccaaatcgatctatttatgaggtcagtaagtccggcctcgtaggggtttctaagtcgtcttactcgtcggccttacgaagtcgtacggacaacgtaccggtcctcccgtcgacccagttcctcgtcgggcctcccgaggtcctacggacgggtaccggaacggtcttacggtaagtttaactttacgtacgtacgtacgtcctacgtagttttcggaaccttaagttaccgtacggttaacggtaacgggttaccttttacgttacgggttaccgttttaaccgggggtaacggttaccgggggtaaaacccgttaacggggttaccgttaaacggtttcccggtttaacccggttacgggttacccggtaacccgggtaccccggtaaaaccccgggg

SEQ ID NO: 233892 - DNA, 587 bp, Homo sapiens
  misc_feature: GYAE6OF02FJZNH.39.86.H09.1.454.CMB.1.raw
  modified_base (304)..(304): a, c, t, g, unknown or other
  misc_feature (304)..(304): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctccgtggtaccagcaatactccagcacacgcccccaaactcatcatttangaggtcagtaactccggccctgtaggggtttctaagtcgcttctcgtggctccaagtctggcaacgcggccctcccgtgacctatccgtcgtgggcctccgaggtctaggacgggacgtaaggccttaggaactttacttaccgtgactacgccttacgtagttttcgacctaaagtccaaggtgacggtctttagtcggttacgttacgggaaggtcgggaaccctaaggttccaacgttcccggtaccgtagggttacccacggtacccccgtaaaccggg

SEQ ID NO: 233893 - DNA, 715 bp, Homo sapiens
  misc_feature: GYAE6OF02HD7CP.39.86.H09.1.454.CMB.1.raw
  modified_base (228)..(228): a, c, t, g, unknown or other
  misc_feature (228)..(228): n is a, c, g, or t
  modified_base (274)..(274): a, c, t, g, unknown or other
  misc_feature (274)..(274): n is a, c, g, or t
tcagtcgcactagtcacgaccggtgctcgatttagtgctatagacttgggttgggggtcgtcgagggaggcgagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacgttgggggttatgatatgtctcctggtaccagcaaatntccaggcacacgacccccaaactcatctatttatgagtcagtaatccggcctcgtaggggtttactaagtccgtcttactcgtcggcctaccgtaacgtctcggtaccaaccgacggtcccttccctacgaccctacttaccgttccgttcgggtcccttaccggacggtccgttacgggaacgggaaccggtagggtcccgttaggtaacttttaacgtttaaaccgtcggtaacccgtagtaccgtttactaacgtttttacggaacctttaacgttaccgtaaacgggttggtaaacgggttactttacggttcggtttaccggtttaacggggtaacggtttaccggggaaacccggtttaaacgggttaccgttacggttcccggtttaacccggttacgggttacccgtaccggtaccccgtaaaacccccgggg

SEQ ID NO: 233894 - DNA, 725 bp, Homo sapiens
  misc_feature: GYAE6OF02HBEEI.39.86.H09.1.454.CMB.1.raw
  modified_base (308)..(308): a, c, t, g, unknown or other
  misc_feature (308)..(308): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggtatgactatgtctcctggtaccagcaagtatccaggcacaccgacccccaaatcatcatttangagtcagtaatccggcctacgtaggggtttactaacgtccgtcttctactcggcctacgtaagtcgtacggacaaccgaccggtccctacccgtcgaccctatcccgttcgtacgggtccttacccgagggtaccgttagggaacgggtaacccggtacggggtaccctttaggtaaactttttaacgttaacccgttcgggaaccctaacggttaccttaacgttacgttttaccggaaccttaaacgttaccggttaaggttaacgggttacgttaaccgtttttacggttacggtttaccgggtttaaccggggtaagggttaaccgggaaacccgttaagggttaccttaaccggtttcccgttaccgggttaaccgggtaaccgtaccgggtaacccccgtaaaccccgggg

SEQ ID NO: 233895 - DNA, 581 bp, Homo sapiens
  misc_feature: GYAE6OF02JLQ68.39.86.H09.1.454.CMB.1.raw
  modified_base (269)..(269): a, c, t, g, unknown or other
  misc_feature (269)..(269): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggtatgactatgtctcctggtaccagcaatntccaggcacacgcccccaaactcatctatttatgacggtcaagtaactccggccctgtacggggtttactaacgtcgtaccttctctcggctacctaagttcctcggaccaactaccgggtccctcccgtgaccctatccgttcgtcgggactccgaggctacggaggtaccgaggtccttagactttacgttacgtgactagtccttctagtttcgactacttcgagttcggagttccttagtcgttacgttacgggtaagtcgggaacctaaggtctacgtcggttcctaggtcacggacccgtaaccgg

SEQ ID NO: 233896 - DNA, 464 bp, Homo sapiens
  misc_feature: GYAE6OF02HY256.39.86.H09.1.454.CMB.1.raw
  modified_base (362)..(362): a, c, t, g, unknown or other
  misc_feature (362)..(362): n is a, c, g, or t
  modified_base (437)..(464): a, c, t, g, unknown or other
  misc_feature (437)..(464): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacagcccccaaactcatcatttatgaggtcagtaatcggccctcaggggtttctaatcgcttctctggctccaagtctggcaacacggcctccctgaccatctctgggctccaggctgaggacgaggctgattatactgcagctcatttgacaatcagtgaggtcttatgtcttcggaagtgggacaaggtcatcgtcctaggtcagaccctaaggcccaaacccncttgtcactcctgttccccaacccttctcacttagtcgccgactgagcgggtctgggacaaggcgacaagtacgnnnnnnnnnnnnnnnnnnnnnnnnnnnn

SEQ ID NO: 233897 - DNA, 615 bp, Homo sapiens
  misc_feature: GYAE6OF02HKTR0.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtggacggttgggggttatgactatgtctccgtggtaccagacaatatccaggcaccaccgacccccaaactcatctatttatgaggtcaagtaacgtccggccctagtaggggtttactaacgtcgtcttctcgtcggtctaccgtaagtctcggaccaaccgaccggtccctcccgtcgaaccctatccgtccgtcgggtcctccggtacggcgttacgggacggacggtacggtcgttacgtaattacgttacgtcgacgacgttactcgtaacgtttcgaactatacgtagtcgagttctttagtacgtttcggttacgggaacggttcgggaaccgtacggtactcgttaccgtccggttaggtaccacgacccgtaacccgg

SEQ ID NO: 233898 - DNA, 593 bp, Homo sapiens
  misc_feature: GYAE6OF02G0DTZ.39.86.H09.1.454.CMB.1.raw
  modified_base (304)..(304): a, c, t, g, unknown or other
  misc_feature (304)..(304): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatatccaggcacacgcccccaaactcatcatttangagtcagtaatcggcctgtaggggtttctaatcgcttctcgtgctccaagtctggacaaccgaccggccctccctgaccctatcctcgtcgggcctccgaggtcctaggacgggacgaggctagtattacttacgtgactagtcctactagttttcgactaaacttcgaaggttcggaggttctttagttcggttaccggtttcggggtaaacggttcggggaaacccgttaagggtctaacgttccggttacccgtaagggttcccaacggtaccccgtaaacccggg

SEQ ID NO: 233899 - DNA, 555 bp, Homo sapiens
  misc_feature: GYAE6OF02HHM30.39.86.H09.1.454.CMB.1.raw
  modified_base (306)..(306): a, c, t, g, unknown or other
  misc_feature (306)..(306): n is a, c, g, or t
  modified_base (366)..(366): a, c, t, g, unknown or other
  misc_feature (366)..(366): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggtatgactatgtctcctggtaccagcaatatccaggcacacgacccccaaatcatcatttangagtcagtaatccgcctcgtagggtttctaagtcgtcttctctggctacagtctgacacncgtccctcctacgacctactcgtcgtacgggtcctccgaggctaggaggacgaggcttagatttacgtactgactagtcttactatttcgactaatccgtagtgacgttcttagttgtccgttagggaggttacgggaaccgtagttcgtacgttccgtaccgttagggtcaccggtaccctaacccgg

SEQ ID NO: 233900 - DNA, 658 bp, Homo sapiens
  misc_feature: GYAE6OF02FHEGP.39.86.H09.1.454.CMB.1.raw
  modified_base (310)..(310): a, c, t, g, unknown or other
  misc_feature (310)..(310): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctccgtggtaccagacaatactccgaggccacaccgacccccaaactcatctatttanggaggtcaagtaacgtccggtcctcggttaggggtttactaagtccgtctttctcgtcggtcctaccgaagtcgtcggaccaaccgtaccggtcccttccctacgtacccattccgtcgtcgggtcctccgacggtcgtagggacgggacggaggtcgttagtactttaacttacgtgacgacgtccttactaacgtttcgaacttaacgttcgtacggttaggacgttactttagttacggtttccggtttaacgggtaagggttaccgggaaccgttaacgggttacctaacggttcccggttaacccggttacggtacccgtaccggtaccccggtaaaccccgg

SEQ ID NO: 233901 - DNA, 619 bp, Homo sapiens
  misc_feature: GYAE6OF02G4Z4J.39.86.H09.1.454.CMB.1.raw
  modified_base (223)..(223): a, c, t, g, unknown or other
  misc_feature (223)..(223): n is a, c, g, or t
  modified_base (259)..(259): a, c, t, g, unknown or other
  misc_feature (259)..(259): n is a, c, g, or t
  modified_base (296)..(296): a, c, t, g, unknown or other
  misc_feature (296)..(296): n is a, c, g, or t
tcagtcgcactagtcacgaccggtgctcgatttagtgctatagacttgggctggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacgttggggtatgactatgtctctggtacngcaatatccaggcacacgccccaaactcatcatttangagtcagtaactcggcctcgagggtttctaatcgtcttctcgtgtctctaagtctggacaacgaccggtcctcccgtagacctatccgtcgtgggcctccgacgtcgtaggaacgggacgagggccttagtaacttttagttaaccgtggtaccacgtccgttacgttaacgttttacggaccttaagttcctaagggttcggtaacgggttcttttaggtacggtttaccgtttaacggggtaacgggtacggggtaaccgtaagggtttaccgacggtttacccggttacccgtttaagggtaccctacggtaacccccgg

SEQ ID NO: 233902 - DNA, 668 bp, Homo sapiens
  misc_feature: GYAE6OF02HPW0B.39.86.H09.1.454.CMB.1.raw
  modified_base (319)..(319): a, c, t, g, unknown or other
  misc_feature (319)..(319): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctcgccctgactcaggctgcctccgtgtcgtgggtctctaggacagtcgatcaccatcctcctgcacgtgaaccagcagtgacggttgggggttatgactatgtcctccgtaggtaccagactaatactccgaggccaccaccgaccccctaaactcatctatttanggtacgtacaagtaacgtccggtccctacgtaggggtttactaacgtccgtcttcctcgtcggcctaccgtaagtcgtaggacctaaccgaccggtcccctacccgtacgaaccctacgttcctcggtcgggtccctaccggacggtccgtagggaacgggacggtacggtcgttagttaactttacgttacgtcgacgtacgtccttacgtaagtttcgaactaacttccgtaaggtacgtacggttctttagtcggtttaccggtaacgggtacggtaccgggtaaccgtaaggttacctacggttccgttaccggtaccggtaccgtaccggtaccccgaacccgg

SEQ ID NO: 233903 - DNA, 641 bp, Homo sapiens
  misc_feature: GYAE6OF02HLIA4.39.86.H09.1.454.CMB.1.raw
  modified_base (303)..(303): a, c, t, g, unknown or other
  misc_feature (303)..(303): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtggacggttgggggttatgactatgtctcctggtaccagcaatatccaggcacacgcccccaaatcatcatttangagtcagtaatcggccctgtaggggttctaacgtcgtcttctcgtgctcgtaagtcgtcgacaacgaccggtccctacctacgaccctacgtccttcgtcgggtccctaccgacgggtccgtagggacggaacggacggtcgtacgttaagtttaatttaccgcggtactacggtaccttacgttactttcgtaacctaaattcgaaggtaggtaacggttctttagttcggtttaccggtttaacgggtacgggttacggggtaaacccgttaagggttacgtaccgttaccggttacccggttaacggtacctaccgggaaccccgtaaccccggg

SEQ ID NO: 233904 - DNA, 505 bp, Homo sapiens
  misc_feature: GYAE6OF02FYU5A.39.86.H09.1.454.CMB.1.raw
  modified_base (306)..(306): a, c, t, g, unknown or other
  misc_feature (306)..(306): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgacccccaaatcatcatttangagtcagtatcggcctgagggtttctaatcgcttctctggctcagtctgcacacgcctcctgaccatctctgggcctccgaggctgacggacggagctgtaattatactgcagcttctatttgctaatcgtagtgagtcttatgtcgttgggaagtggaacctaggtctacgtcgtccgtaggtcacgacccgaaccgg

SEQ ID NO: 233905 - DNA, 568 bp, Homo sapiens
  misc_feature: GYAE6OF02IL0SR.39.86.H09.1.454.CMB.1.raw
  modified_base (304)..(304): a, c, t, g, unknown or other
  misc_feature (304)..(304): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggtatgactatgtctccgtggtaccagcaatactccaggcacacgacccccaaatcatctattangagtactaagtaactcggcctcgtagggtttctaagtcgtcttctcgtggtctacgaagtcgtcggacaaccgaccggtccctaccgtagaacctactccgtcgtcgggtcctaccgaggtctaggacggacgtaggctagtacttatactgacacgtctagtacttgactatcgagtagtagtcttagtgttccgttaagggaacgttcgggaacgtaaggtctacgttccggtaccgttaggtacctacgacccgtaaccgg

SEQ ID NO: 233906 - DNA, 248 bp, Homo sapiens
  misc_feature: GYAE6OF02FIBGG.39.86.H09.1.454.CMB.1.raw
  modified_base (246)..(248): a, c, t, g, unknown or other
  misc_feature (246)..(248): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcacctcgtcctaggtcagcccaaggccaaccccactgtcactctgttcccgccctcctcactagtgcgactgagcggctggcaggcgcatagnnn

SEQ ID NO: 233907 - DNA, 561 bp, Homo sapiens
  misc_feature: GYAE6OF02F1WGF.39.86.H09.1.454.CMB.1.raw
  modified_base (309)..(309): a, c, t, g, unknown or other
  misc_feature (309)..(309): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgtacgttgggggttatgactatgtctctggtaccagcaatatccaggccacacgacccccaaactcatcatttangaggtcagtaactcggcctcgtaggggtttactaatccgcttctctggcctccaagtctggacaacgccggccctccctagacctattactcgtcgggcctccgacggtctggaacggacgaggtctagtattactactgactagctatattacgactaatcaagtggacgttcttagtgttccgttcggaaggttcgggaaccttaaggcgtacgttccggtaccgtacggtactaccggacctaacccgg

SEQ ID NO: 233908 - DNA, 568 bp, Homo sapiens
  misc_feature: GYAE6OF02JK81V.39.86.H09.1.454.CMB.1.raw
  modified_base (262)..(262): a, c, t, g, unknown or other
  misc_feature (262)..(262): n is a, c, g, or t
  modified_base (297)..(297): a, c, t, g, unknown or other
  misc_feature (297)..(297): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggtatgactatgtctctggtaccngcaatctcaggcacacgccccaaatcatcatttangagtcagtatcggcctgagggttcaagtcgtcttctctgcctactagtcgtgactaacgccggtcctcccgtagaccctatctccgtcgggacctccgagggctcggaacggtacgacgggtcttaggtactttacttaacgcgtacgacgtccttacgtattttggacctaaagttcgaaagtggtacgttaccttagtcgtacgtttacgggaagttgggaaccctaaggtccaacgttccgtacgttaggccgtacgccctaaccggg

SEQ ID NO: 233909 - DNA, 537 bp, Homo sapiens
  misc_feature: GYAE6OF02GQHC3.39.86.H09.1.454.CMB.1.raw
  modified_base (301)..(301): a, c, t, g, unknown or other
  misc_feature (301)..(301): n is a, c, g, or t
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
tcagtcgcactagtcacgaccggtgctcgatttagtgctatagacttgggctggggtctcaggaggcagcgctctcaggacatctccaccatggcctgggctctgctgctcctcaccctcctcactcagggcacagggtcctgggcccagtctgccctgactcaggctgcctccgtgtctgggtctctaggcagtcgatcaccatctcctgcactggaaccagcagtgacggttgggggttatgactatgtctcctggtaccagcaatatccaggcacacgcccccaaactcatcatttangagtctagtaatccggccctcgtagggtttactaatcgtcttctctggctcagtcngcacgacgcctccgnaccntctcgtggcctcgaggctgacggcgaggctgtatttaatacctgcagtctcgttatttcgactaacgtctaggttcgaggtctttagtcggttccgttacggaaggttacgggaacctaggtactacgttccggtaccgttacggtaccacggtaaccccg

SEQ ID NO: 233910 - DNA, 523 bp, Homo sapiens
  misc_feature: GYAE6OF02F7ZBS.39.86.H09.1.454.CMB.1.raw
  modified_base (302)..(302): a, c, t, g, unknown or other
  misc_feature (302)..(302): n is a, c, g, or t
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
  modified_base (394)..(394): a, c, t, g, unknown or other
  misc_feature (394)..(394): n is a, c, g, or t
  modified_base (404)..(404): a, c, t, g, unknown or other
  misc_feature (404)..(404): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttangaggtcaagtatccggccctcgagggtttctaatcgtcttctctggctcaagtcnggcacgacgcctccngaccatctctggctcgacggtntggaggacgnggctgtaattattactgcagtctctatttcgactatcagtgtagtcttatcgttcgttacggaaggtcggaaccgtaaggtcctagttccggtaccgtaggtccacggtacccaaccgg

SEQ ID NO: 233911 - DNA, 490 bp, Homo sapiens
  misc_feature: GYAE6OF02JZWN7.39.86.H09.1.454.CMB.1.raw
  modified_base (220)..(220): a, c, t, g, unknown or other
  misc_feature (220)..(220): n is a, c, g, or t
  modified_base (226)..(226): a, c, t, g, unknown or other
  misc_feature (226)..(226): n is a, c, g, or t
  modified_base (235)..(235): a, c, t, g, unknown or other
  misc_feature (235)..(235): n is a, c, g, or t
  modified_base (278)..(278): a, c, t, g, unknown or other
  misc_feature (278)..(278): n is a, c, g, or t
  modified_base (369)..(369): a, c, t, g, unknown or other
  misc_feature (369)..(369): n is a, c, g, or t
  modified_base (408)..(408): a, c, t, g, unknown or other
  misc_feature (408)..(408): n is a, c, g, or t
  modified_base (452)..(452): a, c, t, g, unknown or other
  misc_feature (452)..(452): n is a, c, g, or t
  modified_base (456)..(456): a, c, t, g, unknown or other
  misc_feature (456)..(456): n is a, c, g, or t
  modified_base (460)..(461): a, c, t, g, unknown or other
  misc_feature (460)..(461): n is a, c, g, or t
  modified_base (463)..(466): a, c, t, g, unknown or other
  misc_feature (463)..(466): n is a, c, g, or t
  modified_base (469)..(469): a, c, t, g, unknown or other
  misc_feature (469)..(469): n is a, c, g, or t
  modified_base (472)..(490): a, c, t, g, unknown or other
  misc_feature (472)..(490): n is a, c, g, or t
tcagtcgcactagtcacgaccggtgctcgatttagtgctatagacttgggtttgggggcgttgtgcctggatattgctggaaccagcagtgacgttgggggttatgacgtatgtctcctggtaccagcaatatccaggcacacgccccccaaactccatcatttatgaggtcagtaatccggccctcgagggttttcaatcgcttctctggctcaagtcngcaacncggcctccngaccatctctgggcctccagctgaggcgagctgatttactacngcagctcatttcgacaatcagtgacgtcttagtgtcttcggaagtcggactagtcaattcgcgtaggtcacgacccgaaggccccaacccntcgacactccttcgtcccccgctctcacctcgcgccgtntcggacgtcggaccttggccgtaacggccgtactacgacgtcanccgngctnncnnnncgncgnnnnnnnnnnnnnnnnnnn

SEQ ID NO: 233912 - DNA, 660 bp, Homo sapiens
  misc_feature: GYAE6OF02JZ97V.39.86.H09.1.454.CMB.1.raw
tcagtcgcactagtcacgaccggtgctcgatttagtgctatagacttgggtttggggggggttcgtcgtagggaggcagcgctctcaggacatctccaccatggcctgggctctgctgctcctcaccctcctcacctcagggcacagggtcctgggcccagtctcgccctgactcaggctgcctccgtgtctggtctctaggacagtcgatcacctatctccgtgccacgtcggaaccagcaacgtggacgttgggggttatggacgttatggtcctccgttaggtaccctagactaatactccgaggccaccgacgaccccccaaactcactacctattttagcgtaacggtcaagttaactccgggtaccctaggttacggggtttacctaattccgtcttcttcggtcgtacctacgaagttcacgggtacaaccgtaccggtccctaccgtacgacctacttccgtcgtcgggacctccgacgggctcgggaacggcgtagtcgttagactttaatcgagtcagtaccttgtattacgactacgttacgaggtagtaccgtacttagttcggttttaccggaggttacggtacggtaaccggtaacgttcgtacgttaccggtacccgttaggacctaccggacccgtaaccccgg

SEQ ID NO: 233913 - DNA, 560 bp, Homo sapiens
  misc_feature: GYAE6OF02FKLLK.39.86.H09.1.454.CMB.1.raw
tcagtcgcactagtcacgaccggtgctcgatttagtgctatagacttgggtttggggggggtctcaggaggcagccgctctcaggacatctccaccatgggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccagcacacgcccccaaatcatcatttatgaggtcagtaatcggccctgtagggtttctaatcgcttctctcggctccgaagttctacgggcaaccgtaccggccctccctaggacccatcctcgtgggcctcccgaggtctggacggacgaggctgattattactgcagtctactatttcgactaatcgaggttgagtcctttagtcgttagtttcgggaagttcgggaaccttaagggtctaaggttccgtaccgttacggtcaccggaccccgtaaacgg

SEQ ID NO: 233914 - DNA, 564 bp, Homo sapiens
  misc_feature: GYAE6OF02F9Q48.39.86.H09.1.454.CMB.1.raw
  modified_base (308)..(308): a, c, t, g, unknown or other
  misc_feature (308)..(308): n is a, c, g, or t
  modified_base (370)..(370): a, c, t, g, unknown or other
  misc_feature (370)..(370): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatatccaggcacacgacccccaaactcatcatttangagtcagtactcggcctgtagggtttctaatcgcttctctgctcagtctgcacgcgcctccngaccatctcgtcggcctccgaggtctaggacggacggacgtcttagtactttaagttacctgaccaggtcttacgtagtttcgactatacgtaggttgacgttcttagtcggttaccgttacgggaacggttcgggaaccgttaaggttccacgttccggttaccgtaggtaccgaccggtacccgtaacccgg

SEQ ID NO: 233915 - DNA, 528 bp, Homo sapiens
  misc_feature: GYAE6OF02GSX56.39.86.H09.1.454.CMB.1.raw
  modified_base (304)..(304): a, c, t, g, unknown or other
  misc_feature (304)..(304): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaatcatcatttangagtcagtaatcggcctgaggggtttctaatcgcttctctgctcaagtctggcaacaccggcctcctgaccatcctctgggcctccgaggtctggacggacgaggctgtattattactgcagctcgtatttcgactaatctaggtgagtcttagtcgtcgttacgggaagttcgggaaccgtaaggtctacgttccgtaccgtaggtaccacgcccgtaaccgg

SEQ ID NO: 233916 - DNA, 559 bp, Homo sapiens
  misc_feature: GYAE6OF02IC4PV.39.86.H09.1.454.CMB.1.raw
  modified_base (273)..(273): a, c, t, g, unknown or other
  misc_feature (273)..(273): n is a, c, g, or t
  modified_base (306)..(306): a, c, t, g, unknown or other
  misc_feature (306)..(306): n is a, c, g, or t
  modified_base (368)..(368): a, c, t, g, unknown or other
  misc_feature (368)..(368): n is a, c, g, or t
  modified_base (434)..(434): a, c, t, g, unknown or other
  misc_feature (434)..(434): n is a, c, g, or t
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctctgcactggaaccagcagtgatggttggggttatgactatgtctcctggtaccagcaatntccaggccacacgaccccaaactcatcatttangaggtcagtaatccggtcctcgagggtttcaactcgtcttctcgtgctcaagtctgacaacncgtcctcctcgaccatcctcgtggcctccgaggctggacggacgagctagatttatactgactacncttctatttcgactaaatcgaagttggacgttctttagtcggttacgttacgggaacgggttcggtaacccgtaaggttcctaacgttcccggttacccgttacggtaccggacgtaacccccgg

SEQ ID NO: 233917 - DNA, 628 bp, Homo sapiens
  misc_feature: GYAE6OF02H3NLB.39.86.H09.1.454.CMB.1.raw
  modified_base (306)..(306): a, c, t, g, unknown or other
  misc_feature (306)..(306): n is a, c, g, or t
  modified_base (495)..(495): a, c, t, g, unknown or other
  misc_feature (495)..(495): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtcttcctggtaccagcaatatccaggcacacgacccccaaatcatcatttacngagtacagtaacgtcggtccctgtaggggtttctaagtctcttacgtcgttggctactaagtccgtaggccaaacgaccggtccttcccgtgaccctatccgttacgtccggtcctcgacgggtctacgggtacgggaccggaggtaccgttaggttactttaacgttacgtcgacgtaggaccctttnttagtttacgacgtaacgttcgtacgtacggtacgttacttagttcgttaccgggttcggtaaccggttacgggtaaccgtaacggtactacggttccggttaccggttacggaccgtaccgaacccgaaccg

SEQ ID NO: 233918 - DNA, 312 bp, Homo sapiens
  misc_feature: GYAE6OF02GVV5S.39.86.H09.1.454.CMB.1.raw
  modified_base (254)..(261): a, c, t, g, unknown or other
  misc_feature (254)..(261): n is a, c, g, or t
  modified_base (263)..(263): a, c, t, g, unknown or other
  misc_feature (263)..(263): n is a, c, g, or t
  modified_base (265)..(312): a, c, t, g, unknown or other
  misc_feature (265)..(312): n is a, c, g, or t
tcagtcgcactagtcacgaccggtgctcgatttagtgctatagacttggggtttgggggggtttggtggtctccactcccgccttgacgaggctgattattactgcagctcatttgcaatcgagtgaggcttatgtcttcgggaagtgggaccaaggtcagtcggtcctaggtcagcccaaggccaaccccatgtcactctcgttcccaccctcctcactagtgccgactgagcgggctggcaaggcgcatagnnnnnnnngntnnnnnnnnnnnnnnnnnnnnnnnnnnnnnnnnnnnnnnnnnnnnnnnn

SEQ ID NO: 233919 - DNA, 531 bp, Homo sapiens
  misc_feature: GYAE6OF02FQKUC.39.86.H09.1.454.CMB.1.raw
  modified_base (383)..(383): a, c, t, g, unknown or other
  misc_feature (383)..(383): n is a, c, g, or t
tcagtcgcactagtcacgaccggtgctcgatttagtgctatagacttggggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatatccaggcacacgacccccaaatcatcatttatgaggtcagtaatccggcctcgtagggtttctatcgtcttctctcggctaccgaagtcgtgaccaacgccggccctcccgngacctactctcgtcgggcctccgagtctaggaggacgaggctgtacttattacgtgctagtctctagtttgactaatcgagtgagtcttagtgtcgttaggaggtacggactaaggtcagtcgtacgtagtcacgaccgacggacccc

SEQ ID NO: 233920 - DNA, 568 bp, Homo sapiens
  misc_feature: GYAE6OF02FYTBK.39.86.H09.1.454.CMB.1.raw
  modified_base (301)..(301): a, c, t, g, unknown or other
  misc_feature (301)..(301): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaatcatcatttangagtcagtatcggcctcgaggggtttctaagtcgtcttctcgtggctcaagtcgtcggcaacgccggtcctccctcgacctatctcgtcgggcctccgaggctggaggacgaggcttgtattatacgtgacagtctctagtttcgactaactcgaggtacgtaggtactttagttcggttacgtttacgggaaaggttacggggaaccgtaagggttcgtaacgttccggttaccgtagggttcccaccggtacccgtaaacccggg

SEQ ID NO: 233921 - DNA, 254 bp, Homo sapiens; identical to SEQ ID NO: 233779
  misc_feature: GYAE6OF02GO1D5.39.86.H09.1.454.CMB.1.raw
  modified_base (246)..(254): a, c, t, g, unknown or other
  misc_feature (246)..(254): n is a, c, g, or t

SEQ ID NO: 233922 - DNA, 652 bp, Homo sapiens
  misc_feature: GYAE6OF02JT7WP.39.86.H09.1.454.CMB.1.raw
  modified_base (469)..(469): a, c, t, g, unknown or other
  misc_feature (469)..(469): n is a, c, g, or t
tcagtcgcactagtcacgaccggtgctcgatttagtgctatagacttgggttggggtcgtcgaggaggcagcgctctcaggacatctccaccatggcctgggctctgctgctcctcaccctcctcacctcagggcacagggtcctgggcccagtctgccctgactcaggctgcctccgtgtctgggtctctaggacagtcgatcaccatctcctgcactggaaccagcagtgacgttggggttatgactatgtctctggtccagcaatatccaggtcacacgcccccaaatcaactcactttatcgaggtcagtaatcggccctcgacggggtttcctaagtccgtcttcctcgtggtacctccaaagttcctggaccaacgaccggccctccctgaccctattcctacgtgggccttccgaggccttaggaacggaccgtgggacccttaggactttagtttaaccgngtaccgaacggttctaccgtaaattactaacgaaacggttccaacggtacctaacgggccctacgtttccgtttcgggttacgggtttaaatttcccgggggacgggttaacggggaacccccttaaagggccctttaaccgggaaccccggtttaccgttaacggggttcaaacccccgggg

SEQ ID NO: 233923 - DNA, 250 bp, Homo sapiens; identical to SEQ ID NO: 233806
  misc_feature: GYAE6OF02FSDRA.39.86.H09.1.454.CMB.1.raw
  modified_base (247)..(250): a, c, t, g, unknown or other
  misc_feature (247)..(250): n is a, c, g, or t

SEQ ID NO: 233924 - DNA, 603 bp, Homo sapiens
  misc_feature: GYAE6OF02FMSN3.39.86.H09.1.454.CMB.1.raw
  modified_base (393)..(393): a, c, t, g, unknown or other
  misc_feature (393)..(393): n is a, c, g, or t
  modified_base (483)..(483): a, c, t, g, unknown or other
  misc_feature (483)..(483): n is a, c, g, or t
tcagtcgcactagtcacgaccggtgctcgatttagtgctatagacttggggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatatccaggcacacgcccccaaactcatcactttatgaggtcagtaatccggcctcgtaggggtttcaatcgcttctctgctccaagtctggacacacggcctcctgaccatctcgtggctccgnggctggagcgaggctagtatttagttactgacgtacgtcttacgtattttacgactaacttcgaacgttagggcggttactttacggttnttacccgggttttaggtaaacgggttacggggtaaccggttaaaccgggtaccttaacggttccggttacccgtttaacgggttaccgacccggtaaccccggaacgggtaaaccccccc

SEQ ID NO: 233925 - DNA, 645 bp, Homo sapiens
  misc_feature: GYAE6OF02IBFJS.39.86.H09.1.454.CMB.1.raw
  modified_base (201)..(201): a, c, t, g, unknown or other
  misc_feature (201)..(201): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgntcaccatctcctgcactggaaccagcagtgacggttggggttatgactatcgtctcgtggtaccagctaagtactccgaggcaccaccgacccccaaactcatctattatgtagtcagtaacgtccggtcctcgtagggtttactacgtcgtactcgtcgtgtcacctagtctagacctaaccgccggtcccttccctagaccctacgtccgtcggtacgggtccttaccggaggtaccgtagggaacggtaccggtacggtacttaggtaatttactaacgtcgacgttacgtaccttactacgttcgtaacctaacgttacgtagtacgtacggttctttaggttcgttaccggttacgggtaacggttacgggaacccgttaaggtacttacggttaccggttaccgttaacggtaccctaccgggtaccctaaaccccgg

SEQ ID NO: 233926 - DNA, 545 bp, Homo sapiens
  misc_feature: GYAE6OF02GHSUP.39.86.H09.1.454.CMB.1.raw
  modified_base (303)..(303): a, c, t, g, unknown or other
  misc_feature (303)..(303): n is a, c, g, or t
  modified_base (344)..(344): a, c, t, g, unknown or other
  misc_feature (344)..(344): n is a, c, g, or t
  modified_base (365)..(365): a, c, t, g, unknown or other
  misc_feature (365)..(365): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgtgtctctaggacagtcgatcaccatctcctgcactggaaccagcagtgacgttgggggtatgactatgtctcctggtaccagcaatatccaggcacagcccccaaatcatcatttangaggtcagtaatcggccctcgagggtttctaatcgcttctntcggctccaagtctggcaacncggcctccctgacccatcctctgggcctccgaggtctgacggacgaggctagaattacttacgtgctagcctcagtttacgctaatcgaagtgtacggtcttaagtggttccttaggggaaacgtggggaaccctaagggttccaagttccggttacccgtaggtccacggtaacccccg

SEQ ID NO: 233927 - DNA, 603 bp, Homo sapiens
  misc_feature: GYAE6OF02HB50N.39.86.H09.1.454.CMB.1.raw
  modified_base (304)..(304): a, c, t, g, unknown or other
  misc_feature (304)..(304): n is a, c, g, or t
  modified_base (409)..(409): a, c, t, g, unknown or other
  misc_feature (409)..(409): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacagcccccaaactcatcatttangaggtcagtaatccggccctgtaggggtttctaatcgtcttctctcggctccaagtctggacaacgacggccctcccgtgacccattcctctgggtccttaccgngggtctaggacgggtaccgaggtccttgaatttagttacctgacagtccttacttagtttcgacttaactcgtagtacggaggttacctttagtcggtttaccgttaacgggtaacgggttcggtaaacccggtaggttaccgtacgtttaccggtacccgttaggtacccgtacccgaccccggtaaacccgg

SEQ ID NO: 233928 - DNA, 699 bp, Homo sapiens
  misc_feature: GYAE6OF02HPE9A.39.86.H09.1.454.CMB.1.raw
  modified_base (244)..(244): a, c, t, g, unknown or other
  misc_feature (244)..(244): n is a, c, g, or t
  modified_base (305)..(305): a, c, t, g, unknown or other
  misc_feature (305)..(305): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttangactatgtctctaggtaccagcaatatccgaggcacaccgacccccaaatcatctatttanggtagtcaagtaactccggaccctaggtacggggtttactaacgtcgtcttctcgtcggtctaccgtaagtcgtaggaccaacgaccgggtccctcccgtacgacctactccgttacgtcgggtcctaccggacgggtcgtacgggacgggaaccggtacggtcgtagttaactttaacgttacgtacggtactaacggtccttaactaacgttttcgaacttaaaacgttccggtaaaggttacggtaacggttacttttacgttacggtttacccgggtttaacgggggtaacgggttaacgggggtaaacccttaaacggggtccttaacggttcccggttaaccggttaacgggttaccccgaaccgggttacccccggtaaaacccggg

SEQ ID NO: 233929 - DNA, 612 bp, Homo sapiens
  misc_feature: GYAE6OF02IL738.39.86.H09.1.454.CMB.1.raw
  modified_base (281)..(281): a, c, t, g, unknown or other
  misc_feature (281)..(281): n is a, c, g, or t
  modified_base (385)..(385): a, c, t, g, unknown or other
  misc_feature (385)..(385): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctcgtaggacagtcgactcgaccatctcctgcactggaaccagcaggtgacggttgggggttatcgactatcgtcctcctacggaccagacaactntccgaggcacgaccgaccccctaaatcactctatttatgagtactaagtacgtccggcctaggtagggtttactagtccgtacttctcgtcgctacgtaagtcnggaccacgaccgtccctcctcgacctactcctcgcggtacctacgacgtcgtacggacggacgacgtactagtactttactacgcgtcacgtctacgtacttagacttaagtcgtagtacggtcgttacttacgttcgttacggttacgggtaacggtacgggtaacccgtaagttaccgttacgtccggttaccggtaggtacccgaccggtacccgtaacccggg

SEQ ID NO: 233930 - DNA, 534 bp, Homo sapiens
  misc_feature: GYAE6OF02HJYJG.39.86.H09.1.454.CMB.1.raw
  modified_base (299)..(299): a, c, t, g, unknown or other
  misc_feature (299)..(299): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggtatgactatgtctcctggtaccagcaatatccaggcacacgcccccaaatcatcatttangagtcagtaatcggccctgaggggtttctaagtcgtcttctctggctcaagtctggacaacgcggccctcctgaccctatcctcgtcggcctccgaggctggacggacgagctagtattattactgacagtcctactatttgactaactcgagtgagtcttagtgttacgttacgggaagttcgggaacctaaggtctacgttccgtaccgttaggtccacggacccgtaaccgg

SEQ ID NO: 233931 - DNA, 602 bp, Homo sapiens
  misc_feature: GYAE6OF02FMLBP.39.86.H09.1.454.CMB.1.raw
  modified_base (302)..(302): a, c, t, g, unknown or other
  misc_feature (302)..(302): n is a, c, g, or t
  modified_base (307)..(307): a, c, t, g, unknown or other
  misc_feature (307)..(307): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatatccaggcacacgccccaaactcatcatttangagtnagtaatcggcctgtagggtttctaatcgtcttctctggtcctccgaagttctcggacaaccgaccggtcccttccctacgaccctattccgtccgtcgggccttaccgacgggtctgggaacgggacggtacgggtccttaggtactttaacgtttacgtcgactacgcctttactacgtttcgactaattcgaggttcgacggttctttagtcggttacggtttacgggaaggttcgggaaaccgtaggttaccgtacgttccgtaccgttaggtccacggccccgtaaaccgg

SEQ ID NO: 233932 - DNA, 565 bp, Homo sapiens
  misc_feature: GYAE6OF02GUZRM.39.86.H09.1.454.CMB.1.raw
  modified_base (233)..(233): a, c, t, g, unknown or other
  misc_feature (233)..(233): n is a, c, g, or t
  modified_base (486)..(486): a, c, t, g, unknown or other
  misc_feature (486)..(486): n is a, c, g, or t
  modified_base (492)..(492): a, c, t, g, unknown or other
  misc_feature (492)..(492): n is a, c, g, or t
tcagtcgcactagtcacgaccggtgctcgatttagtgctatagacttgggtttgggggctggggtctcaggaggcagcgctctcaggacatctccaccatggcctgggctctgctgctcctcaccctcctcactcagggcacgagggtcctgggcccagtctgccctgactcaggctgcctccgtgtctgggtctctaggacagtcgatcaccatcctcctgcactggaaccngcagtgacggttggggttatgactatgtctcctggtaccagacaatatccaggcacacgacccccaaatcatctatttatgtagtacagtaacgtccggtccctcgtagggttctaactcgtactttctcgtcggtcctaccgaacgtcgtggaccaaccgtaccgtccctcccgtacgaccctaatccgtacgtcgggtcctccgacggtcgtaggaaggaccggtaggcctgtatttacgtctgcagtctntatttnactatgagttagacgtctagttggtcttaggacgtcgggaacctaggtctagtccgtacgtaggtcaacccgg

SEQ ID NO: 233933 - DNA, 523 bp, Homo sapiens
  misc_feature: GYAE6OF02FPRAJ.39.86.H09.1.454.CMB.1.raw
  modified_base (429)..(429): a, c, t, g, unknown or other
  misc_feature (429)..(429): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgacccccaaactcatcatttatgaggtcagtaatccggcctgaggggtttctaatcgcttctctggctcaagtctggacaacgccggcctcctgaccatcctcgtcgggctccgaggctggacggacgagctagattattacgngcagtctctatttcgactaatcgagtgtagtcttagtgttcgttcgggaagtgggaacctaggtcagttcgtccgtaaggcacggacccaacgg

SEQ ID NO: 233934 - DNA, 511 bp, Homo sapiens
  misc_feature: GYAE6OF02GAMU8.39.86.H09.1.454.CMB.1.raw
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
  modified_base (411)..(411): a, c, t, g, unknown or other
  misc_feature (411)..(411): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttataattatgtctcctggttccaacagcattcaggcagcgccccgaaactcttaattatgagtctttcgtcgccctcgtagggttctagtcgcttctcggctcagtctggcaacgacgcctcctgaccatctctggctccnggctgaggacgngctgattattacngtcagctcagtttcgctaatcagtgagtctttaagtgttcgttcggaagtcggactaggtctagtcgtcctaggtcacgccaacgcccacccgatgtacc

SEQ ID NO: 233935 - DNA, 444 bp, Homo sapiens
  misc_feature: GYAE6OF02GBQJ8.39.86.H09.1.454.CMB.1.raw
  modified_base (360)..(360): a, c, t, g, unknown or other
  misc_feature (360)..(360): n is a, c, g, or t
  modified_base (426)..(444): a, c, t, g, unknown or other
  misc_feature (426)..(444): n is a, c, g, or t
tcagtcgcactagtcacgaccggtgctcgatttagtgctatagacttgggtttgggggctgtgcctggatattgctggaaccagcagtgacgttggggggttatgactatgtctcctggtaccagcaatatccaggcacagcccccaaactcatcatttatgaggtcagtaatcggccctcaggggtttctaatcgcttctctggctccaagtctggcaacacggcctccctgaccatctctgggctccaggctgaggacgaggctgattattactgcagctcatttgcaatcagtgaggcttatgtcttcggaagtgggaccaaggtcatcgtctaggtcagcccgaaggcccaacccntgtcactctcgttccccgccctcctcactcgtgccacgtgacggcgggctcggcaaggcgcatcgnnnnnnnnnnnnnnnnnnn

SEQ ID NO: 233936 - DNA, 741 bp, Homo sapiens
  misc_feature: GYAE6OF02HTWLR.39.86.H09.1.454.CMB.1.raw
  modified_base (250)..(250): a, c, t, g, unknown or other
  misc_feature (250)..(250): n is a, c, g, or t
tcagtcgcactagtcacgaccggtgctcgatttagtgctatagacttggggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacaggtcgatcaccatctcctgcactcggaaccagcagtggtacggtttgggggttangtacttatgtcctccgtggtaccagctaactacgtccaggccaccgacgaccccccaaactcatctatttatgacggtactagtaacgtccggtacccttcggtacggggttttactaacgtccgtctttccgtcgtcggtacctaccaacgttctacggacctaaccgtaccggtacccgtcccgtacgaaccctacgtccgttacggtcgggtcccttaccggacgggtcgttacggaaccggggtaaccgggacgggttaccgttagggtttactttaaccgtttaccgtacggtccgttacgtcctttactaacgttttcgaaccgtaagttccgtaacggttacggtaacgggtttactttacgttacggtttaccgggtttaaccggggtaaggttacccggggtaaccggtaacgggttactaacccggtttcggttacccgttacgggtacccgtaaccggtaccccgaaccggtaacccccg

SEQ ID NO: 233937 - DNA, 253 bp, Homo sapiens
  misc_feature: GYAE6OF02IYWDX.39.86.H09.1.454.CMB.1.raw
  modified_base (237)..(237): a, c, t, g, unknown or other
  misc_feature (237)..(237): n is a, c, g, or t
  modified_base (242)..(253): a, c, t, g, unknown or other
  misc_feature (242)..(253): n is a, c, g, or t
tcagtcgcactagtcacgaccggtgctcgatttagtgctatagacttggggtttggggggtttggtggtctccactcccgccttgacgaggctgattattactgcagctcattgcaatcagtgaggcttatgtcttggaagtgggaccaaggtcatcgtcctaggtcagcccaaggccaaccccatgtcactctgtcccaccctctcactagtgcgactgagcgggctggcaaggcnatagnnnnnnnnnnnn

SEQ ID NO: 233938 - DNA, 258 bp, Homo sapiens
  misc_feature: GYAE6OF02JBQF7.39.86.H09.1.454.CMB.1.raw
  modified_base (247)..(258): a, c, t, g, unknown or other
  misc_feature (247)..(258): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtggaccaaggtcatcgtcctaggtcagcccaaggccaaccccactgtcactctcgttcccgccctcctcactagtgcgactgagcgggctggacaaggcgcatagnnnnnnnnnnnn

SEQ ID NO: 233939 - DNA, 527 bp, Homo sapiens
  misc_feature: GYAE6OF02JJUWJ.39.86.H09.1.454.CMB.1.raw
  modified_base (228)..(228): a, c, t, g, unknown or other
  misc_feature (228)..(228): n is a, c, g, or t
  modified_base (394)..(394): a, c, t, g, unknown or other
  misc_feature (394)..(394): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacgttgggggtatgactatgtctcctggtaccagcaatatccaggcacacgcccccaaactcatcatttatgaggtcagtaatcggccctcgtaggggtttctaatcgtcttctctgctcaagtctggcaacgcgcctcctgaccatctcgtggctccgnggctgaggacgagctgtattatacngacngtctactntttcgactactcgagtgagtcttagtcgtacgttcgggaagtcgggaaccgtaaggtctacgttccggtacctaggtcgaccggcccgtaacccgg

SEQ ID NO: 233940 - DNA, 631 bp, Homo sapiens
  misc_feature: GYAE6OF02HOKDL.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtcgtgggtctctaggacagtcgatcaccatcctcctgcactaggaaccagccagtgacggttgggggttatggactagtgtctccgtaggtaccagacaatctacaggcaccacgacccccaaaactcaactctattataggtagtctaagtaacgtcccggtaccttcggtaaggggtttactaacgtcgtcgtttacctcgtacgggtcctaccgtaacgtctggaaccaaccgtaccggtccctacccgtagaccctattccgtacgtcggcttccgagggtctaggaggaacggtacggtcctaggtaactttaagtctacggtacacgtccgttacaagttacaactaagccgaagtacaacgtcaccgtttgttacgggtgtaccggttcgggacggggtaaccgacgtaacgcgtaccggacccggtactagggtactaacccggg

SEQ ID NO: 233941 - DNA, 652 bp, Homo sapiens
  misc_feature: GYAE6OF02GTMEV.39.86.H09.1.454.CMB.1.raw
  modified_base (228)..(228): a, c, t, g, unknown or other
  misc_feature (228)..(228): n is a, c, g, or t
  modified_base (309)..(309): a, c, t, g, unknown or other
  misc_feature (309)..(309): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcaggtgacggttgggggttatgtactatgtctcgtggtaccagcaatatccaggcacacgcccccaaatcatctatttangagtcagtactcggcctgtacgggtttctaatcgtcttctcgtggctacaagtctaggaccaacgaccggcctcccgtagaccctatcctcggtcgggtcctccggacggtccgtaggacggtaccggtagtccgttagttaagttaactttacgtcgtacgaacgtccttagtacgtttgaacgttaacgttccgtaaggttcgtaacggttacgtttacgtacggttacggttttaaaggggaacgggtttaccggggtaaacctaaacgggtttccgtaaacggtttcccggttaaccggttacgggttacccgtacccggtacccccgtaaacccgggg

SEQ ID NO: 233942 - DNA, 842 bp, Homo sapiens
  misc_feature: GYAE6OF02F8SVF.39.86.H09.1.454.CMB.1.raw
tcagtcgcactagtcacgaccggtgctcgatttagtgctatagacttgggggggggggtctcaggaggcagcgctctcaggacatctccaccatggcctgggctctgctgctcctcaccctcctcactcagggcacagggtcctgggcccagtctgccctgactcaggctgcctccgtgtctgggtctcgtaggacagtcgactcacctatcctcctgacctacgtacggaaccagcgtaggtggtacgggtttggggttatcgtacttagtcgttcctccgttaggtaaccagactaatactaccgaacggtccaaccgaccgaacccccccgtaaaattccgtaacttaccgtaattttacggtacgggtaaccgggtttaccgtaaacgggtttaaaccggttccccgggtaccccgtttacgggttaacgggggttttttacctaaacggtttcccggtaccttttaccgttccggttacgggtaccccttaacccggtaaacggttccccggttacgggaacccctaaaacccggtacccgggttccccctttaccccgttacggaaccccgttacctttacccggttaccggttccggggtacccttaccggacgggtccggttaacgggacggtacgggtacgtcgttaacgtattttaacgttacgtcgtactaaccgttccttagttacgtttacgaccttaacgtagttaacggtacggtagttaccgttagttcggttacggttaacgggtaacgggttacggtaaccgtaagggttccttacggttccgtaccggttacggtaccaccggtacccgaccggtaacccccg

SEQ ID NO: 233943 - DNA, 589 bp, Homo sapiens
  misc_feature: GYAE6OF02HD352.39.86.H09.1.454.CMB.1.raw
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
  modified_base (398)..(398): a, c, t, g, unknown or other
  misc_feature (398)..(398): n is a, c, g, or t
  modified_base (405)..(405): a, c, t, g, unknown or other
  misc_feature (405)..(405): n is a, c, g, or t
  modified_base (414)..(414): a, c, t, g, unknown or other
  misc_feature (414)..(414): n is a, c, g, or t
  modified_base (420)..(420): a, c, t, g, unknown or other
  misc_feature (420)..(420): n is a, c, g, or t
tcagtcgcactagtcacgaccggtgctcgatttagtgctatagacttgggttgggggttcgttcgaggaggcagcgctctcaggacatctccaccatggcctgggctctgctgctcctcgaccctcctcactcagggcacagggtcctcgggcccagtctcgccctgactcaggctgcctcgtgtctggtctcgtaggacagtcgatcgaccatcctcctgcacgtacggaaccagacaagtgtacggtttgggggttatagacttagtcggtcttcgtacggtaccagtacaatactccgaggaccacctaacgacccccaaaatcgaactctatttacaggtagtacagtaactcgacctacgtagggtttacacgtntctntctgctacgagtcngactacncgtcctccngacctntctctcggctcgaggctagacggacgacgctgaacttgtaactggcaacggtcttcgtaacgtttcgactaacgtcgtaacgtcgtaacgtcttagtcgttaccgtacggtagtccgggtaaccaaggttcacgttccggtaacttacggtaccacgtacccgaaccgg

SEQ ID NO: 233944 - DNA, 642 bp, Homo sapiens
  misc_feature: GYAE6OF02HE83E.39.86.H09.1.454.CMB.1.raw
  modified_base (300)..(300): a, c, t, g, unknown or other
  misc_feature (300)..(300): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctcgtgtctgggtctcgtaggacagtcgatcaccatctcctgcactggaaccagcagtgacggttggggttatgactatgtctctggtaccagcaatatcaggcacacgaccccaaatcagtcatttangtagtcaagttaactcgcctcggtagggtttactaagtccgtcttcgtcgtcggacttaccgaagttcgtcggactaaacgccggtcctcccgtagaccctacgttccgtacgtcgggcctaccgagggtcctagggaacgggtaccggaacggtcttaggtaactttaaagtttcgacgttacgacgtcttacttagtttaccgaacttaattccggaagtacggtacggttctttaaggtttccggttaccgttaacgggaacggttccgggtaaaccgttaggtacgttacgtccgttaaccggttacgggtacctacccggtacccgaaaaccccggg

SEQ ID NO: 233945 - DNA, 649 bp, Homo sapiens
  misc_feature: GYAE6OF02F7OAS.39.86.H09.1.454.CMB.1.raw
  modified_base (324)..(324): a, c, t, g, unknown or other
  misc_feature (324)..(324): n is a, c, g, or t
tcagtcgcactagtcacgaccggtgctcgatttagtgctatagacttgggtttgggggtctcaggaggcagcgctctcaggacatctccaccatggcctgggctctgctgctcctccaccctcctcactcgagggcacgagggtccgtcgggcccagtctcgccctgactcgaggctcgcctccgtgtcgtgggtctctaggacagtcgatcaccatcctcctgcacgtacggaaccagcagtggtacggttggggttatgactatgtcctctggtaccagacaatactccgaggccacaccgacccccaaatcatctatttanggagtcaagtaactccggcctcgtacgggtttactaagtccgtcttctcgtcgctaccaagttcgcggaccaaccgaccggcctcccgtacgaaccctattccgtcgtcgggtccctaccgacggtccgtaggaacgggtaccggacgggtcttacggttaatttacttaaccgtggacctagtccttactagtttgaacctaagtacgtaggtacggtacggttactttagttcggttacggtttaacgggaagggtccgggtaaacgtagggttacctacggttccgttaccgtaggtaccgaccggtaccccgtaaacccgg

SEQ ID NO: 233946 - DNA, 550 bp, Homo sapiens
  misc_feature: GYAE6OF02GVXOV.39.86.H09.1.454.CMB.1.raw
  modified_base (299)..(299): a, c, t, g, unknown or other
  misc_feature (299)..(299): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactgaaccagcagtgacgttgggggttatgactatgtctcctggtaccagcaatatccaggcacagcccccaaatcatcatttangagtcagtaatcggccctgaggggtttctaatcgcttctctggctcaagtcnggcaacncggcctcctgaccatctctgggctccaggctgacggacgagctgattattactgcagtcctacgtatttcgactaattccgagtagacggtctttacgtggttccgtttacgggaaggttaccggggtaacccaagggtttccaacggttccggttacccgttaagggtccaccggtacccctaaacccggg

SEQ ID NO: 233947 - DNA, 596 bp, Homo sapiens
  misc_feature: GYAE6OF02JFNTT.39.86.H09.1.454.CMB.1.raw
  modified_base (306)..(306): a, c, t, g, unknown or other
  misc_feature (306)..(306): n is a, c, g, or t
tcagtcgcactagtcacgaccggtgctcgatttagtgctatagacttgggtttggggggggtcgtcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggtatgactatgtctcctggtaccagcaatatccaggcacacgcccccaaaatcatcatttangagtcagtatcggcctcgaggggtttctaagtcgcttctctcggtctccgtaagtcctggccaaccgaccggcctccctacgacctactctcgtcgggcctccgacggtcgtaggacggaccggaggctagtaactttacgttacctggaccagtaccttacgtagttttacgactaatcgtaggttacgaggtctttagtcgtccggtttacgggaacggttgggaacccgtaaggttcctacgttacccggttaccgtacggggttacaccggtaccccgaaacccgg

SEQ ID NO: 233948 - DNA, 625 bp, Homo sapiens
  misc_feature: GYAE6OF02H3DZR.39.86.H09.1.454.CMB.1.raw
  modified_base (304)..(304): a, c, t, g, unknown or other
  misc_feature (304)..(304): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatgactatgtctcctgtaccagcaatatccaggcacacgacccccaaatcactctatttagngagtcaagtaactcggcctgtaggtttcaatctcttctctgctacagtctggcaacgcgcctcctcgacctattcctcgtacgggcctaccgaggtcctaggacgggtaccggaggcttacggttaatttacgttacgtcggaccacgttaccttacgttaagtttcgacgtaacgttaccgagttacggtacggttacctttaggttccggttacggtttaccggggaacgggttacgggtaaacccggtaaggtttacctaccggtttacccggtacccgttaacgggtaccgtaacccgggaccccgtaaaccccggg

SEQ ID NO: 233949 - DNA, 631 bp, Homo sapiens
  misc_feature: GYAE6OF02FX9OI.39.86.H09.1.454.CMB.1.raw
  modified_base (298)..(298): a, c, t, g, unknown or other
  misc_feature (298)..(298): n is a, c, g, or t
tcagtcgcactagtcacgaccggtgctcgatttagtgctatagacttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacagcccccaaatcatcatttangaggtcagtaatcggccctcgagggtttctaatcgcttctctggctcgaagtctggcaaccgacggccctccctgaccctatcctcgtcgggcctccgacgggtctggaacgggaccgtaggccttggatttaacgttaccgtaggctacggtccttacgtattttcgactaacgttcgaaggttcggtaacgtacgtttaacgttgttacccggtttacggggtaaacgggttacggggaaaccccgttaaaggggttcctaaacggtttcccggttacccggttaaacgggttccgtaacccgggtacccccgtaaggggtaacccccccc

SEQ ID NO: 233950 - DNA, 563 bp, Homo sapiens
  misc_feature: GYAE6OF02HWUA7.39.86.H09.1.454.CMB.1.raw
  modified_base (314)..(314): a, c, t, g, unknown or other
  misc_feature (314)..(314): n is a, c, g, or t
  modified_base (465)..(465): a, c, t, g, unknown or other
  misc_feature (465)..(465): n is a, c, g, or t
  modified_base (475)..(475): a, c, t, g, unknown or other
  misc_feature (475)..(475): n is a, c, g, or t
tcagtcgcactagtcacgaccggtgctcgatttagtgctatagacttggggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggtatgtactatgtctccgtggtaccagcaatactccaggaccacacgacccccaaatcatctatttangagtcaagtactccggacctcgtagggtttactaagtcgtcttctcgtggctacctaagtcgtcggacaaccgaccgggtcccttacccgtacgaccctatcctcgtcgggtcctccgagggtctagggagacggtggctagtatttatcngcacggtctntagttgactacgtcgagtgaggtcttagtcgttcgtaagggtagtcggtaacaaggtctacgtccgtacgtaggctaccggccaacgg

SEQ ID NO: 233951 - DNA, 252 bp, Homo sapiens; identical to SEQ ID NO: 233262
  misc_feature: GYAE6OF02GXX2L.39.86.H09.1.454.CMB.1.raw
  modified_base (246)..(252): a, c, t, g, unknown or other
  misc_feature (246)..(252): n is a, c, g, or t

SEQ ID NO: 233952 - DNA, 635 bp, Homo sapiens
  misc_feature: GYAE6OF02I2QSM.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaccagcagtgacgttggggtatgactatgtctccgtggtaccagcaatatccaggtcacacgcccccaatcatctatttatgtaggtcagtaatcgccctcgtagggtttctaatcgtcttctctggctcaagtctggacaacgaccggtcctcccgtacgaccctatccgtacgtcggtctccgagggtcgtaggacgggacggaggtccttagtactttagttaccgtggacctaggtccttacgtagttttcgaccgtaaactttccgtaaggttacgggaacgttcctttaaggtttcggtttaccggtttaccggggttaaagggttccggggtaaacccttaacgggttctaaccggtttccggttaacccggttagggtacccgtaccggttacccccgaaaccccggg

SEQ ID NO: 233953 - DNA, 249 bp, Homo sapiens; identical to SEQ ID NO: 233247
  misc_feature: GYAE6OF02HUWVC.39.86.H09.1.454.CMB.1.raw
  modified_base (246)..(249): a, c, t, g, unknown or other
  misc_feature (246)..(249): n is a, c, g, or t

SEQ ID NO: 233954 - DNA, 715 bp, Homo sapiens
  misc_feature: GYAE6OF02JEPXX.39.86.H09.1.454.CMB.1.raw
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacacgggtcctgggcccagtctgccctgactcaggctgcctccgtgtctggtctctaggacagtcgatcacatctcctgcacgtggaaccngcagtgacggttggggtangactatcgtctctggtaccagactaatactccgaggcaacgaccgacccccaaaactccaattacctaatttacgcggtaacgtaccgtaaggttaacgtcccggtaccctcggttaacgggtttactaacgtccgttcttcgtacgtcggtacctaccgtaagttccgtacggtaaccaaccggtaccggtcccttacccgtacgaaccctacgttccgttccgggtaccggtcccttaccggaacggtccggttaccgggaaccgggtaaccggtacggtaccgttaacgttaacctttacgtttaaccgcggtaaccgtaccgtaccttacgtacgttttacggaaccttaacgtacgtaacggttacgtacgttactttacgtacggttacggttaacgggtaacggtacggtaaccgtacggtactacgttcggtaccgttacgtaccgacgtacccaaccgg

SEQ ID NO: 233955 - DNA, 631 bp, Homo sapiens
  misc_feature: GYAE6OF02GY2BL.39.86.H09.1.454.CMB.1.raw
  modified_base (311)..(311): a, c, t, g, unknown or other
  misc_feature (311)..(311): n is a, c, g, or t
tcagtcgcactagtcacgaccggtgctcgatttagtgctatagacttggggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactgaaccagcagtgacgttgggggttatgactatgtctccgtcggtaccagcaatactccaggccacacgacccccaaactcatcatttangaggtcaagtaacgtccggcctacgtacggggtttctaagtcgtcttctctggcctacgaagtcgtacgcaaccgaccggtcctcccgtacgaccctacttccgtacgtcgggccctccgacggccgtacgggacggtaaccggaggtaccgttaggttaactttactacgtacgtacgacggtccttacgtacgttttacgccgtaaacgttccgtaggtacggtgtacgtttagttccggttacggttacgggtaaggttccgggaaccgtaggtacgtacgttcgttaccgtacggtacgaccgtacccggaacccg

SEQ ID NO: 233956 - DNA, 522 bp, Homo sapiens
  misc_feature: GYAE6OF02IZU1G.39.86.H09.1.454.CMB.1.raw
  modified_base (301)..(301): a, c, t, g, unknown or other
  misc_feature (301)..(301): n is a, c, g, or t
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
  modified_base (411)..(411): a, c, t, g, unknown or other
  misc_feature (411)..(411): n is a, c, g, or t
tcagtcgcactagtcacgaccggtgctcgatttagtgctatagacttgggttgggggtctcaggaggcagcgctctcaggacatctccgccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaatcatcatttangagtcagtaatcggccctgagggtttctaatcgtcttctctgctcatctgcacgcgcctcctnacctatcncgtggcctcgacgctggagacggagtctgtattattacngacagtccttactattgactaactcgtagtgagtcttgttcgttcgttacggtaggtcgggtaaccgtaggtctacgtcgtaccgttaggtaccacggacccgtaacccgg

SEQ ID NO: 233957 - DNA, 619 bp, Homo sapiens
  misc_feature: GYAE6OF02HF0SI.39.86.H09.1.454.CMB.1.raw
  modified_base (308)..(308): a, c, t, g, unknown or other
  misc_feature (308)..(308): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtcctcctggtaccagcaatatccaggccacacgcccccaaatcatcatttangagtcagtatccgcctgtagggtttcaatcgtcttctctgctcaagtctggcaacgaccgtcctccgtacaccatcctcgtcgggtcctaccggaggtccgtagggacggaccggagggtccttaggtaacttttaacgttaccgttcggaaccgtacggtcccttacttaagtttccgactaaagttccgtaaggttggaacggttcctttagttcggtttaccgttacggggtaaggttcggggaaacccgtaggttaccgtagttaccggtccgttaacgggtacctaccggtacccgtaaacccggg

SEQ ID NO: 233958 - DNA, 571 bp, Homo sapiens
  misc_feature: GYAE6OF02IA91W.39.86.H09.1.454.CMB.1.raw
  modified_base (180)..(180): a, c, t, g, unknown or other
  misc_feature (180)..(180): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
  modified_base (547)..(548): a, c, t, g, unknown or other
  misc_feature (547)..(548): n is a, c, g, or t
  modified_base (551)..(556): a, c, t, g, unknown or other
  misc_feature (551)..(556): n is a, c, g, or t
  modified_base (558)..(559): a, c, t, g, unknown or other
  misc_feature (558)..(559): n is a, c, g, or t
  modified_base (561)..(571): a, c, t, g, unknown or other
  misc_feature (561)..(571): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacagcccccaaactcatcatttatgaggtcagtaatcggccctnaggggtttctaatcgcttctctggctccaagtctggcaacacggcctccctgaccatctctgggcctccgaggctgaggacggaggctgatttaattactgcagcttctattttgctaaatcaggttgaggtcttttaagtgttcgttacggaaggttcgggaacctaaaggggtctaacgttccggttaccttagggtaccacggtccccgaaagggcccctaaacccccgacttacggtccctaacctccgttcgtttcccccgccccttcccgtcctaccgttacgtcgacggtaccgtggaccggtcggggccgttcgggaccgaaagggccgtacgaacgttacggacngncngacncntgnnctnnnnnngnncnnnnnnnnnnn

SEQ ID NO: 233959 - DNA, 836 bp, Homo sapiens
  misc_feature: GYAE6OF02JYWWN.39.86.H09.1.454.CMB.1.raw
tcagtcgcactagtcacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcaggctgcctccgtgtctggtctctaggacagtcgatcaccatctcctgcactggaaccagcgagtgtacggttggggttatggactatcgtctccgtaggtaccagactaatactccgaggccacgaccgaccccctaaaatccaattacgtaattttacgtacggtaacggttactaaacggttaaacgtccccgggttacccgttacgggttaacgggggtttttaccttaaacgttcccgttaccgtttttaccgtaccggttaccggtaccttaacccggtaaggtttacccgtaccgggtaacccgtaaacccggtaacccgggttcccccttaaccccggttaaccgtaaccccgttaaccgtttcccggtaccgggttaccggggtccccttacccgggaacgggttccggtaacggggtaaccgggtaaccgggtacgggtacctttaacgggttaacttttaacggtttacgaccgtacgtaacgttcccgttaagttacgttttacggacttaacgtaccggtacggttacggtacgttaccgttttaaggtccggtttaaccggttacggggtaaccgggttaaccgggtaaccgtacgggttacccgttacggttaccccggtttcgggttaaccgtacccgtaaaccccggg

SEQ ID NO: 233960 - DNA, 654 bp, Homo sapiens
  misc_feature: GYAE6OF02IVCCA.39.86.H09.1.454.CMB.1.raw
  modified_base (275)..(275): a, c, t, g, unknown or other
  misc_feature (275)..(275): n is a, c, g, or t
tcagtcgcactagtcacgaccggtgctcgatttagtgctatagacttgggtttggggggggtctcaggaggcagcgctctcaggacatctccaccatggcctgggctctgctgctcctcacctcctcactcagggcacagggtcctgggcccagtctgccctgactcaggctgcctccgtgtctgggtctctaggacagtcgatcaccatctcctgctactggaaccagcagtgacggttgggggttatgactatgtctcctggtaccagcaatntccaggcacacgaccccaaatcatctatttatgaggtcagttaactccggtcccttcgtaggggtttactaagtcgtcctttcgtcgttcggaccttcgtaacgtcgtcggacctaaccgtaccggtccctaccgtcgacctactccgtcgtcgggcctccggacggtcttagggacggtacggacggtcgttagtaatttacgttaacgtcgactacggccttacgttatttcgtactaacgttcgaaggttcgtacggttactttacgttcggttaccggtttaccgggtaaggttaccggggtaaccgtaagggttaccttacggtttccggtacccgtttaagggtacccggtaccggtacccgtaaaccccggg

SEQ ID NO: 233961 - DNA, 647 bp, Homo sapiens
  misc_feature: GYAE6OF02H8UDC.39.86.H09.1.454.CMB.1.raw
  modified_base (485)..(485): a, c, t, g, unknown or other
  misc_feature (485)..(485): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctcgccctgactcaggctgcctccgtgtctgggtctcgtaggacagtcgatcaccatctcctgcacgtaggaaccagcgtagtggtacggttgggggttaatgacgtatcgtctcgtggtaccagcaatactccgagtcacgaccgaccccaaacgtcactactactttagtgtacgtactaagttaacgtccgtaccgtacggtaacggggtttactaacgtcgtaccttctcgtcgtctacgtaacgtcgtcgactaccgacgtccctacctagacctatccgtacgcggtctccgaggcgtaggacgacggacgtctgtaattacgtacncgtgtaacgtctaccgtagttcgacgttaactccggtaatacgacggttacttaggttccggttaccggtaacgggaacggttacgggtaaacccggtaaggttccttaacggtaccggttaccggttaaccggtaccgacccgggtaaccctaaccccggg

SEQ ID NO: 233962 - DNA, 625 bp, Homo sapiens
  misc_feature: GYAE6OF02JCO9Y.39.86.H09.1.454.CMB.1.raw
  modified_base (305)..(305): a, c, t, g, unknown or other
  misc_feature (305)..(305): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggtatgactatgtctcgtggtaccagcaatactcaggcaccacgaccccaaatcatctattangagtcagtaactccgcctaggtaggtttctaactcgtcttctcgtggtctacgaatcgtggaccacgtccgccctacctagacctacgtctacggtcggtcctcgaggtccgtagggaccggaacggtcggtacttaggttaactttacgttacgtcgtacgtcgttacttacgttacttcggaacttacgtacgtacggtacggtacgttacgtttacgttacggttacggtaaccggttaaggggtaccggtaacgttaacggttacgttacggttaccggtttaccggtacggaccgttaccggacccgtaacccgg

SEQ ID NO: 233963 - DNA, 539 bp, Homo sapiens
  misc_feature: GYAE6OF02JEHLX.39.86.H09.1.454.CMB.1.raw
  modified_base (228)..(228): a, c, t, g, unknown or other
  misc_feature (228)..(228): n is a, c, g, or t
  modified_base (304)..(304): a, c, t, g, unknown or other
  misc_feature (304)..(304): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacgttggggttatgactatgtctcctggtaccagcaatatccaggcacacgcccccaaatcatcatttangagtcagtatcggcctcgagggtttctaatcgtcttctctgctcaagtctgcacgacgcctcctgaccatctcgtggctcgagctggaggacgagctagtattagttacngcagtctntatttcgactaatcgagtgacggtcttagtggtaccgttcgggaaggttcggggaacctaacgggttactacgttccggttaccgttacgggtacccacggtacccccgtaaaccgg

SEQ ID NO: 233964 - DNA, 616 bp, Homo sapiens
  misc_feature: GYAE6OF02HPSV9.39.86.H09.1.454.CMB.1.raw
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctccgtggtaccagcaatatccaggcacacgccccaaactcatcatttatgaggtcagttaactccggccctacgtagggggtttactaagtccgactttcgtcgtggcctacctaagtctggaccaacaccgggtcccttaccctgtacccatccttacgtcgggtccttaccgacgggccgtaggaacggaccggtaagggccttaggtaactttaagttaaccgtggtacgtacggtccttacgtaagttttcgactaattacgaggttgacggtactttagtcgttacggttacggtaggttacgggaacctaaggtacctagttccgaccggttaggtaccgtacgacccgtaaccgg

SEQ ID NO: 233965 - DNA, 556 bp, Homo sapiens
  misc_feature: GYAE6OF02F998Z.39.86.H09.1.454.CMB.1.raw
  modified_base (300)..(300): a, c, t, g, unknown or other
  misc_feature (300)..(300): n is a, c, g, or t
  modified_base (359)..(359): a, c, t, g, unknown or other
  misc_feature (359)..(359): n is a, c, g, or t
  modified_base (426)..(426): a, c, t, g, unknown or other
  misc_feature (426)..(426): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgccccaaatcatcatttangagtcagtaatcgcctgagggtttcaagtcgtcttctctgctacgaagtctggacaacncgcctccctgaacctatcgtcgtcgggctccgaggctaggacggacgaggctagtattaacgttacngacagtctactatttcgacttaagtctaggtgacgtctttacgtcgttacgttaacgggtaacggttcgggtaaaccctaaggttactacgttccgttaccgtaaggtcccgaaggaccccgtaacccgg

SEQ ID NO: 233966 - DNA, 759 bp, Homo sapiens
  misc_feature: GYAE6OF02IBRET.39.86.H09.1.454.CMB.1.raw
  modified_base (628)..(628): a, c, t, g, unknown or other
  misc_feature (628)..(628): n is a, c, g, or t
tcagtcgcactagtcacgaccggtgctcgatttagtgctatagacttggggggggggtctcaggaggcagcgctctcaggacatctccaccatggcctgggctctgctgctcctcaccctcctcactcagggcacagggtcctgggcccagtctgccctgactcaggctgcctccgtgtctggtctctaggacagtcgatcacatctcctgccactggaaccagacagtggtacggtttgggggttatgtacttagtgtcctccgtggtaccagactaatactccaggccaacaccgaccccctaaactcctaatacctattttagagtaacggttactaacgtaacgttcccgggacccttaggttacggggttttactaacggttccgtactttccgtacgttcggccctttacgaacggttctaacggaccaaaaccgtcccggtcccctttacccgtcgtaaaccctcttcccgttaccggtcgggtcccgtaccgtacgggtaccgtagggtaaccgggacggtaaccgggtcgttaacgttaacgtttaacgtttaccgacgacgtacgttcttaaccgttagtttacgaccttaacgtacgtagggttacggtaaacgttntttaacgtcggtttaaccggtttacggggtaacgggttaaccgggtaaccggtaaacggttaccgtaacgtttaccggttaccggttaaccgggttacccgaaccggtaaccccgtaccggtaaacccccg

SEQ ID NO: 233967 - DNA, 611 bp, Homo sapiens
  misc_feature: GYAE6OF02FQBDB.39.86.H09.1.454.CMB.1.raw
  modified_base (301)..(301): a, c, t, g, unknown or other
  misc_feature (301)..(301): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggtatgactatgtctcctggtaccagcaatatccaggcacacgcccccaaactcatcatttangagtcagtaatcggcctcgtaggggtttctaatcgtcttctctggctccaagtctggacaacgaccggtccctccctagaccactctcgtcgggcctccgaggccgtaggacggacggaggtcgttaggtaatttaacgttactggtaccacggtccttactagttttcggactaacgttcgaaggttcgggtacggttacgttttacgtacggtttccggtttaacgggaagggttacggggtaacccgtaacgggttaccgtagttccggttaccgtagggtaccgtaccggtaccccgtaaacccgg

SEQ ID NO: 233968 - DNA, 342 bp, Homo sapiens
  misc_feature: GYAE6OF02H94MX.39.86.H09.1.454.CMB.1.raw
  modified_base (129)..(129): a, c, t, g, unknown or other
  misc_feature (129)..(129): n is a, c, g, or t
  modified_base (310)..(310): a, c, t, g, unknown or other
  misc_feature (310)..(310): n is a, c, g, or t
  modified_base (319)..(342): a, c, t, g, unknown or other
  misc_feature (319)..(342): n is a, c, g, or t
tcagtcgcactagtcacgaccggtgctcgatttagtgctatagacttggggtttgggggggggtctcaggaggcagcgctctcaggacatctccaccatggcctgggctctgctgctcctcacctcctnactcagggcacagggtcctgggcccagtctgccctgactcaggctgcctccgtgtctgggtctctaggacagtcgatcaccatctctgcactggaaccagcagtgtacggtggggttatgactatgtctcgtggtaccagcaatatccgaaggcacacgacccccaaatcatacattaacngaggtactnnnnnnnnnnnnnnnnnnnnnnnn

SEQ ID NO: 233969 - DNA, 815 bp, Homo sapiens
  misc_feature: GYAE6OF02HKJMX.39.86.H09.1.454.CMB.1.raw
  modified_base (331)..(331): a, c, t, g, unknown or other
  misc_feature (331)..(331): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacgagggtcctcgggcccagtctcgccctgactcaggctgcctccgtgtcgtgggtctctaggacagtcgatcaccatcctcctgcacgtggaaccagcagtggacggttgggggttatggactatgtcctcgtcggtaccagactaatactccaggaccaaccgaccgaccccctaaaacgtcaacttactatttancggtaggtactaagttaacgtcccggcccgttacggttacggggtttacctaagttccgtctttccgtacgtcgtcctaccgtaacgttcgtacggaccaaccgtaccggtcccttacctaccgtaacctcgttaccgttccgggtccgggtacccgttacccggacgggttccggttaacgggacggggtaaccgggtacgggttacccgttaagggtttaacttttaacgtttaccggtacgggtaccgttacggttacccgttacgttttacggtttaacgtaaccgttaagtttaccgggtaacgggtttacgggtacggtttaccgttttaacggtttccgggttttaacccgggtttaaacggggtaacgggttaaccggggtaaacccgttaaccggggtttaccgttacccggtttacccgggttacccggttaacgggtaccccgtaccccgggtaacccccggtaaacccccgg

SEQ ID NO: 233970 - DNA, 580 bp, Homo sapiens
  misc_feature: GYAE6OF02JVHWX.39.86.H09.1.454.CMB.1.raw
  modified_base (280)..(280): a, c, t, g, unknown or other
  misc_feature (280)..(280): n is a, c, g, or t
  modified_base (545)..(545): a, c, t, g, unknown or other
  misc_feature (545)..(545): n is a, c, g, or t
  modified_base (548)..(549): a, c, t, g, unknown or other
  misc_feature (548)..(549): n is a, c, g, or t
  modified_base (551)..(551): a, c, t, g, unknown or other
  misc_feature (551)..(551): n is a, c, g, or t
  modified_base (554)..(554): a, c, t, g, unknown or other
  misc_feature (554)..(554): n is a, c, g, or t
  modified_base (556)..(556): a, c, t, g, unknown or other
  misc_feature (556)..(556): n is a, c, g, or t
  modified_base (558)..(560): a, c, t, g, unknown or other
  misc_feature (558)..(560): n is a, c, g, or t
  modified_base (562)..(564): a, c, t, g, unknown or other
  misc_feature (562)..(564): n is a, c, g, or t
  modified_base (566)..(573): a, c, t, g, unknown or other
  misc_feature (566)..(573): n is a, c, g, or t
  modified_base (575)..(580): a, c, t, g, unknown or other
  misc_feature (575)..(580): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacagcccccaaactcatcatttatgaggtcagtaatcggccctcgaggggtttctaatcgcttctctggctccaagtctggcaacacggcctccctgaccatcctcgtgggctccgagctgacggacgaggctgatttattacngcagtctatgtttagactaatcgaggttcgaacggtctttagtcgttacgttacgggaagttcgggaacctaaggtcacgttccggtacttacggtcaaccgtccccgaaacgggtacccctaaaaccccgtgttacgtacctaaccgtttcccgtccgtttaccccccggcccttccgtacctaccgtaacggtccgtaccggtaccgtaggtacgggtccgggtcgacggacgtaacgggcgaccgtaagtcggatcagtcgngcnncngcncngnnncnnncnnnnnnnncnnnnnn

SEQ ID NO: 233971 - DNA, 640 bp, Homo sapiens
  misc_feature: GYAE6OF02HW84N.39.86.H09.1.454.CMB.1.raw
  modified_base (306)..(306): a, c, t, g, unknown or other
  misc_feature (306)..(306): n is a, c, g, or t
  modified_base (503)..(503): a, c, t, g, unknown or other
  misc_feature (503)..(503): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacgagggtcctcgggcccagtcctgccctgactcaggctgcctccgtgtctgggtctcgtaggacagtcgatcaccatctcctgacactaggaaccagcagtgacggttggggtatgatatgtctcgtgtacagacaatactcagcacacgacccccaaatcatactatttangtagtcaagtacgtccggccctaggtacgggtttactaacgtcgtaccttctcgtacggtcctaccgtaagttccgtacggactaaaccgaccggtccccttccgacgtaaccctattcccgttaccgtcggggtacctcccggaagggtccgttagggaacgggtaacggtacggtctaaggttactttagttacncgtacgacgtctacttagttcgaactaagtcgaggtacgtaggtacttagttcggttacgtacggggtaaggtacggaaccgttaagggtcctaaggttcccgttacggtaacggtactaccgacccggtaaacccg

SEQ ID NO: 233972 - DNA, 645 bp, Homo sapiens
  misc_feature: GYAE6OF02FI1KR.39.86.H09.1.454.CMB.1.raw
  modified_base (318)..(318): a, c, t, g, unknown or other
  misc_feature (318)..(318): n is a, c, g, or t
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcgagtggacggttgggggttactggactatgtctcctggttaccagcaatatccaggccacaccgacccccaaactccatccagttttangacggttacaagtaacgtccggaccctcgtacggggtttctaagtcgtcttcgttcgtacggtcctacgaagtcgtcggaccaaccgaccggtccctcccgtacgacctacgttacctcggtcgggtcctccgacggtcgtaggacggacgggacgtccgttagttaacttacttacgtagtcgtagtccttacgtatttcgactaacgtctaaggttcgacggttactttagtcggttaccgttacgggtaacggtacgggtaaccgtaacggttacgtacgttcccggttaccggtacggtaccgtaccgtacccgtaaacccgg

SEQ ID NO: 233973 - DNA, 639 bp, Homo sapiens
  misc_feature: GYAE6OF02IULRD.39.86.H09.1.454.CMB.1.raw
  modified_base (269)..(269): a, c, t, g, unknown or other
  misc_feature (269)..(269): n is a, c, g, or t
  modified_base (307)..(307): a, c, t, g, unknown or other
  misc_feature (307)..(307): n is a, c, g, or t
tcagtcgcactagtcacgaccggtgctcgatttagtgctatagacttggggtttggggggtctcaggaggcagcgctctcaggacatctccaccatggcctggctctgctgctcctcaccctcctcactcagggcacagggtcctgggcccagtctgccctgactcaggctgcctccgtgtctgggtctctaggacagtcgatcaccatcctctgcacgtaggaccagcagtgacggttggggttatgactagtgtctcctcggtaccngtacaatatcagcacacgcccccaaatcatcatttacngagtactagtaactccggtaccctacgtagggtttactaagttccgctttctcttgggtaccttccgaaacgttcgtacgggctaaccgaccgtccctcccgtacgacctacgtcctcggtcggcctcgacggtccgacggtaggaccgtagggtaccttagacgtttacgtttaaccttcggacctaagtccttacgtaacgtttacggacgttactacggacgtacgggtaacgtacttacggttacggttcttaaccggggaagtttaccgggaccgtaacggttctaacgtcccgttagtaaccgtcgtaccgtaccgtaaacccggg

SEQ ID NO: 233974 - DNA, 845 bp, Homo sapiens
  misc_feature: GYAE6OF02H1O4A.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgctcctcacctcctcactcagggcacagggtcctgggcccagtctgccctgactcaggctgcctccgtgtcgtggtctctaggacagtcgatcacctatctcctgcactaggaaccagcagtgtacggttgggggttatgactatgtctccgtggtaccagacaatactccgacggcaaccgaccgaccccccaaacgtaccaattcctaattttacgtaggtaacggttaccgtaagttaactcccgggtcccccgttacggttaacgggggtttttacctaaacgttcccgttaccgtttccgtcgttacgggttaccctaacccgtaaggtttccgtacgggaacccgtaaaccgaccccggggtccccctttaccccgtaccggtaaacccctaacgtttccccgtttaccggttaccgggggtaccccttacccgggtaaacgggtcccggttacggggtaaaccgggggtaacccgggttaaccggggttccgttaacgggtttaaatttttaaccgtttaacggtacggtccgtaaacggtccgtttacgttaacgttttaaccgaccgttaaacgttccggtaaggtacggttaccgggtttacttttacggtttcggtttaccggtttaacggggtaacgggttacggggtaacccgtaaggttaccgtacggtttacccgttacgtaacgggtttaccgacccggtacccggtaaacccccgg

SEQ ID NO: 233975 - DNA, 640 bp, Homo sapiens
  misc_feature: GYAE6OF02H4UOH.39.86.H09.1.454.CMB.1.raw
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
  modified_base (322)..(322): a, c, t, g, unknown or other
  misc_feature (322)..(322): n is a, c, g, or t
  modified_base (361)..(361): a, c, t, g, unknown or other
  misc_feature (361)..(361): n is a, c, g, or t
  modified_base (370)..(370): a, c, t, g, unknown or other
  misc_feature (370)..(370): n is a, c, g, or t
  modified_base (382)..(382): a, c, t, g, unknown or other
  misc_feature (382)..(382): n is a, c, g, or t
  modified_base (431)..(431): a, c, t, g, unknown or other
  misc_feature (431)..(431): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtggtacggttgggggttataggtactagtcgtctccgtaggtaccagacaatactccaggcacacaccccaaatcatcattngtagtnaagtancgcctgtaggtttctatcgtcttcgctgctacgagtcgngaccgaacnccgtccctaccncgacctactccgtacgtcggtcctccgacggtcgtacgggacggtacgnggtacgtagttaatttacgtactcgacgtacgtaccttacttaacgtttcgaacgttaagttacgtacggttaaggacggtttacgtttacgtcggtttaccggttaacgggttaagggtccccggggtaaaacttaaccgggtacgttaaccgggttcccttaacccgggttagggtacccgtacccggaaccccgtaaacccccggg

SEQ ID NO: 233976 - DNA, 653 bp, Homo sapiens
  misc_feature: GYAE6OF02FOO7G.39.86.H09.1.454.CMB.1.raw
  modified_base (411)..(411): a, c, t, g, unknown or other
  misc_feature (411)..(411): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaatcatcatttatgagtcagtaatccggtccctcgtacggggtttctaagtccgtctttcctcgtggccttaccgaagttctaggacctaaaccgccggtccctcccgtggaacccctnttccgtacgtcgggacctccgaacgggtcctaggacgggaccgtacggtcttagtaactttacgttaccgtgacctacgtccttcgttaacgtttgactaagtacgtaggtcggtaacgttctttacgtcggtttacggttacgggtaaacgggttaccgggtaaccgttaacgggtccttaacggtttacccggttaccggttaacgggtccgtaaacccgggtacccgtaaacccccggg

SEQ ID NO: 233977 - DNA, 628 bp, Homo sapiens
  misc_feature: GYAE6OF02G5S7J.39.86.H09.1.454.CMB.1.raw
  modified_base (319)..(319): a, c, t, g, unknown or other
  misc_feature (319)..(319): n is a, c, g, or t
  modified_base (531)..(531): a, c, t, g, unknown or other
  misc_feature (531)..(531): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtcgtgggtctctaggacagtcgatccaccatcctcctgcactggaaccagcagtgtacggttgggggttatgacttatgtcctccgtggtaccagtcaatactccgaggcaccgaccgacccccaaactcatctatttagngagtcagtactccggtcctgtacggtttacaagtcgtcttctcgtggctacgtagtcgtcggaccaaccgtaccggtcccttcccgtacgaaccctactccgtccggtcgggtccctaccggacggtccgtagggacggacggtcggtctagtaatttaacgtcgtgacgtagtccttacgtatttcgactagttacgagtacggtacgttnttacgtcggtttaccggttaacgggtaaggttacgggtaaccgtacggtactaccggttccgtaccggtacggcgtacccggtacccggtaacccgg

SEQ ID NO: 233978 - DNA, 258 bp, Homo sapiens
  misc_feature: GYAE6OF02GDID4.39.86.H09.1.454.CMB.1.raw
  modified_base (249)..(258): a, c, t, g, unknown or other
  misc_feature (249)..(258): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggcccaaccccactgtcactctcgttcccaccctcctcactagtgcgactgagcgggctggcaaggcgcatagnnnnnnnnnn

SEQ ID NO: 233979 - DNA, 628 bp, Homo sapiens
  misc_feature: GYAE6OF02HFPHL.39.86.H09.1.454.CMB.1.raw
  modified_base (310)..(310): a, c, t, g, unknown or other
  misc_feature (310)..(310): n is a, c, g, or t
  modified_base (315)..(315): a, c, t, g, unknown or other
  misc_feature (315)..(315): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggaccccagtcgatcaccatctcctgcactggaaccagcagtgtacggttggggttatgactatgtctccgtggtaccagcaatatccgaggcacacgacccccaaaatcaatcatttangagtnagtaatccgcctgtagggttctaagtcgtcttctcgtcggtacctaccgtaagtccgtacggaccaaaccgaccggtcccttacccgtacgacctacttcgtccgtcgggtcctccgacggtcgtacggacggacggtaggtcctaggtaactttacgttacgtcgactacgtcttacgtatttcgacttaacttcgtaggtagtacgtacgtttagttacggttcgttaacgggtaacggttacgggtaacctaacgggtacctaacgttccggttaccgttaggtaccgtaccggtacccgtaaaccccgg

SEQ ID NO: 233980 - DNA, 657 bp, Homo sapiens
  misc_feature: GYAE6OF02J02MH.39.86.H09.1.454.CMB.1.raw
  modified_base (117)..(117): a, c, t, g, unknown or other
  misc_feature (117)..(117): n is a, c, g, or t
  modified_base (232)..(232): a, c, t, g, unknown or other
  misc_feature (232)..(232): n is a, c, g, or t
  modified_base (239)..(239): a, c, t, g, unknown or other
  misc_feature (239)..(239): n is a, c, g, or t
  modified_base (298)..(298): a, c, t, g, unknown or other
  misc_feature (298)..(298): n is a, c, g, or t
  modified_base (363)..(363): a, c, t, g, unknown or other
  misc_feature (363)..(363): n is a, c, g, or t
  modified_base (393)..(393): a, c, t, g, unknown or other
  misc_feature (393)..(393): n is a, c, g, or t
  modified_base (418)..(418): a, c, t, g, unknown or other
  misc_feature (418)..(418): n is a, c, g, or t
  modified_base (451)..(451): a, c, t, g, unknown or other
  misc_feature (451)..(451): n is a, c, g, or t
  modified_base (468)..(468): a, c, t, g, unknown or other
  misc_feature (468)..(468): n is a, c, g, or t
tcagtcgcactagtcacgaccggtgctcgatttagtgctatagacttgggttgggggtctcaggaggcagcgctctcaggacatctccaccatcggcctgggctctgctgctcctcncctcctcacgtcacgggcacacgggtccgtgggcccaacgtctcggccctgacctcgacggcctgccctccggtgtcgtgggtctctaggacagtcgatcaccatctcctgctcncggaacngtcgtagtcggtacggttaggggtttaatggaccttagtcgtccgttccgtagtaaccngtacaacgtatccgagacacgacctaccccaatccagttcctattactagacgtcgaagttaacnccggccgtacgtacggggttcaagtccgtnttccgttcgacggtctaacgattcncggtaccaacgtaccgtccttccacgtaccctntcgtcgtggaccgttcncggttacgttcggaacgggtaccgtaacggtcgtaacgtacctttagtaaccgtcgtacgtacctcgtaccttagggttaccacgttaacagtacgttagaaccgttcgttacgtgttacgggtaaccggagacgggttaacccacggtactcggttccgaccggttagacgtccggaaccaacccggg

SEQ ID NO: 233981 - DNA, 639 bp, Homo sapiens
  misc_feature: GYAE6OF02JJNIK.39.86.H09.1.454.CMB.1.raw
  modified_base (209)..(209): a, c, t, g, unknown or other
  misc_feature (209)..(209): n is a, c, g, or t
  modified_base (272)..(272): a, c, t, g, unknown or other
  misc_feature (272)..(272): n is a, c, g, or t
  modified_base (512)..(512): a, c, t, g, unknown or other
  misc_feature (512)..(512): n is a, c, g, or t
  modified_base (543)..(543): a, c, t, g, unknown or other
  misc_feature (543)..(543): n is a, c, g, or t
tcagtcgcactagtcacgaccggtgctcgatttagtgctatagacttgggtttgggggggggtcgtcgaggaggcagcgctctcaggacatctccaccatggcctgggctctgctgctcctcaccctcctcactcagggcacagggtcctggcccagtctgccctgactcaggctgcctcgtgtctggtctcgtaggcagtcgatcacntctcctgcactggaaccagcaggtgtacggtttggggtatgactagtcgtctcctggtaaccngacaatactaccaggacacgaccgaccccaaacgtacaacttcctaatttagacgtaggttacaaggttaacgtcccggtacccgttaggtaacgggtttcctaaacggtcgttccttacttcgtacggtaccttaccgtaaggttcgtacggaacaaccggcgtcccctccgtacgacctacgtctacggtcggacctcacgggtcagggaccggacggtagtctagtattacgtacgngtactaccgtataccttgttaccgacttaanggtaacgtgtacggtactttagttgtacgttacggtaggtacggaacgttacggacctaggttccgttaccgtaggtacccacggtccgaaaccgg

SEQ ID NO: 233982 - DNA, 576 bp, Homo sapiens
  misc_feature: GYAE6OF02FNGEU.39.86.H09.1.454.CMB.1.raw
  modified_base (306)..(306): a, c, t, g, unknown or other
  misc_feature (306)..(306): n is a, c, g, or t
  modified_base (355)..(355): a, c, t, g, unknown or other
  misc_feature (355)..(355): n is a, c, g, or t
  modified_base (423)..(423): a, c, t, g, unknown or other
  misc_feature (423)..(423): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcgtggtaccagcaatatccaggcacacgcccccaaatcatcatttangagtcagtatcggcctgtagggtttcagtcgtcttctcgtgctcagtcngcacacgtcctcctcgacatctcgtcggcctcgagctaggacggacgagtcgtagtattacgttacgngtcctaggtccttacgtagttttacgactaaacgttcgtaggtacgtacggttactttagtcggttacgtttacgggaacggttaccgggaaccgttaaggttcctacgttccggttacccgttagggtacccacggtaccccgtaaacccgg

SEQ ID NO: 233983 - DNA, 548 bp, Homo sapiens
  misc_feature: GYAE6OF02H3VSH.39.86.H09.1.454.CMB.1.raw
  modified_base (318)..(318): a, c, t, g, unknown or other
  misc_feature (318)..(318): n is a, c, g, or t
  modified_base (341)..(341): a, c, t, g, unknown or other
  misc_feature (341)..(341): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (375)..(375): a, c, t, g, unknown or other
  misc_feature (375)..(375): n is a, c, g, or t
  modified_base (388)..(388): a, c, t, g, unknown or other
  misc_feature (388)..(388): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatactccaggcacacgacccccaaatcatctattatgagtcagtanccgccctgtaggtttcaatcgtnttctctgctcagtcngcaacncgcctcctgaccntctcgcggctcgngctggaggcgaggctagtatttactacgtcgcagtcttactatttcgactaacttcgtagtacgagttactttagtcggttacggttacgggtaacggttcgggaaccgtaacggtcgtacgttccgttaccgtacggtaccacggaccccgtaacccgg

SEQ ID NO: 233984 - DNA, 679 bp, Homo sapiens
  misc_feature: GYAE6OF02IZ7AD.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatgactatgtctcctaggtaccagcaatatccgaggcacacgcccccaaatcatcatttatgagtcagtactcggcctagtacgggtttcaagtcgtacttctcgtcggactcctaagtcgtacggacctaaacgacccgggtccctcccgtacgaacccgtacttaccgtcgtcgggcctaccgacgggtaccgtacggacgggaacggtacgggtccgtttaggtaacttttaacgtttaccgtaggtacctaacgtccttaccgtaagtttcggaaccttaacgttacgtaacggttagtaacgggttacttttacgtcggtttaccggtttaaccggggtaaggtttaccggggtaaacccgttaagggtttaaccgtacgtttacccggtaccggttaacgggtacctacccggtaccccgtaaaccccggg

SEQ ID NO: 233985 - DNA, 582 bp, Homo sapiens
  misc_feature: GYAE6OF02F2PH9.39.86.H09.1.454.CMB.1.raw
  modified_base (320)..(320): a, c, t, g, unknown or other
  misc_feature (320)..(320): n is a, c, g, or t
  modified_base (428)..(428): a, c, t, g, unknown or other
  misc_feature (428)..(428): n is a, c, g, or t
tcagtcgcactagtcacgaccggtgctcgatttagtgctatagacttggggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggtatgactatgtctcctggtaccagcaatatccaggcacagacccccaaatcatcatttatgagtcagtaatcggccctnagggtttctaatcgctttctctggctccgtaagtctggacaacgacggccctccctgaccatcctcgtgggctccaggtctggaggacggaggctgtattacttacgncgagctactatttcgactaagttcaagtgaaggtctttaagttcgttaccgttacgggtaacggttacgggaacccgttaagggtacccttaagttcccgggttaccgtttaacgggtccgtaacggtaccccccggtaaaggtaacccccccg

SEQ ID NO: 233986 - DNA, 649 bp, Homo sapiens
  misc_feature: GYAE6OF02FPQV8.39.86.H09.1.454.CMB.1.raw
  modified_base (301)..(301): a, c, t, g, unknown or other
  misc_feature (301)..(301): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaatcatcatttangagtcagtaatcggcctgagggtttctaatcgcttctcgtggctccgaagtctggaccaaccgaccgtccctcccgtcgaaccctactcctccgtcgggtccctccgaggtcctaggacggacggaggcttaggtaactttacgttacctggaccgtacggtaccttaccgttaattttcggaaccttaacgttacgaaggttacggtaacggttcttttaacgtccggtttaccgggttaaccggggtaacgggtttacggggaaccccgttaagggttaccctaccggttacccggttacccggttaacgggtaccgtaaccccggtacccccgtaaaccccgggg

SEQ ID NO: 233987 - DNA, 637 bp, Homo sapiens
  misc_feature: GYAE6OF02GVRTH.39.86.H09.1.454.CMB.1.raw
  modified_base (313)..(313): a, c, t, g, unknown or other
  misc_feature (313)..(313): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctcgtgtctgggtctctaggcagtcgatcaccatctcctgcactgaaccagcagtgacggttggggttatgactagtgtctccgtgtaccagactaatactccaggcaacgaccgaccccctaaactcatctatttangtagtcagtacgtcgccgtgtaggggtttactacgtcgtcttccttcgtcggtcctaccgtaaggtccgtagtaccgaaacgtcccggcccttacccgtacgaccctacttccgtccgtcgggtcctaccgacggtcgtagggacggtacgtacgggtcctaggttaactttacttacgtcgacgtacgtaccgttactagttacgacctaagttccgtaggttacggtacgttacgttacgtgttaccggttagggaacggttcgggaaaccgtaggtactacgttccggtaccgtacggtacccgacgtacccgtaacccgg

SEQ ID NO: 233988 - DNA, 540 bp, Homo sapiens
  misc_feature: GYAE6OF02F1L5U.39.86.H09.1.454.CMB.1.raw
  modified_base (302)..(302): a, c, t, g, unknown or other
  misc_feature (302)..(302): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttangagtcagtaatccggccctgtaggggtttactaatcgtcttctcgtggctcaagtctggcaacgccggccctccctgaccatctcgtcgggcctccgaggtcgtggacggacgaggctagtattacttactgactagtcttctatttgactaagttcaggttgagttcttagtcgttcgttacggaaggtcgggacctaaggtctacgtcgtaccgtaggtaccacgacccgaaccgg

SEQ ID NO: 233989 - DNA, 699 bp, Homo sapiens
  misc_feature: GYAE6OF02J1H9C.39.86.H09.1.454.CMB.1.raw
  modified_base (275)..(275): a, c, t, g, unknown or other
  misc_feature (275)..(275): n is a, c, g, or t
  modified_base (295)..(295): a, c, t, g, unknown or other
  misc_feature (295)..(295): n is a, c, g, or t
tcagtcgcactagtcacgaccggtgctcgatttagtgctatagacttgggtttggggggggtcgtcaggaggcagcgctctcaggacatctccaccatggcctggctctgctgctcctcaccctcctcactcagggcacagggtcctgggcccagtctcgccctgactcaggctgcctccgtgtctgggtctcgtaggacagtcgatcaccactctcctgcactcggaaccagcagtgacgttggggtatgactatgtctctggtaccagcaatntccagcacacgaccccaaanctaatcctatttcgagtagtactaagtacgtcggtcctcgttacggggttactaacgtcgtacttcgtcgtcggcctcgaagttcgtcggacctaaccgtaccggcccttacccgtacgaccctacttaccgtccggtcgggccttacccgagggtccgtaggtacgggaaccggtaccggtcgtcgttaactttacgttaaccgtgtaaccgtcgttcccgtacttacgttttacgaacttaaacgttaccgtaagggttcggtaacgttccggtttacgtcggtttttccggttaaacggggtaaccggtttacggggtaaacccggtttaagggtaccgttacggtttacccggtaacccggtttacgggacccgtaccgggtaccccggttaaaccccgg

SEQ ID NO: 233990 - DNA, 649 bp, Homo sapiens
  misc_feature: GYAE6OF02IVBWC.39.86.H09.1.454.CMB.1.raw
  modified_base (222)..(222): a, c, t, g, unknown or other
  misc_feature (222)..(222): n is a, c, g, or t
  modified_base (299)..(299): a, c, t, g, unknown or other
  misc_feature (299)..(299): n is a, c, g, or t
tcagtcgcactagtcacgaccggtgctcgatttagtgctatagacttgggctggggtctcaggaggcagcgctctcaggacatctccaccatggcctgggctctgctgctcctcaccctctcactcagggcacagggtcctgggcccagtctgccctgactcaggctgcctccgtgtctgggtctctaggacagtcgatcaccatctcctgcactggaaccngcagtgacggttggggtatgactatgtctcctggtacagcaatatccaggcacacgacccccaactcatctatttangagtcagtaatccggcctacgtacgggtttctaagtccgtacttccgtcggccttaccgaacgttcgtcggaccaaccgaccgggtccctaccctacggaccctaactcctacgtaccgtacctcccgaggtaccgtaggaccgggacggtacggtcgttaggtacttaagtttagtacgactacggtacctagtaacttacgttaagtacgtaaagtactaagttacggttactacccgtgttaccgggtcgtttccgggttacgggaccgggtaaccggggtaacccgttaacgggttacccggtaacccggttacccggttagggtaccccgtaggtaacccccggg

SEQ ID NO: 233991 - DNA, 592 bp, Homo sapiens
  misc_feature: GYAE6OF02IWHH3.39.86.H09.1.454.CMB.1.raw
  modified_base (305)..(305): a, c, t, g, unknown or other
  misc_feature (305)..(305): n is a, c, g, or t
  modified_base (377)..(377): a, c, t, g, unknown or other
  misc_feature (377)..(377): n is a, c, g, or t
  modified_base (386)..(386): a, c, t, g, unknown or other
  misc_feature (386)..(386): n is a, c, g, or t
  modified_base (391)..(391): a, c, t, g, unknown or other
  misc_feature (391)..(391): n is a, c, g, or t
  modified_base (446)..(446): a, c, t, g, unknown or other
  misc_feature (446)..(446): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctcctgcactggaaccagcagtgacgttggggtatgactatgtctcctggaccagctaatctccaggcacacgacccccaaactcactctatttanagacggtcaagtaatccggtaccctcgtaggggtttctaagtcgtaccttctcgtgctcaagtctgacaacnccgcctccncgacnctctcgtcggtctacgcgtcgtagacggacgtaggtcttagtaactttattacgngtacacgtaccttacttacgtttcgactaactgtaaggttagacggttactttagttcgttccggttaacgggtaaggtacgggtaaccgttaaggtcgtaacgttccgggttacccgtaggtccgaaccggtaccctaacccggg

SEQ ID NO: 233992 - DNA, 716 bp, Homo sapiens
  misc_feature: GYAE6OF02HGIPI.39.86.H09.1.454.CMB.1.raw
tcagtcgcactagtcacgaccggtgctcgatttagtgctatagacttggggggggggggtctcaggaggcagcgctctcaggacatctccaccatggcctgggctctgctgctcctcaccctcctcactcagggcacagggtcctcgggcccagtctcgccctgactcaggctcgcctccgtgtcgtgggtctcgtaggacagtcgatccaccatcctcctgcacgtagaaccacgctaggtggtacgggttgggggttaatcggaacttagtcgtcctccgtacggtaccagactaatacgtaccgaggacccaacgaaccccgaacccccaaactccaacttaccttattttacgcgggtagtacgaaggttaacctccgggtaccccttgggttaacgggtttacttaacgtcgttctttccgtcgtacgccttaccgtaaggttccgtacggaccaaccgtacccggtccctacccgtacgtaacctacttccgtccgtcgggtacctccggacggtcgtagggacggacggaggtaccttaaggtactttaccgtagtcgacgtacgtcttacttagttcaacgtacttcgtaaggttcggtagttacgttaggttcggttacggtaacgggtacgggttaaccgacggttacgtaacgtcggttacccgttcggtacggtaccgtacccggaccctacccggtaaccccg

SEQ ID NO: 233993 - DNA, 606 bp, Homo sapiens
  misc_feature: GYAE6OF02GU3Y3.39.86.H09.1.454.CMB.1.raw
  modified_base (245)..(245): a, c, t, g, unknown or other
  misc_feature (245)..(245): n is a, c, g, or t
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
  modified_base (437)..(437): a, c, t, g, unknown or other
  misc_feature (437)..(437): n is a, c, g, or t
tcagtcgcactagtcacgaccggtgctcgatttagtgctatagacttgggggggggggtctcaggaggcagcgctctcaggacatctccaccatggcctgggctctgctgctcctcaccctcctcactcagggcacagggtcctgggcccagtctgccctgactcaggctgcctccgtgtctgggtctcgtaggacagtcgatcaccatctcctgcactggaaccagcagtgacggttggggtangactatgtctctggtaccagctaatntccaggcacacgacccccaaatcatctatttangacggtacagtaacgtccggtccctcgtaggggtttctaacgtcgtctttctcgtggcctacaagtctcgaccaaccgccggcccttccgcgacctctcctcgtgggcctacgaggtcgtaggacggaccggnggtccttagtaatttacgtactgctacgttcctacttagtttcgacttaatacgtagtcggtacgtactttacgtagttacggttacgggtaacggtacgggttaaccgtaacgtccgtaagttcccgttacggttacggtccaacggtaccccgtaacgtaacccccg

SEQ ID NO: 233994 - DNA, 274 bp, Homo sapiens
  misc_feature: GYAE6OF02I5MGR.39.86.H09.1.454.CMB.1.raw
  modified_base (247)..(274): a, c, t, g, unknown or other
  misc_feature (247)..(274): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaacccaactgtcactctgttcccaccctcctcactagtgcgactgagcgggctggcaaggcgcatagnnnnnnnnnnnnnnnnnnnnnnnnnnnn

SEQ ID NO: 233995 - DNA, 683 bp, Homo sapiens
  misc_feature: GYAE6OF02IP8AA.39.86.H09.1.454.CMB.1.raw
  modified_base (307)..(307): a, c, t, g, unknown or other
  misc_feature (307)..(307): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggtatgactatgtctcctggtaccagcaatactccaggcacacgacccccaaatcatctatttanagacggtacagttaactccggtccctacgtaggggtttactaagtccggtactttccgtcgttcggaccttaccgtaaacgttccgtacgggaccctaaccgaacccgggtccctacccgtaccggaccctaacgttccgttccgtacggggtccctaccggtaacggtcggtacggacgggtaaccggaggggtcctttaggtaaacttttaacgtttacggtccgtaccgtaacgtccctttaacgtacgtttacgactaacgtctacggttaggaacgttcttagttcggttacgttaacgggtacggtacgggtaaccgtaacgtactacgttccggtacgttacggaccgttaccgacccgtaaacccggg

SEQ ID NO: 233996 - DNA, 703 bp, Homo sapiens
  misc_feature: GYAE6OF02GBXCV.39.86.H09.1.454.CMB.1.raw
  modified_base (167)..(167): a, c, t, g, unknown or other
  misc_feature (167)..(167): n is a, c, g, or t
  modified_base (246)..(246): a, c, t, g, unknown or other
  misc_feature (246)..(246): n is a, c, g, or t
  modified_base (308)..(308): a, c, t, g, unknown or other
  misc_feature (308)..(308): n is a, c, g, or t
  modified_base (336)..(336): a, c, t, g, unknown or other
  misc_feature (336)..(336): n is a, c, g, or t
tcagtcgcactagtcacgaccggtgctcgatttagtgctatagacttggggggggggtcgtcaggaggcagcgctctcaggacatctccaccatggcctgggctctgctgctcctcaccctcctcactcagggcacagggtcctgggcccagtctgccctgaccctnaggctgcctcgtgtctgggtctctaggacagtcgatcaccatcctcctgcactggaaccagcagtgacggttggggtangactatgtctcctggtaccagcaatatccaggcactacgacccccaaactcatccatttagngtaggtcaagttaacgtccggcccttanacggggttttactaaacgttccgctttctcgttcggtctaccgtaaagttcgtcggacaaaccgaccgggtccctcccgtacggaacctaactccttcgtcgggtcctccgacggtcgtacgacgggtacggacggttctaggtaatttacttaacgtgacctaggtccttacgaactttacgttacgtaaacggtacaagtttaaaccgtaaccgtttacggtttacccgtttttcggggaaccgggtaacgggggtaacccgttaaacgggtcccgttaaccggtacccgggtttacccgttaacgggttcccgtaaccggtaaccccgtaacgggttacccttccccgggttaacccccccggg

SEQ ID NO: 233997 - DNA, 607 bp, Homo sapiens
  misc_feature: GYAE6OF02HY2EX.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctccgtggtaccagcaatactccaggcacacgaccccccaaactcatctatttactgaggtcagtaagtccggccctcgtacgggtttacaatcgtcttctcgtcggctacaagtctacggccaaccgccgtccctcccgtacgaccctattccgtcgtcgggtcctccgtacggtcgtcggaacgggaccggacggcttaggttaatttacgttactcgtacgtagtccttacgtactttcgacctaattcgaggtcgtaggttctttagtcggttacgtacggtaaggttcgggaaccgttaaggtctacgtcggttaccgtaggtaccaccggtacccgtaacccgg

SEQ ID NO: 233998 - DNA, 589 bp, Homo sapiens
  misc_feature: GYAE6OF02G8THT.39.86.H09.1.454.CMB.1.raw
  modified_base (303)..(303): a, c, t, g, unknown or other
  misc_feature (303)..(303): n is a, c, g, or t
  modified_base (390)..(390): a, c, t, g, unknown or other
  misc_feature (390)..(390): n is a, c, g, or t
  modified_base (445)..(445): a, c, t, g, unknown or other
  misc_feature (445)..(445): n is a, c, g, or t
  modified_base (449)..(449): a, c, t, g, unknown or other
  misc_feature (449)..(449): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatgactatgtctctggtacagcaatataccaggcacacgacccccaaatcatactatttangagtcaagtactcggccctgtagggtttactaagtcgtcttctcgtgcctccaagtctggaccaacgaccggcccttcctacgaccngtcctcgtacgggcctccgacggtctacgggaggacgacggtctagtattactcngacngtcctatagtttagactaacgtcgtaggtacggtagtacttagttccggttacggttaacgggtaacgggttacgggaaccgtaagggttacctaacggttccggtaccggttacgtacggtaccggacccgtaacccgg

SEQ ID NO: 233999 - DNA, 518 bp, Homo sapiens
  misc_feature: GYAE6OF02FIO4S.39.86.H09.1.454.CMB.1.raw
  modified_base (239)..(239): a, c, t, g, unknown or other
  misc_feature (239)..(239): n is a, c, g, or t
  modified_base (363)..(363): a, c, t, g, unknown or other
  misc_feature (363)..(363): n is a, c, g, or t
  modified_base (376)..(376): a, c, t, g, unknown or other
  misc_feature (376)..(376): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggngcttataattatgtctccttggttccaacagcattcaggcagccgccccgaaacttcttaatttatgaggtctttcgtcggccctcgtaggggttctagtcgcttctcgctcagtctggcaacncgcctcctgaccntctctagactccaggctgaggacgaggctgactattacttgcagctcatatactgaagtcaatggtataccgacgtggtctggtcggcggagggacctagttcgtaccgtccgtaggtaccgacgcccgtaggccgtcccgg

SEQ ID NO: 234000 - DNA, 581 bp, Homo sapiens
  misc_feature: GYAE6OF02FXQEI.39.86.H09.1.454.CMB.1.raw
  modified_base (223)..(223): a, c, t, g, unknown or other
  misc_feature (223)..(223): n is a, c, g, or t
  modified_base (322)..(322): a, c, t, g, unknown or other
  misc_feature (322)..(322): n is a, c, g, or t
  modified_base (383)..(383): a, c, t, g, unknown or other
  misc_feature (383)..(383): n is a, c, g, or t
tcagtcgcactagtcacgaccggtgctcgatttagtgctatagacttgggctggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacggttgggggttatgactatgtctcctggtaccagcaatatccaggcacacgcccccaaactcatctatttatgagtcagtaatccggcctntagggtttactaagtcgtcttctctcggctcagtctggcaacaccggccctcctcgacctntcctcgtcggtcctccgaggcctaggacgggacgacgggtctagtaatttactacgtgcacggtctacgtaagtttcgaactaactcgtaaggttacgagggttctttaagtcggtttccggttacgggtaacgggtcgggtaaccgtaaggttctaccggttaccggttaccgttacgggtccaacggtacccccgg

SEQ ID NO: 234001 - DNA, 252 bp, Homo sapiens; identical to SEQ ID NO: 233545
  misc_feature: GYAE6OF02FJ473.39.86.H09.1.454.CMB.1.raw
  modified_base (247)..(252): a, c, t, g, unknown or other
  misc_feature (247)..(252): n is a, c, g, or t

SEQ ID NO: 234002 - DNA, 657 bp, Homo sapiens
  misc_feature: GYAE6OF02JAB1R.39.86.H09.1.454.CMB.1.raw
  modified_base (324)..(324): a, c, t, g, unknown or other
  misc_feature (324)..(324): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctcgccctgactcagctgcctcgtgtctgggtctcgtaggactagtcgatcaccatctcctgcactcggaaccagcagtggacggttgggggttatgactagtcgtctccgtgtaccagctaatactccaggacctaccgaccgaccccctaaactcaactactaatttagngtaacggtctaagtacgtccggccctacggtagggtttacctaagttccgtacctttctccgttacggaccttacgtaacgtccgtaggaccctaacggtacccgccctttacccgacgtaaccctagttccgtaccggttcgggtacctccgacggtcgtaggacgtaacggtcggtactagtatttaactcgtacgctaacgttctactagttcacctaatcgagtacgtagttcttagtcggttacggttaacggtaacggtacggaacccgtaggtaccgttacgttccccggtagttaaccgggtccaaccgggtaccctaaacccgg

SEQ ID NO: 234003 - DNA, 658 bp, Homo sapiens
  misc_feature: GYAE6OF02HVBHO.39.86.H09.1.454.CMB.1.raw
  modified_base (527)..(527): a, c, t, g, unknown or other
  misc_feature (527)..(527): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcaggcacagggtcctgggcccagtctgccctgactcaggctgcctccgtgtctgggtctctaggacagtcgatcaccatctcctgcactggaaccagcagtgacggttgggggttatgacgtatgtctcgtaggtaccagacaaatactaccaggacaaccgacgaccccccaaaatccaatacctaatttagtggtacggtacaagttaactccgggtacccttacggtagggggtttacctaaagttcggtccttagttccgtggtacttacccgaaagtttcgacggaccaaaccgaccgggtccccttaccgacgaccctattccgttacggtcgggtcctaccgaacgggtctagggaacggaaccgacgggttctacggtaatttacgttaacncggtacacgtctactagtttacgactaatcgaggttagacgtacttaggtcgtttaccggtacggaacggttcgggaacctaagggtctacggtcggtaccgttaagggtacaccgggtacccaaacccgg

SEQ ID NO: 234004 - DNA, 746 bp, Homo sapiens
  misc_feature: GYAE6OF02JLU74.39.86.H09.1.454.CMB.1.raw
  modified_base (128)..(128): a, c, t, g, unknown or other
  misc_feature (128)..(128): n is a, c, g, or t
  modified_base (141)..(141): a, c, t, g, unknown or other
  misc_feature (141)..(141): n is a, c, g, or t
  modified_base (335)..(335): a, c, t, g, unknown or other
  misc_feature (335)..(335): n is a, c, g, or t
tcagtcgcactagtcacgaccggtgctcgatttagtgctatagacttgggtttggggggggtactcaggaggcgagcgctctcaggacatctccaccatggccgtggctctgctgctcctcaccctcncactcaggcacgnggtcctcggcccagtctgccctgactcgagctgcctcgtgtcgtggtctcgtaggcagtcgatcaccatcctccgtgactacgtcggaacctagcctagtaggtacgggtttggggtatcgtacgttagtgttcctcgtcggaccagacaatacgtcgacggcaccgaccgaccccaacgtcactctactttanacggtagtcgaagtaacgccgtaccgtcggtacggtttactaacgtccgttacttacgtcgtacgtacctaccgtaaagtccgtaccgaaccgtaaccccgtacccggtaccccgtttaccccgtaaccgacccttaccgttccgttacccgggtaccggtaccccttacgggacggttcggtaaccgggaccggtaaccggcggtaccgttaaagttacgttaacgtttccgcggtacgtaaccggtccttacgttaccgtttgtaacccgttaagttccggaaggttaccggtacgttacctttagtttccggtaacggtttaacgggtaacgggtaccgggtaccgttaaccggttactacgttcccggtaaccggtcggtaaccggaccggtaccccgtaaccccgg

SEQ ID NO: 234005 - DNA, 739 bp, Homo sapiens
  misc_feature: GYAE6OF02HWZHQ.39.86.H09.1.454.CMB.1.raw
  modified_base (251)..(251): a, c, t, g, unknown or other
  misc_feature (251)..(251): n is a, c, g, or t
tcagtcgcactagtcacgaccggtgctcgatttagtgctatagacttgggtttggggggggtctcaccggaggcagcgctctcaggacatctccaccatggcctgggctctgctgctcctcaccctcctcactcagggcacagggtcctgggcccagtctcgccctgactcaggctgcctccgtgtctgggtctctaggacagtcgatcaccatctcctgcactggaaccagcagtgacggttggggttangactatgtctcgtggtaccagcaaatactaccgaggacacgacgacccccaaactcaactctaatttatgaggtacagtaacgttccgcccgtagtacggggtttactaacgtcgtcttcgtcgtcggtctacctaacgtctcggaccaaacgaccggtcccttacccgtacgtaaccctaacgttccgtttccgtacgggtacctaccgtacgggtaaccgttagggaaccgggtaaaccggaaccggggttacctaagggtttaaacctttaacgtttaaccgtaggtaccgaacggttcccttacgtaacgtttttacggaaccttaaaacgttccgtaaaggttacggaacggtttacgtttaacggtcgttttaaccggttacgggggtaaaacggttccggggtaaaccggttaaaccggttcgtaacgtttaccgggttaccggttaagggttacccaacccggacccgtaaaaccccggg

SEQ ID NO: 234006 - DNA, 869 bp, Homo sapiens
  misc_feature: GYAE6OF02IR7TJ.39.86.H09.1.454.CMB.1.raw
  modified_base (202)..(202): a, c, t, g, unknown or other
  misc_feature (202)..(202): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcgagggcacgagggtccgtgggcccagtctcgccctgactcaggctcgcctccgtgtcgtgggtctcgtaggacngtcgactcaccattcctcctcgacctacgtacggaaaccaggccgtaggttacgggtaacggggtttggggggttaattacggtaacttaacgtcgttccgttcccgttacggtaaccgaaggtacctaaatacgtccggaacggtccaaccgacccgtaacccccctaaaactaccgtacttaaccgttaagtttttaccgagggtaacggttaccgtaaacggtttaaccggttcccggacccggttttaaccgggttaacggggtttttaacctaaccggtccgtttaccgtttccgtttacgttccgggtaccttaaccgtaacggttcgtaaccgggacctaaacccggtacccgtcccccttaccggtaccctaaccctaacgtttccccggttacgtacccggggttacccgtaccgggtaacgggttcccggtaagggtaaccgggtaacgggttaaccggtcgtttaacgttaaacgtttacgttaacgcggtacgtgttacccgttcgtttaagtttaccgaacttaagtaccgtaaggttacgtacgttacttacgtttcgttaacggttaggtaacgggtaccggtaacgttaacggttacctaacggtttccggttaaccggtagtacccggaacccgtaaccggtaaaccccg

SEQ ID NO: 234007 - DNA, 510 bp, Homo sapiens
  misc_feature: GYAE6OF02GYF47.39.86.H09.1.454.CMB.1.raw
  modified_base (372)..(372): a, c, t, g, unknown or other
  misc_feature (372)..(372): n is a, c, g, or t
  modified_base (388)..(388): a, c, t, g, unknown or other
  misc_feature (388)..(388): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctccgtggtaccagcaatatccaggcacacgacccccaaactcatctatttatgagtcagtaactcggccctgtacgggttactatcgtcttctctgctcagtctgacacgcgcctccngacactctctggctcnggctggacgacggagctgtattactatgcagtctctatataacagtcagtcagctacgttcgttggtggtagttcgggacggtacggacgacggcgtcggaccgtccgtacggtcgtaccgg

SEQ ID NO: 234008 - DNA, 614 bp, Homo sapiens
  misc_feature: GYAE6OF02FXX0T.39.86.H09.1.454.CMB.1.raw
  modified_base (266)..(266): a, c, t, g, unknown or other
  misc_feature (266)..(266): n is a, c, g, or t
  modified_base (303)..(303): a, c, t, g, unknown or other
  misc_feature (303)..(303): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctcctgcactggaaccagcagtgacggttgggggttatgactatgtctcctggtaccngcaatatccaggcacacgcccccaaatcatcatttangagtcagtaactcggccctcgtagggtttctaagtcgtcttcgtctggcctaccgtaagtctcggaccaaacgtacccgggtccctccccgtacgaaccctagttccttacgtcgggtcctccgagggctagggaacggacggacggtcttaggtaactttacgttacctgtacgtacgtaccttacgtatttacgacttaagtcgtacggtagaggttaccttagtcgttacggtttacgggaaggttacgggaaccgttaaggtactacgttccgttaccgtaggtacccgacgacccgtaaaccccgg

SEQ ID NO: 234009 - DNA, 689 bp, Homo sapiens
  misc_feature: GYAE6OF02IFG9C.39.86.H09.1.454.CMB.1.raw
  modified_base (312)..(312): a, c, t, g, unknown or other
  misc_feature (312)..(312): n is a, c, g, or t
tcagtcgcactagtcacgaccggtgctcgatttagtgctatagacttgggggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctcctgcactcggaaccagcagtgacggttggggttatgactatgtctcctggtaccagctaatactccaggcacaccgacccccctaaactcatctatttangtagtacaagtaactccggtccctacgtagggttactaactcgtctttctcgtcggtactacgaagtcgtgaaccaaccgaccgtcccttcccgtacgaacccctacgttcccgtcggttcgggccttaccggtacggtcctacgggtaacgggacggaggtcgttagtaactttacgttacgtcggactacgccttaacgtactttacgacttaacgttacgtaaggtacgtcggttaacttacgttcggttaccggtttacggggtaacggtaccggggtaaacccttaacgggttaccgttaaccggttcccggtttaacccggttaacgggttaccctaaccgggtacccccgtaaccgggtaaacccccccg

SEQ ID NO: 234010 - DNA, 505 bp, Homo sapiens
  misc_feature: GYAE6OF02FJSMB.39.86.H09.1.454.CMB.1.raw
  modified_base (360)..(360): a, c, t, g, unknown or other
  misc_feature (360)..(360): n is a, c, g, or t
  modified_base (452)..(452): a, c, t, g, unknown or other
  misc_feature (452)..(452): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctctggtaccagcaatatccaggcacacgacccccaaatcatcatttatgagtcagtaatcggcctcgtagggttctaatcgcttctctgctcaagtctgcacncggcctccctgaccatcctgtcgggtcctccgagctggaggacgaggctgtattacttactgactagctctagtttgactaatcagtgagtnttatgtcgttaggagtcggaccagtcagttcgtcgtagcgtacgaccgaacgg

SEQ ID NO: 234011 - DNA, 696 bp, Homo sapiens
  misc_feature: GYAE6OF02H641Q.39.86.H09.1.454.CMB.1.raw
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtctggtctctaggacagtcgatcaccatctcctgcactggaaccagctagtgacggttgggggttatgacttatgttcctccgtcggtaccagacaattactaccgaggaccaacccaaccccgaaccccctaaactacctaacttactttaacgtttaacgtaggtacggtacgtaacgttaaccgtcccggtaccgttacggttacgggtttactaacgtccttcgttctcgtcggtacctacgtacgttcgacgaccgtaccgtacccgtccctaccgtacgacctcgtccgttcggtccggtcctacggacggtcgtagggtaaccgacggtacgtactaagtttacgttacttacggacgtccgtacgttaccttacttacgtttcgaaacttacgtacgtaggacgttacgtttctaggttacgttacgggtaacggtaagggtacggtaaacgtacggttccgtacgtaccgttaccggtacgtacgtacccggacccgtaacccg

SEQ ID NO: 234012 - DNA, 755 bp, Homo sapiens
  misc_feature: GYAE6OF02F9Q07.39.86.H09.1.454.CMB.1.raw
  modified_base (228)..(228): a, c, t, g, unknown or other
  misc_feature (228)..(228): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtcgtgggtctctaggacagtcgatcaccatcctctcgcactacggaaccngcaggtcggtacgggtttgggggttatacgtactacgtgttccgtccgtacggttaccagtactaaattcctaccgaaggtccaaccgaacccgaaccccccgtaaaacttcctaacttaccttaagttttaacgacggtaacggttaactaaggttaaccgtccccgggtaccccgtttggttaaccgggggttttaccttaacgttccgttcctttaccgttccgtcggtaccttaccgtaagttccgtacggaccgtaaccgcccggtacccttacccgtacgacccttacgtaccgttccggtccgggtacctccgtacggtcgtacggaacggcgggtacgtacgttgttaacttctacgtccgtactacggtacttacgttagttccgtaactaacgtcgtaggttacgttacgtcgtttagtcggttaccggttacgggtaaggtaccggtaaaccgtacggttaccgttacggtaccggttaccggttaccggaccgtacccggaacccgtaaccccgg

SEQ ID NO: 234013 - DNA, 256 bp, Homo sapiens
  misc_feature: GYAE6OF02GWE5K.39.86.H09.1.454.CMB.1.raw
  modified_base (248)..(256): a, c, t, g, unknown or other
  misc_feature (248)..(256): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctcgttcccgccctcctcactagtgcgactgagcgggctggcaaggcgcatagnnnnnnnnn

SEQ ID NO: 234014 - DNA, 436 bp, Homo sapiens
  misc_feature: GYAE6OF02IIYDG.39.86.H09.1.454.CMB.1.raw
  modified_base (159)..(159): a, c, t, g, unknown or other
  misc_feature (159)..(159): n is a, c, g, or t
  modified_base (279)..(279): a, c, t, g, unknown or other
  misc_feature (279)..(279): n is a, c, g, or t
  modified_base (357)..(357): a, c, t, g, unknown or other
  misc_feature (357)..(357): n is a, c, g, or t
  modified_base (373)..(373): a, c, t, g, unknown or other
  misc_feature (373)..(373): n is a, c, g, or t
  modified_base (384)..(384): a, c, t, g, unknown or other
  misc_feature (384)..(384): n is a, c, g, or t
  modified_base (407)..(407): a, c, t, g, unknown or other
  misc_feature (407)..(407): n is a, c, g, or t
  modified_base (413)..(436): a, c, t, g, unknown or other
  misc_feature (413)..(436): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacagcccccaaatcatcatttangaggtcagtaatcggccctcaggggtttctaatcgcttctctggctccaagtctggcaacacggcctccctgaccatctctgggctcaggctgaggacgaggctgattatactgcagctnatttgcaatcagtgagtcttatgtcttcggaagtcgggacctaggtcatcgtcctaggtcacgccaaggcccaacccntcgcactctcgtcccncctctcatcgngcactgacgcggctggacaggcnagtagnnnnnnnnnnnnnnnnnnnnnnnn

SEQ ID NO: 234015 - DNA, 591 bp, Homo sapiens
  misc_feature: GYAE6OF02H0PET.39.86.H09.1.454.CMB.1.raw
  modified_base (301)..(301): a, c, t, g, unknown or other
  misc_feature (301)..(301): n is a, c, g, or t
  modified_base (400)..(400): a, c, t, g, unknown or other
  misc_feature (400)..(400): n is a, c, g, or t
  modified_base (436)..(436): a, c, t, g, unknown or other
  misc_feature (436)..(436): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatctccaggcacacgaccccaaatcatctattangagtcaagtaactcggtcctgtaggtttcagtctcttctctgctacaagtctggacctaacgccggcctcccgtagaccctatcgtcgtcgggctccgngtcgtaggaggtacgtaggtctagtaatttcgtacngaccgtagtccttacttagtttccgacttaatcggagttcggtacgttacgtttacgttcggttccggttaacgggtaacggttacgggaacccttaaggtaccgttacgttacccggttaccgtaacgggtactacccgtaaccgtaacccggg

SEQ ID NO: 234016 - DNA, 631 bp, Homo sapiens
  misc_feature: GYAE6OF02GQCDY.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatggactatgtctcctggtaccagcaatatccaggcacacgcccccaaaactcatcatttatgagtcagtatccggcctgagggtttcaatcgtcttctcgtggtcctaccgtaagttccgtcggacaaccgtaccgggccccttaccgtacgaccctacttccgtccgttcgggccttaccgagggtctacgggacgggacggacggtcgttagttacttaactttaccgcgtaccgtagtccttagtacgttttgaccttaagtccgtaaggtacgtacgggttctttaggttcgtttacggttaacgggtaacggttacggggaacccgtaaggttccgtaagttcccgggttaccttagggtaccctacggacccgtaacccgg

SEQ ID NO: 234017 - DNA, 672 bp, Homo sapiens
  misc_feature: GYAE6OF02G8H4R.39.86.H09.1.454.CMB.1.raw
  modified_base (208)..(208): a, c, t, g, unknown or other
  misc_feature (208)..(208): n is a, c, g, or t
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (307)..(307): a, c, t, g, unknown or other
  misc_feature (307)..(307): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacgagggtcctgggcccagtctcgccctgactcaggctgcctccgtgtctgggtctctaggacagtcgatcaccntcctcctgcactggaaccngcagtgacggttggggtangactntgtctcgtggtaccagcaatactccaggcacaccgaccccaaatcatctatttagnggagtcagtacgtccgcctggtagggttactacgtcgtcttactcgtcggacctcgtagtccgtacggacctaaccgccggtcccttacccgacggtaaccctacgttccggtccgttaccggggccttaccgggaacgggtcgtagggtaaccggaacggtacgggttacctaggttaactttaacgtcgttacgacgtacgtccgttacgttacgtttacgacgtaacgttcggtacggttacggacggtttacttaggtttaccgttacggggttaacggtacgggttacggggtaacccgtaaaggttcaaccggtttccggttaaccgtacgggttaccacccgggtacccaaccccggg

SEQ ID NO: 234018 - DNA, 594 bp, Homo sapiens
  misc_feature: GYAE6OF02F24B5.39.86.H09.1.454.CMB.1.raw
  modified_base (249)..(249): a, c, t, g, unknown or other
  misc_feature (249)..(249): n is a, c, g, or t
  modified_base (306)..(306): a, c, t, g, unknown or other
  misc_feature (306)..(306): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttangactatgtctcctggtaccagcaatatccaggcacacgccccaaatcatctatttangagtcagtactcggccctgtaggggtttactaagtcgtcttctcgtcggtcctaccgaagtctaggaccaaccgtaccggtccctcccgtacgacctacgtcctcgtcgggcctccgacgggtctagggacggtacggaggtctagtaatttacttacgtcgactacgtcttacgtatttcgactaacgtcgaggtgtacggttcttagtcgttacggttacgggaaggttacgggaaccttaggtctacgttccggtaccgttaggtccacggaccccgtaacccgg

SEQ ID NO: 234019 - DNA, 709 bp, Homo sapiens
  misc_feature: GYAE6OF02H71PX.39.86.H09.1.454.CMB.1.raw
  modified_base (206)..(206): a, c, t, g, unknown or other
  misc_feature (206)..(206): n is a, c, g, or t
  modified_base (333)..(333): a, c, t, g, unknown or other
  misc_feature (333)..(333): n is a, c, g, or t
  modified_base (531)..(531): a, c, t, g, unknown or other
  misc_feature (531)..(531): n is a, c, g, or t
tcagtcgcactagtcacgaccggtgctcgatttagtgctatagacttggggggggggtctcaggaggcagcgctctcaggacatctccaccatggcctgggctctgctgctcctcaccctctcactcagggcacagggtcctgggcccagtctcgccctgactcaggctgcctccgtgtctgggtctctaggacagtcgatcacgntcctctgcacgtacggaaacctgactaggtcgtaagggtttgggggttatggtaactagtcgtctacctggtaaccagacaaagtactacgacggcaaccacgtaaccccaaactcatcgtattagngacggtcaagtaacgtccggcccttaggtacggttttacaacgtcgtccttcgtcgtcggtcttaccaagttcgtagaccgaaacccgcggtaccctacctacgtaacctacgttccgttacgtccggtccgtaccgtacggtacgttacgggtaacggaacgtacgggtacttacgggttaactttaacgtaacgtnaaccggtcgtactacgtttacgttacggaacttaacgtactaacggttacgtaaggttaccgttagttccgggtttacgtaacggggtaaacggtcggtaaacccggtaacgttacgtaaccgttccggttaaccgttccggttaaccgaaccggttacccgaaacccgtaaccccgg

SEQ ID NO: 234020 - DNA, 671 bp, Homo sapiens
  misc_feature: GYAE6OF02JQT2E.39.86.H09.1.454.CMB.1.raw
  modified_base (197)..(197): a, c, t, g, unknown or other
  misc_feature (197)..(197): n is a, c, g, or t
  modified_base (230)..(230): a, c, t, g, unknown or other
  misc_feature (230)..(230): n is a, c, g, or t
tcagtcgcactagtcacgaccggtgctcgatttagtgctatagacttgggtttggggggggtctcaggaggcagcgctctcaggacatctccaccatggcctggctctgctgctcctcaccctcctcactcagggcacagggtcctgggcccagtctgccctgactcaggctgcctcgtgtctgggtctctaggacngtcgatcgacatctccgtgctacgtacgaaccngacagtgacggttggggtactgatatgtctccgtgtacagcaatctcgacggtcacacgaccccaatcgactcaatttgtacgacggtctaaacggtactccggtaccgttaggttacgggtttactaacgtccgtacgttttccgtactttcggaccgttacgaacgttccgtacgggaaccacccgtacgggtccctaccgtccgaaccctagttcctcgggacgtccgtcgtacgtaccggtgaacgggaacggttcggtataccgttattaaccgtttacgcgacgttcggcttagtaacgtttggaccttagccgtagtaccgggtctttaacgttccgttggttaaccggttaacgggtaacgtttcccgggtaactaaacggttccgttcggttaacccgttacgtacggtaccccacggttaaacccgtcccg

SEQ ID NO: 234021 - DNA, 739 bp, Homo sapiens
  misc_feature: GYAE6OF02H858C.39.86.H09.1.454.CMB.1.raw
  modified_base (226)..(226): a, c, t, g, unknown or other
  misc_feature (226)..(226): n is a, c, g, or t
  modified_base (302)..(302): a, c, t, g, unknown or other
  misc_feature (302)..(302): n is a, c, g, or t
tcagtcgcactagtcacgaccggtgctcgatttagtgctatagacttgggggggggggtctcaggaggcagcgctctcaggacatctccaccatggcctgggctctgctgctcctcaccctcctcactcagggcacagggtcctgggcccagtctgccctgactcaggctgcctccgtgtctgggtctcgtaggacagtcgatcaccatctcctgcactggaaccngcagtgacggttggggtatgactatgtctctggtacagcaatatcgaggcacacgaccccaaactcatctatttanggtacggtacaagttaacgtccggtccctaggtacggggtttactaacgttcgtactttccgttacgtcggtacctaccgaaggttccgtacggaactaacccgtacccggtcccctttacccgtaaccgtaaccctacgtttccttaccgggttcgggtaccccgttaccgtacgggtccgttaggggaaaccggggtacgggtaaccgggttccgttaggttaaacttttaccgtttaccggttcgtacccgtaacgtccgtttaaccgttagtttaccggtacttaagttccggaagggttcggtaacgggttaccttttagttccggtttacggtttaacgggaacgggttaccgggaaaccgtaaaccggttcgtaacgttcccggttaccgtacggttacccgaaccgtacccggaaccggtaaccccccg

SEQ ID NO: 234022 - DNA, 611 bp, Homo sapiens
  misc_feature: GYAE6OF02JDO6H.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctggcccagtctgccctgactcaggctgcctccgtgtctgggtctctaggacagtcgatcaccatctcctgcactggaaccagcagtgacgttggggtatgactatgtctctggtaccagcaatactccaggcacacgacccccaatcatccatttagtgagtcagtacgtcggtccctcgtagggtttctaagtccgtcttctcgtcggctacctagtcgtcggtaccaacgtaccggtccctcccgtacgaccctaacgtcctacgtcgggtccctccgacgggcctggacggaccggtacggtacgttcgtaagtttacttacgcgtacctagtacctacttagttacgactaacttcgagttcgacggttctttagttcggttaccgttacgggtaaggttcgggaaccctaaggtctaaccggttccgtaaccgttacggtacccgtacgtaccccgtaacccgg

SEQ ID NO: 234023 - DNA, 731 bp, Homo sapiens
  misc_feature: GYAE6OF02HQGGM.39.86.H09.1.454.CMB.1.raw
  modified_base (229)..(229): a, c, t, g, unknown or other
  misc_feature (229)..(229): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctcgccctgactcaggctgcctccgtgtctgggtctctagggacagtcgatccaccatctcctgcacgtagaaccngcaggtgtacggttgggggttaatgactatcgtctccgtggtaccagctaatactccgaggccacgaccgaccccctaaaagtctaactacctaatttacgcggtaaggtactaaggttaacgttccccggggtacccgttacgggtaacgggggttttacctaacggttcccggtttacctttccgttcggttacgggtaccctaccggtaaacggttccgtaaccgggacctaaacccggtacccggtcccctacccgtaccggtaaccctacgttaccgtcgggtcggtcccgtaccgtacgggtcgtagggacggacggtacggtctacgttattacgtacgtcggactacgtcttacgtagtttacgacttaacgtcgtaggtacggtacgttacgttacggttcggttaccggttacgggtaacgggttcggtaaaccggttaggtccgttacgtccggttaccggtacggtacccgtacggtacccgtaacccgg

SEQ ID NO: 234024 - DNA, 670 bp, Homo sapiens
  misc_feature: GYAE6OF02G8JXP.39.86.H09.1.454.CMB.1.raw
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
  modified_base (276)..(276): a, c, t, g, unknown or other
  misc_feature (276)..(276): n is a, c, g, or t
  modified_base (311)..(311): a, c, t, g, unknown or other
  misc_feature (311)..(311): n is a, c, g, or t
  modified_base (385)..(385): a, c, t, g, unknown or other
  misc_feature (385)..(385): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctcgtaggaccngtcgatcaccatctcctgcactgaaccngcagtgacggttgggggttatgactatgtctcctgtaccagcaatntccagcacaccgacccccaaatcatctaatttagngtaacgtctaaggtaacgtccggtccttaggtcgggtttactatcggtcttctcgtcgtacctccgtaagtcgnggaccaaccgtcccggtccctaccgcgaacctctccgttcgcgggtacctcggagtcgtacgggaacgggtaccgtacggtccgttaagtacgtttaacgtttacgcggtactaccggtactttactacgtttcgaacttaacgtcgtaacggtagtaccggtatttaccggttcggttaaccgggttagggtaacgggttaccgggtaaacccgttaacgggttacctaaccggtttccggtccgttaaccgggtccctaaccgggtaccccgtaaaccccggg

SEQ ID NO: 234025 - DNA, 690 bp, Homo sapiens
  misc_feature: GYAE6OF02JWTBA.39.86.H09.1.454.CMB.1.raw
  modified_base (140)..(140): a, c, t, g, unknown or other
  misc_feature (140)..(140): n is a, c, g, or t
  modified_base (235)..(235): a, c, t, g, unknown or other
  misc_feature (235)..(235): n is a, c, g, or t
tcagtcgcactagtcacgaccggtgctcgatttagtgctatagacttggggggggggtctcaggagcagcgctctcaggacatctccaccactggcctgggcctctgctgctccgtcaccctcctcgactcagggcacgngggtcctggcccagtctgccctgactcaggctgcctcgtgtcgtggtcctagtaggcgagtcgatcgaccatccgtcctgcctacgtaggaaccngacgtaggtcggtacgggtttggggttactcgtacttcgttcgtcgtacgtacgtaaccagtactaactcgaccgacggccaaccgacccgaccccgtaacgtcgtacttacgtagtttaggtaggtacggtactaacggttaacgtccggtccgttaggttacgggttttacaacgttccgtcgttacgtcgtcgtacctacgtacggttcggtacggaccaaccgtccggtcctaccgtagtaccgtacgtaccgttcgcgtcctacggacgtcgtacggacggtacgcgtacgtagtaacttacgtacgtcgtacttcgtctacgtgttcaacgtagttcgacggttaggtaccgttacgtagttcgttacggttaccgggaacggtaacgtacggtaaccgttagttacgttaccggttcgaccggttacgaccggtacccgacgtacccc

SEQ ID NO: 234026 - DNA, 711 bp, Homo sapiens
  misc_feature: GYAE6OF02H53F7.39.86.H09.1.454.CMB.1.raw
  modified_base (128)..(128): a, c, t, g, unknown or other
  misc_feature (128)..(128): n is a, c, g, or t
  modified_base (324)..(324): a, c, t, g, unknown or other
  misc_feature (324)..(324): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctnactcaggcacagggtcctgggcccagtctgccctgactcaggctgcctcgtgtctgggtctcgtaggacagtcgatccacctatcctcctgcacgtggaaccagctaggtggtacgggttgggggttatggactatgttcctccgtggtaccagacaatatccgagaccacacgcctaccaaactcatctatttangtagtcagtactcggtacctgtacggttctaatcgtctcgtactcggtcctacgtacgtcgtcgaccgaaccgtaccggtccctcccgtaccgtaccttacgttaccgtccggtcgggtaccctccggacggtcgtacgggtaacggacggtacggtacgtagttaacgtttaacgttaccgtggacctacggttctacgtttacgttacgtaaccgttaaatcggttaacggtacgggttaacggttaccgtttaggttccgggtttaacggggtttaaccgggtaaacggggttaccgggaaacccggttaacgggttaccggttaccgggtttaaccggttacccggttaaccgggttacccgtaacccggtaaaccccccggg

SEQ ID NO: 234027 - DNA, 556 bp, Homo sapiens
  misc_feature: GYAE6OF02FGIZ6.39.86.H09.1.454.CMB.1.raw
  modified_base (450)..(450): a, c, t, g, unknown or other
  misc_feature (450)..(450): n is a, c, g, or t
  modified_base (478)..(478): a, c, t, g, unknown or other
  misc_feature (478)..(478): n is a, c, g, or t
tcagtcgcactagtcacgaccggtgctcgatttagtgctatagacttgggttgggggtctcaggaggcagcgctctcaggacatctccaccatggcctgggctctgctgctccttcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgacccccaaactcatcatttatgaggtcagtaatccggtcctcgtagggtttctaatcgtcttctctggctcaagtctggacaacgccggcctccctagaccctatcctcgtcgggtctccgaggcctggacggcgaggctagattatactgctagcttactagtttnactaatcgaagttggacgttatttacgnggttacggttacgggaaggttacgggaacctaaggtcctaacgttccgtaccgtaggtccaacgtaccccgtaaccgg

SEQ ID NO: 234028 - DNA, 556 bp, Homo sapiens
  misc_feature: GYAE6OF02F8SWX.39.86.H09.1.454.CMB.1.raw
  modified_base (305)..(305): a, c, t, g, unknown or other
  misc_feature (305)..(305): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
  modified_base (421)..(421): a, c, t, g, unknown or other
  misc_feature (421)..(421): n is a, c, g, or t
  modified_base (439)..(439): a, c, t, g, unknown or other
  misc_feature (439)..(439): n is a, c, g, or t
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctccgtgtaccagcaatatccaggcacacgaccccaaatcatctatttangagtcagtaactcgccctgtacgggtttctaagtcgcttctcgtcggctcctaagtctaggaccaacgccgcccttccncgaccnctctcgtcggcctccgaggctggacggacgnggtctagtattattacgngacagtcttacgatttcgactagtcgagttgacgtcttagtcgttacgttacgggaacggttacgggtaacctaggtactacgtccgttaccgtaagggtccaccggtaccgaaccg

SEQ ID NO: 234029 - DNA, 606 bp, Homo sapiens
  misc_feature: GYAE6OF02IKEDT.39.86.H09.1.454.CMB.1.raw
  modified_base (230)..(230): a, c, t, g, unknown or other
  misc_feature (230)..(230): n is a, c, g, or t
  modified_base (250)..(250): a, c, t, g, unknown or other
  misc_feature (250)..(250): n is a, c, g, or t
  modified_base (317)..(317): a, c, t, g, unknown or other
  misc_feature (317)..(317): n is a, c, g, or t
  modified_base (434)..(434): a, c, t, g, unknown or other
  misc_feature (434)..(434): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctcctgcactggaaccngcagtgcggttgggggttangactatgtctccgtggtaccagacaatactaccgaggccaacgaccgaccccaaactcatcatttangacgtacagtaactcgcctagacgggtttactaacgtctcttctcgtacgtctacgtagtcgtcggactaaccaccgtccctaccgtcgacccagttcctacgtcgggtcctaccgnggtcgtaggaccgggacggtaacgttcgttacgttaagtttacgttacgacgtacgaggtaccttcgttaagttcgactaagtctaggtgagttctagttcgtcgttaacgggacggtacggtaactacggtactacgtccggttacgacgtaccgaccgaccgtaacccgg

SEQ ID NO: 234030 - DNA, 642 bp, Homo sapiens
  misc_feature: GYAE6OF02JL4U7.39.86.H09.1.454.CMB.1.raw
  modified_base (251)..(251): a, c, t, g, unknown or other
  misc_feature (251)..(251): n is a, c, g, or t
  modified_base (316)..(316): a, c, t, g, unknown or other
  misc_feature (316)..(316): n is a, c, g, or t
tcagtcgcactagtcacgaccggtgctcgatttagtgctatagacttgggtttgggggggggtcgtcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttangactatgtctcctggtaccagcaatactccaggtccacacgacccccaaactcactctaatttangtaggtactaagtaactccgggtcccctacggtaggggtttactaacgtccgtacttcctcgtcggtcctaccgtaagtcgtcggaccaaaccgtccggccctccgtcgaccctatctcgtcgggcctccgaggtctaggacggacgaggtctagtactttatacctggactacggtcttacgtatttcgacgttaactccgtaaggtcgacggttactttagtacggttcggttaacgggtaacgggttacggggaaccctaacggttcctaacggttcccggttaccctagggtttacccaccgggttaaccccgaaccccggg

SEQ ID NO: 234031 - DNA, 719 bp, Homo sapiens
  misc_feature: GYAE6OF02JGG4P.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatgactatcgtctacctcggtacctagctaatatccgaggcaacacgaccccctaaaactccaagttaccagtttaactggaacggttccaaggttaaacgtcccggtacccgttacgttaggggtttacctaaacgttccggtacctttccgttcgtacgggtcctaccgtaaacggttccgttacgggaaccaaaccggtacccggtttaccctaccccgttacggaaaccccttagtccggtttacccgtcggggtaccttacccggaaggtaccgttagggaacgggaccgtaggtaccgttagtaacgttacttacgtcggacacggtacctacgtagttacgactaacttacgaggtggttaacgtcgtttacgtcgtttacggtaacgggggtaattacgggggtaacctaacggtccgtaacttccgggtaccttaaggggtttacccaacggtaccccgtaaaccggg

SEQ ID NO: 234032 - DNA, 546 bp, Homo sapiens
  misc_feature: GYAE6OF02FJ4TM.39.86.H09.1.454.CMB.1.raw
  modified_base (408)..(408): a, c, t, g, unknown or other
  misc_feature (408)..(408): n is a, c, g, or t
tcagtcgcactagtcacgaccggtgctcgatttagtgctatagacttggggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttatgagtcagtaactcggccctgagggtttctaatcgcttctctggctccaagtctgcaccgacggccctccctgaccctatctcgtgggcctccaggctggaggacgnggtctgtattacttactgcagctctatttgactatcgagtgacgtctttagtgtacgttacgggtaacggtcgggaacctaaggttctaacgttccggttacccgttaacggtccgaaccgacccgaaggtacccccc

SEQ ID NO: 234033 - DNA, 701 bp, Homo sapiens
  misc_feature: GYAE6OF02GWXI1.39.86.H09.1.454.CMB.1.raw
tcagtcgcactagtcacgaccggtgctcgatttagtgctatagacttgggggggggggtctcaggaggcagcgctctcaggacatctccaccatggcctgggctctgctgctcctcaccctcctcactcagggcacagggtcctgggcccagtctgccctgactcaggctcgcctccgtgtcgtgggtctcgtaggacagtcgatcaccatctcctgcacgtacggaaccagcaggtggtacggtttagggggttatgtaacttagtcgttctccgtaggtaccagactaaattactaccgacggccaaccgtaaccccgaccccctaaaactacctacttaccgttaagttttagacgggtacggttaacaacggttaacgtcccgggtaccccgtttacggttacggggtttactaacttccgtacctttcgtccggtacggtaccttaccgtaaggttcgtacggaacctaaccgtacccggtccctcccgtacgacctactcgtcgtcggctcgacgtcgtcggaacggacgtagtcgtagttacttaagtcgtagacctctactatcgttacgaactacgtcgtacgtagttacgttagttacgttcggttacggtaacgggtaacgggttaccggaacggtagtacccggttacgtccggtacggttacgaaccgtccgaacccgtacgtacccc

SEQ ID NO: 234034 - DNA, 749 bp, Homo sapiens
  misc_feature: GYAE6OF02II1ML.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatccaccatcctcctgcacgtggaaccagcagtggtacggttggggtatgactagtgtctcctggtaccagctaatactccgaaggcaccaccgaccccccaaaactccactactatttactggtacggtctaagtaactccggtacccttcggtaacgggggtttctaacgtccgttctttaccgtccgtcggtcctaccgtaacggttccgtacgggtacccaaacccgtcccgggtaccccttcccgtacgtacccgtacttccgtacggttccgggaccttccggacggtcgttagggaccggtacgggacggtcgttagtaacgttttacttacggtacgtacgtacggtccttaccgtttactttacggtactaacgttaaccggtaggtaccggtacgttaccgtttaacgtttccgggtttaccgggtttaacggggttaacggggtaccgggtaaaacccggttacggttaacccgtacgtttacccgggttacccggttacggtacccggtaaccccggtaaccccggtaaacccccggg

SEQ ID NO: 234035 - DNA, 666 bp, Homo sapiens
  misc_feature: GYAE6OF02HN6DH.39.86.H09.1.454.CMB.1.raw
  modified_base (316)..(316): a, c, t, g, unknown or other
  misc_feature (316)..(316): n is a, c, g, or t
tcagtcgcactagtcacgaccggtgctcgatttagtgctatagacttgggtttgggggggggtctcagggaggcagcgctctcaggacatctccaccatggcctgggctctgctgctcctcaccctcctcactcagggcacagggtcctgggcccagtctgccctgactcaggctgcctccgtgtctgggtctctaggacagtcgatcacatctcctgcactggaaccagcagtgacggtttgggggttatgacttatgtcctccgtcggtaccagcaatactccgagcacacgaccccaaactcatctatttagngtagtacagtactccgccgtacgtaggggtttactagtccgttcttctcgtcggtcctacgtaacgtctcggacctaaccgaccgggtccccttacccgacgtaacccctcgttcccgtaccggttcggggacccttaccggagggtccgttagggacggggtaccggacggtcttacggttaactttacgttacgtcgtacgcgtccgttactacttttacggaaccttaagttcgtaggtcgttacggtactttagttcggtttaccggttacgggtaacggtacggtaaccgtaagggtacctacgttccgggtaaccgttcggtacgtacccgaccgtaaacccgg

SEQ ID NO: 234036 - DNA, 599 bp, Homo sapiens
  misc_feature: GYAE6OF02IPJ7D.39.86.H09.1.454.CMB.1.raw
  modified_base (317)..(317): a, c, t, g, unknown or other
  misc_feature (317)..(317): n is a, c, g, or t
  modified_base (418)..(418): a, c, t, g, unknown or other
  misc_feature (418)..(418): n is a, c, g, or t
  modified_base (464)..(464): a, c, t, g, unknown or other
  misc_feature (464)..(464): n is a, c, g, or t
tcagtcgcactagtcacgaccggtgctcgatttagtgctatagacttggggtttggggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtgatcacatctcctgcactggaaccagcagtgacggttgggggttatgactatgtcctccgtggtaccagcaatatccgaggacacgaccgacccccaaactcaatctatttangtagtctagtaactcggcctagtagggtttactaacgtcgtcttcgtctcggccttaccgaagtcgtaggacaaccgcggtccctcctacgaccctagtcncgtcggctcgaggtctaggacgacggtcgctagtaacttacgtacngtacaggttctacgtattcgacttacgtcgtaggtacggtagttacgttattaggttcggttaacgggtaacggtcggaaccgtaacggttactacgttaccggtacgtacggtaccaccggtaccctaacccgg

SEQ ID NO: 234037 - DNA, 614 bp, Homo sapiens
  misc_feature: GYAE6OF02IJE6L.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatactccaggcacacgacccccaaactcatcactttatgaggtcaagtaactcggccctcgtaggggtttctaagtcgtctttctctggtctaccaagttccgtcggtacaaccgtaccgggcccttaccctcgaaccctactccgttcgtcgggtcctacccgagggccgttaggaacggacggacggtccttaggtaactttaacgtttacgtcggactacgtcttcgtaattttcgactaactcgagtgtaagtcttagtcggttcgtaacgggtaaggtcgggtaaccgtaaggtccgtacgttaccggttaccgtacggtacctacggacccgtaacccgg

SEQ ID NO: 234038 - DNA, 593 bp, Homo sapiens
  misc_feature: GYAE6OF02FT1JN.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtggacgttgggggttatgactatgtctcctggtaccagcaatatccaggcacacgcccccaaactcatcatttatgaggtcagtaactcggccctacgtaggggtttctaagtcgtcttctcgtgctacaagtctggccaacgaccggccctccctcgaccactccgtcgtcgggtcctaccgaggtcctagggacggaccggtacggcgttagtaattacttacgtcggtactacgtccttacgtagttttacgactaaacgttcagggttgacggtctttagtcggttacgttacgggaacggttacgggaacctaacggtcctacgttccgtaccgttaggtaccacggacccgtaacccgg

SEQ ID NO: 234039 - DNA, 262 bp, Homo sapiens
  misc_feature: GYAE6OF02HO0VA.39.86.H09.1.454.CMB.1.raw
  modified_base (247)..(262): a, c, t, g, unknown or other
  misc_feature (247)..(262): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccgccctcctcactagtgcgactgagcgggctggcaaggcgcatagnnnnnnnnnnnnnnnn

SEQ ID NO: 234040 - DNA, 610 bp, Homo sapiens
  misc_feature: GYAE6OF02IOPIB.39.86.H09.1.454.CMB.1.raw
  modified_base (302)..(302): a, c, t, g, unknown or other
  misc_feature (302)..(302): n is a, c, g, or t
  modified_base (312)..(312): a, c, t, g, unknown or other
  misc_feature (312)..(312): n is a, c, g, or t
  modified_base (444)..(444): a, c, t, g, unknown or other
  misc_feature (444)..(444): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctcctgcactggaaccagcagtgacgttgggggttatgactatgtctccgtggtaccagcaatatccaggcacacgaccccaatcatcatttangagtcagtancgcctgacgggtttctaatcgtcttctctcgctacaagtctaggcaacgccgccctacctcgacctactctcggtcggcctaccgaggtctacggacggtacggacggtctagtatttaacgttacgtgacngtacttacgtagtttcgactaacgttcgaggttacggacgggttactttacgtcggtttaccggtttaacgggtaacggttcggggtaaacccgtaacgggttaccgtaacgtttaacccggttcccgtttaaacgggtccgtaacccgacccccgtaaacccggg

SEQ ID NO: 234041 - DNA, 636 bp, Homo sapiens
  misc_feature: GYAE6OF02IRIN9.39.86.H09.1.454.CMB.1.raw
  modified_base (316)..(316): a, c, t, g, unknown or other
  misc_feature (316)..(316): n is a, c, g, or t
  modified_base (465)..(465): a, c, t, g, unknown or other
  misc_feature (465)..(465): n is a, c, g, or t
  modified_base (489)..(489): a, c, t, g, unknown or other
  misc_feature (489)..(489): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctctgcactgaaccagccagtgtacggttgggggtatcgtactatcgtcgtccgtaggtaccagctaatactccgaaggcacgtacgacccctaaatcatctattagngtagtcagtactccggtcctagtacgggtttactaagtcgtcttcgtcgtcggtactacgtaagtcgtacggaccaaccgtccggtcccttacccgtacgtaccctatccgtacggtcggtacctccggagtccgtaggacggtacggngtccgtagttaacttacttagtcnctagtaccttcgttagttacgacctaaagttcgaacgggttgtaacggttactttcgtacggtttacgggtaaccggttaaggtaacggtaaccgttaggtaccttaggttccgtaccgtacggtaccgacccgtacccgtaaccgg

SEQ ID NO: 234042 - DNA, 637 bp, Homo sapiens
  misc_feature: GYAE6OF02JC8YQ.39.86.H09.1.454.CMB.1.raw
  modified_base (244)..(244): a, c, t, g, unknown or other
  misc_feature (244)..(244): n is a, c, g, or t
  modified_base (269)..(269): a, c, t, g, unknown or other
  misc_feature (269)..(269): n is a, c, g, or t
  modified_base (297)..(297): a, c, t, g, unknown or other
  misc_feature (297)..(297): n is a, c, g, or t
  modified_base (357)..(357): a, c, t, g, unknown or other
  misc_feature (357)..(357): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttangactatgtctctggtaccagcaatntccaggcacacgccccaatcatcattangagtcagtactcggcctcgtagggttctaagtcgtacttctcgtcggctaccgaagttcncggaccaacgtccggtcctcccgtcgaccacgtctacgtcgggcctaccgacggtcgtaggtaccgggacggtacgggtccttaaggtactttaacgttacgtcggtacgtaacgtccgttacttacgtttacgaccttaacgttacgtacggttaggaacggttacctttacgttcgttaccggttttaacgggaacgttaccggggtaaccgtaacggttccgtacggttacccggtacgttacgggtacccgtaaccggtaccccgtaaaccccggg

SEQ ID NO: 234043 - DNA, 624 bp, Homo sapiens
  misc_feature: GYAE6OF02JH9SU.39.86.H09.1.454.CMB.1.raw
  modified_base (304)..(304): a, c, t, g, unknown or other
  misc_feature (304)..(304): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctctggtaccagcaatactccaggcacacgcccccaaactcatctatttanggtaggtcagtaacgtccggtccctcgtacggggtttctaatcgtcttctacgtcggctacctaagtcgtacggacctaaccgacggtcccctcccgtacgaccctacgtccgttacgtcgggcctaccgaggtcgttaggacggaccgaggtaccttaggtacttacttaccgtgactacgtctacgtatttacggtactaacgttctaaggtcgtaaggttcgttagttacgttccggttaaacgggtacggtaccgggtaacgtaaggtaccgacgtttaccggtccgttaggccgttaccggacccgtaaacccgg

SEQ ID NO: 234044 - DNA, 751 bp, Homo sapiens
  misc_feature: GYAE6OF02HQLC3.39.86.H09.1.454.CMB.1.raw
tcagtcgcactagtcacgaccggtgctcgatttagtgctatagacttgggtttgggggtggtctcaggaggcagcgctctcaggacatctccaccatggcctgggctctgctgctcctcaccctcctcactcagggcacgagggtccgtcgggcccagtcctcgccctgactcgaggctcgcctccgtgtcgtggtctcgtaggacagtcgatccacacttcctccgtgcacgcggaacagctaggtcggtacgggttgggggttatagtacgttatcgtccgttacgtacggtaccagactaatactaccgacgacaaccaccgacccctaactctactactaatttacgaggtacgtactacgtacgtccggtcctacggttacggtttactacgttccgtacgtttcgtccgtacggtcctacgtacgttcgtacggaccgaaccggtccgaccctttacgctaccgttacgtccgtcggtaccggtcctcggacggaccgtaggacggaacggtcgtaacttaggttaactttacgttacgacggtaccgttacgttacgttagttaacgttcaaaccgtttaacggacgttaacggttcggttaaccgtttacgttttaccgggttacggtttaacccggggttaacggggtaacgggttaaccgggggttaaacccgttaagggtccgtttaacggttccccggtttaaaccgtagggttacccccgaacccggtaacccccggg

SEQ ID NO: 234045 - DNA, 272 bp, Homo sapiens
  misc_feature: GYAE6OF02J2AQ6.39.86.H09.1.454.CMB.1.raw
  modified_base (255)..(272): a, c, t, g, unknown or other
  misc_feature (255)..(272): n is a, c, g, or t
tcagtcgcactagtcacgaccggtgctcgatttagtgctatagacttgggtttgggggtttggtgggtcgtccgactcccgccttgacgaggctgattattactgcagctcatttgcaatcagtgaggcttatgtcttcggaagtgggaccaaggtcatcgtcctaggtcagcccaaggccaacccactgtcactctgttccccacctccctcacctagtcgccgactgacgcgggcctggccaagcgcagtagnnnnnnnnnnnnnnnnnn

SEQ ID NO: 234046 - DNA, 630 bp, Homo sapiens
  misc_feature: GYAE6OF02JOEBC.39.86.H09.1.454.CMB.1.raw
  modified_base (287)..(287): a, c, t, g, unknown or other
  misc_feature (287)..(287): n is a, c, g, or t
  modified_base (442)..(442): a, c, t, g, unknown or other
  misc_feature (442)..(442): n is a, c, g, or t
  modified_base (463)..(463): a, c, t, g, unknown or other
  misc_feature (463)..(463): n is a, c, g, or t
tcagtcgcactagtcacgaccggtgctcgatttagtgctatagacttgggttgggggtcgtcaggaggcagcgctctcaggacatctccaccatggcctgggctctgctgctcctcaccctcctcacctcagggcacagggtcctgggcccagtctgccctgactcaggctgcctccgtgtctgggtctctaggacagtcgatcaccatctcctgcactggaaccagcagtgaccgttgggggttatgtactatgtctccgtggtaccagcaaatactccaggcacncgacccccaaaactcactccaatttatcgaggtcagttaactccggacccttgtacggggttactaagtcgtcttctcgtcgtctaccgaagtctcggacaacgacggtccctccctgacctatcgtcgtggcctcgtaggccttaggaggacgngggtcttagtagttattacgnggctaaggtcctacgtactttacggacttaagtacgtaggtcgtagggtacctttaggttaccgttagttaaccggggtaaacggttcggggtaacccgtaaacggttacgtacggtttaccgttacccggttagggttacccgacggttaccccggaaaccccggg

SEQ ID NO: 234047 - DNA, 618 bp, Homo sapiens
  misc_feature: GYAE6OF02GYR23.39.86.H09.1.454.CMB.1.raw
  modified_base (312)..(312): a, c, t, g, unknown or other
  misc_feature (312)..(312): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctcctgcactggaaccagcagtgacggttgggggttatgactatgtctcctggtaccagcaatactccaggcacacgacccccaaaactcatctatttangaggtcagtaactccggcctcgtagggtttactaacgtcgtacttctcgtgggtcctaccgtaagttccgtacgacgtaaacccgacccgggtccccttacccgtacggaccctacgttccgttccgtcgggtcccttccgacggtccgtagggaccgggacggacggtcgttgttaattacttaacgtgctaacgcttctagtttcgactaattcgagtgtacgtacttgtcgttacggtacggtaacggtacgggaacctacggtactacgttccggtccgtacggtactacgcccgtaaccgg

SEQ ID NO: 234048 - DNA, 629 bp, Homo sapiens
  misc_feature: GYAE6OF02JP024.39.86.H09.1.454.CMB.1.raw
  modified_base (315)..(315): a, c, t, g, unknown or other
  misc_feature (315)..(315): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacgtcgatcaccatctcctgcactcggaccagtcagtgacggttggggttatggatatgtctccgtggtaccagcaatactccgaggcaaccaccgaacccccaaacgtcactctagtttagngtaggtacaaggtacgtccggtaccctagtacgggtttacacgttccgtacttcgtctggacctacgtaagtcgtgaccgaaaccgcggtcccctacctgaaccctcgttccgttcggtccgggtctacccggtacggtacggtacgggacggtaaccgggacgggttacttacgggttatttaacgttacgtcgtacgtacgtcctacgttaacgttcgtactaagtcgtgtacgtaacgttcttagtcgttacggtcgggtagtacgggacgtaaggtctacgtcgttaacgtgaccgtacaccgtaacccg

SEQ ID NO: 234049 - DNA, 674 bp, Homo sapiens
  misc_feature: GYAE6OF02IUHKB.39.86.H09.1.454.CMB.1.raw
  modified_base (504)..(504): a, c, t, g, unknown or other
  misc_feature (504)..(504): n is a, c, g, or t
  modified_base (539)..(539): a, c, t, g, unknown or other
  misc_feature (539)..(539): n is a, c, g, or t
tcagtcgcactagtcacgaccggtgctcgatttagtgctatagacttgggtttggggggggggtctcaggaggcagcgctctcaggacatctccaccatggcctgggctctgctgctcctcaccctcctcactcagggcacagggtcctcgggcccagtcctgccctagactcaggctgcctccgtgtcgtgggtctcgtaggacagtcgatcaccatctctcgctactacggaaccagctagtcggtacggttgggggttatcgaatatcgttcctaccgtacggtaccgacgtactaaatcgtaccggaacggcaaccgtaccgaccccctaaactcaacgtacttacttttaggtacggtaggtacgtaaggttaacgccggtcccgttacggtacggtttctaacgtccgttccttctcgtgtccgtactaagtcgtacgactaccgtaaccgtccccttacgtaccgacctactccgtacggtccggactcgtacggcncgggaacggcggagtctaggttatttacgtacgtnacgtacgtcgttacttcttacgacttacgtagtggtacgggtacttacgttacgtgttacggtcgggtaaacggttcgggaacgttacgtacgtacggttaccgttcgtaacggtacgtacccgacccggtaacc

SEQ ID NO: 234050 - DNA, 791 bp, Homo sapiens
  misc_feature: GYAE6OF02FTHU9.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcacgtcggaaccagcaggtggtacggttgggggtatggactatgtctctggtaccagacaatatccaggcacgaccgaccccaactcatctattatgagtcagtacgtccgtcctacgtagggttactagtccgtcttctcgtcgtacctaccgtaagttccgtacggtacccgaaaccggtacccggtacccctcccgtaccgtaaccctaccgttacccgtcccggtacggggtcccgttacccggtacgggtaccggttacggggaccgggtaaccgggtacgggtaccgttacgtttaaacgtttaaccgtttaccgtacggtaccgtacggttaccgtttaaccgtttacgtttaccgtaacgttaaccgtttaccggtaacgggttacggttacgggtttaccgttttaaggtttacccgggttttacccgggtttaaccggggttaaccggggttaaacccgggggttaaccccggtaaacgggtttacccggtaaccggtttaacccgggtttacccggttaaccggggttacccgtaacccccggtaaccccgggtaaaacccccccgg

SEQ ID NO: 234051 - DNA, 255 bp, Homo sapiens
  misc_feature: GYAE6OF02HD7QX.39.86.H09.1.454.CMB.1.raw
  modified_base (242)..(242): a, c, t, g, unknown or other
  misc_feature (242)..(242): n is a, c, g, or t
  modified_base (248)..(255): a, c, t, g, unknown or other
  misc_feature (248)..(255): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtctaggtcacgcccaaggcccaaccccatgtcactctcgttccccaccctcctcactagtcgcgactgagcgggctggcaggcncatagnnnnnnnn

SEQ ID NO: 234052 - DNA, 627 bp, Homo sapiens
  misc_feature: GYAE6OF02J2PEG.39.86.H09.1.454.CMB.1.raw
  modified_base (307)..(307): a, c, t, g, unknown or other
  misc_feature (307)..(307): n is a, c, g, or t
  modified_base (338)..(338): a, c, t, g, unknown or other
  misc_feature (338)..(338): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcaggcacagggtcctgggcccagtctgccctgactcaggctgcctccgtgtctgggtctctaggacagtcgatcaccatctcctgcactcggaaccagcagtgacgttggggtatgactatgtctctggtaccagcaatctccaggcacacgccccctaaatcagtctatttatcgagtnaagtactccggcctgtacgggttctacgtcncttacgtcgtcgtactctaagttcgtcggaccaaccgtaccgtcccttccgtacgtacctacgttctccggtcgggtcccttaccgacgggtcgtagggacggtacggtaggtcctaacgggttactttaaacgttcgtacggtacgtaccggtactttacgtacgtttaggaaccttagtaaaccgtggttacgagttactagttcgttacggtaacggtacggtcggaaccgttagaccgtacgttacccgttacgtaccggtacgtacccggtacccgtaacccgg

SEQ ID NO: 234053 - DNA, 644 bp, Homo sapiens
  misc_feature: GYAE6OF02JQK9T.39.86.H09.1.454.CMB.1.raw
  modified_base (462)..(462): a, c, t, g, unknown or other
  misc_feature (462)..(462): n is a, c, g, or t
  modified_base (513)..(513): a, c, t, g, unknown or other
  misc_feature (513)..(513): n is a, c, g, or t
tcagtcgcactagtcacgaccggtgctcgatttagtgctatagacttgggttgggggtctcaggaggcagcgctctcaggacatctccaccatggcctggctctgctgctcctcacctctcactcaggcacaggtcctggcccagtctgccctgactcaggctgcctcgtgtctggtactctaggccagtcgatcactatcctctgcacgtcggaaccaggcctagtcgtacgttgggggttataggactagtcgtctaccgtggtaacccagtctaatacgtccaaggcacgtaccgacccctaaagtccattacctaagttttagacgtaggttaccaacggttaacgtcccggtacccgtagttacgggggtttacctaagtcccggtctttccgtacgtcggtacctcgtaaacgtcctaggaccctaacgcccgggtcctccgtgaccctagttacnccgttcgactaccgagtacgtagacggcgtacgtctaagtacttagtacgngtaccgagttactaccgtgttacgaccgttaatcgtaaaggtcgttacgtattacgttacgttcggtaacggtaacggtcggtaacctaacggtctacgttccgtcgtaacggtctaccgcccgtaaaccg

SEQ ID NO: 234054 - DNA, 664 bp, Homo sapiens
  misc_feature: GYAE6OF02F7HFF.39.86.H09.1.454.CMB.1.raw
  modified_base (312)..(312): a, c, t, g, unknown or other
  misc_feature (312)..(312): n is a, c, g, or t
  modified_base (525)..(525): a, c, t, g, unknown or other
  misc_feature (525)..(525): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccattctcctgcacgtggaaccagcagtgacggtttggggtatgactatgtctcctggtaccagacaatctcaggcacacgacccccaaactcactcatttagngaggtcagtaactccggtcctacgtacggggtttactaacgtcgtcgtttcctacgtcggtactaccgtacgttccgacggaccaaccggaccgggtcccttacccgtcgaaaccctacgttccgttaccggtcgggtaccctaccgacgggtaccgtagggacggaacggtacggaccgttagtactttaacgttacgtcgacgtgtacctnttacttcgaacttacgtcctagggtacgtacgttacgtttacgtgtttaaccgggtggggtaacggttaccggggaacgttaacggttctacggttccggtttaaccggtaggtacccggtacgaaccccgtaacccgg

SEQ ID NO: 234055 - DNA, 609 bp, Homo sapiens
  misc_feature: GYAE6OF02GVWDT.39.86.H09.1.454.CMB.1.raw
  modified_base (274)..(274): a, c, t, g, unknown or other
  misc_feature (274)..(274): n is a, c, g, or t
  modified_base (305)..(305): a, c, t, g, unknown or other
  misc_feature (305)..(305): n is a, c, g, or t
  modified_base (408)..(408): a, c, t, g, unknown or other
  misc_feature (408)..(408): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactcggaaccagcagtgacggttggggttatgactatgtctcctggtacagcaatntccaggcacacgacccccaatcatcatttangagtcagtactccggcctgtacgggtttactaatccgtcttctcgtcggtctaccgtaagtcgtacggaccaaccgaccgggtcccttacccgtcgaaccctntccgttcgtacgggtcctccgaggtcgtggaacggaccgtacggtctagtatttaacgtacgtcgactacgtcctacgttacttacgactactacgaggttacgtacgtactttacgtagttacggtacgggtaacggttacgggtaaccgtaggtccgtagttccggttaccgtacggtaccgacgaccccgtaacccgg

SEQ ID NO: 234056 - DNA, 788 bp, Homo sapiens
  misc_feature: GYAE6OF02H54DJ.39.86.H09.1.454.CMB.1.raw
  modified_base (86)..(86): a, c, t, g, unknown or other
  misc_feature (86)..(86): n is a, c, g, or t
tcagtcgcactagtcacgaccggtgctcgatttagtgctatagacttggggggggggtctcaggaggcagcgctctcaggacatcnccaccatggcctgggctctgctgctcctcaccctctcactcgagggcacgaggtcctgggcccagtctcgccctgactcgaggctgcctccgtgtcgtggtactctaggacaggtcgataccacctatctcgtagcacgtggaaccaggtccgtaggtcgttaacgggttgggggttaatcggaaccttgtgttccgtaccgttggtaaccagtacaagttactacgaacggccaacgaccccgtaacccccgtaaactacacttaccgaagttttacgaggtaacggtctaacgttaaccggtccggtacccctaggttacggggtttacctaaacgttccgtcgtttccaacggtttctacccgtaccgtaaacgtttccgtggtaaaccccgaaaccgtcccggttcccgttaacccggttcgaaaccctttcgttaccgttccgggttacgggtccccgttacggtaaacgggtccgttaaggggtaaaccgggcggtaaccggggtaccttaaggttacgtttaacgtttaccgttagacgttaccggtacttaccggtaacgttcgactaactcggtaacgtgtaacgttcgttagttccggttacggttacggtaacggtaccggacgttaaacggttaccacgggttccgttaaccgttccgaaccgggaccgtacccgtaagggtaacccccc

SEQ ID NO: 234057 - DNA, 590 bp, Homo sapiens
  misc_feature: GYAE6OF02HCUJ8.39.86.H09.1.454.CMB.1.raw
  modified_base (228)..(228): a, c, t, g, unknown or other
  misc_feature (228)..(228): n is a, c, g, or t
  modified_base (309)..(309): a, c, t, g, unknown or other
  misc_feature (309)..(309): n is a, c, g, or t
  modified_base (461)..(461): a, c, t, g, unknown or other
  misc_feature (461)..(461): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacggttgggggttatgactatcgtctcctggtaccagcaatactccaggcacaccgcccccaaatcatcatttangtagtcagtactccgcctgagggtttctaatcgcttctcgtcggtcctcgagtcgtggacacgccggtccctccgtactaccgtactactcgtcggtcctccgagtcgtcggaggacggtaggctagtattactcgtagcgtacgtccgttntactttacggacttaagttcaggtacgtggtatttacggttaggttaccggttacgggaggttacgggaaccgttaaggttactacggttccggtaccgttacggtaccgaccggtacccgtaacccgg

SEQ ID NO: 234058 - DNA, 621 bp, Homo sapiens
  misc_feature: GYAE6OF02GT1TI.39.86.H09.1.454.CMB.1.raw
  modified_base (427)..(427): a, c, t, g, unknown or other
  misc_feature (427)..(427): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactaggaccagcagtgacggttggggttatgactatgtctctggtaccagcaatactccaggccaacgaccgacccccctaaactccatacctatttagtgaacggtctaagttaacgtccggtaccctggtacgggtttactaacgtcgtcttactcgtggtcctacgtaagtctacggaccacgacccgtccctaccctgaccctntccgtacgtcgggtcctacgacggctcgggacggacggtacgtacgttacgtaattacgttactaggctacgtctacgtagtttacgacctaagtccgtaggtagacgttacgttagttcgtacggttacggtaaggtccgggtaaccgagttcggtacttcggtaccgttaggtcgtaccgcccgtaacccgg

SEQ ID NO: 234059 - DNA, 642 bp, Homo sapiens
  misc_feature: GYAE6OF02H0EW8.39.86.H09.1.454.CMB.1.raw
  modified_base (252)..(252): a, c, t, g, unknown or other
  misc_feature (252)..(252): n is a, c, g, or t
  modified_base (335)..(335): a, c, t, g, unknown or other
  misc_feature (335)..(335): n is a, c, g, or t
  modified_base (530)..(530): a, c, t, g, unknown or other
  misc_feature (530)..(530): n is a, c, g, or t
  modified_base (595)..(595): a, c, t, g, unknown or other
  misc_feature (595)..(595): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcaggcacagggtcctcgggcccagtctcgccctgactcaggctcgcctccgtgtctggtctctaggacagtcgactcacatcctcctgcactaggaaccagcaaggtggtacggttgggggttanggaacttatgtccttccgtggtaaccgacgacctaatactccgaaggccaaccaccgaccccctaaaactcaattctatttanggtagtacagttaacgccggcctacggtaggggttactaacgtcgtcttcgcgtacgcgtaaccgtgtacgtcgactaaccgccgtccctccgactacctactcgtacgtccggccgtcgaggtcgtaggacggtacgaacgtgtgtaactttagtcgtacgacacgtcctacgtttagttaccgaacgttaacncggttaacgtaggtaaccttcttagtcggtttaacgtacggggttaagacgggtaccgtaacgtnttacggtacgttacccgtacggtaccctaccggtaacccaaccccgg

SEQ ID NO: 234060 - DNA, 695 bp, Homo sapiens
  misc_feature: GYAE6OF02FNYOV.39.86.H09.1.454.CMB.1.raw
  modified_base (197)..(197): a, c, t, g, unknown or other
  misc_feature (197)..(197): n is a, c, g, or t
  modified_base (303)..(303): a, c, t, g, unknown or other
  misc_feature (303)..(303): n is a, c, g, or t
  modified_base (334)..(334): a, c, t, g, unknown or other
  misc_feature (334)..(334): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacgagggtcctgggcccagtctgccctgactcaggctgcctccgtgtcgtggtctcgtaggacngtcgatcaccatcctctcgactacgtacggaaccagcaaggttcggtacgggtttgggggttataggtactagtcgttcctccgtacggtaacctagactaatacncagcacaccgaccccaatcactatactttgngtaacggtctaagtacgtccggtccctaggttacggtttactaacgtccgtacttccgtactcggtcctaccggtaagtccgtacggaacctaaccggtcccgtacccttaccgtacgtaaccgtacttccgtcggtacgggtccctacggaggtccgtacggaacgggtaccggtaggtccttaggttaacttaagttaccgtcggacgtacgtaccgttagttacgttacgaactaagttacgaggttaggtacgtagtttacgttacgttacgggtacggtaagggttacggaaccggttaggttaccgtaccggttacgttacccggtaggtaccccgtaggtaccccggtaacccg

SEQ ID NO: 234061 - DNA, 590 bp, Homo sapiens
  misc_feature: GYAE6OF02GLKEY.39.86.H09.1.454.CMB.1.raw
  modified_base (306)..(306): a, c, t, g, unknown or other
  misc_feature (306)..(306): n is a, c, g, or t
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctctgcactggaaccagcagtggacggtttgggggttatgactatgtctccgtaggtaccagcaatatccaggcacaccgaccccaaatcatcatttangagtnagtancgcctgtagggtttctaagtcgtcttctcgtcgactacgagtcgtggaccaaccgccggtccctcccgtgaacctcgtccgtcgtcgggccctacgacggtcgtaggacgggacggagtccttaggttactttacgttactgcgtagtccttacgttatttcgactaacttgtaggtgtagtctttagttcggttcgttacgggaacgggttacggaaccgtaaggttcgtacgttaccggttccgtaacggtacgaccggacccgtaacccgg

SEQ ID NO: 234062 - DNA, 804 bp, Homo sapiens
  misc_feature: GYAE6OF02IMGZD.39.86.H09.1.454.CMB.1.raw
tcagtcgcactagtcacgaccggtgctcgatttagtgctatagacttggggggggggggtctcaggaggcagcgctctcaggacatctccaccatggcctgggctctgctgctcctcaccctcctcactcagggcacagggtcctgggcccagtctgccctgactcaggctcgcctcgtgtcgtgggtctgtaggacagtcgatccacctatctcctgcactcggaaccagcaggtcggtagggtttggggttatgactagtgtcctcctcggtaccacgactaatactaccaggccaccgaccgacccccaaactcaacttacttaatttatggtacggtacgtaagttaacgtcccggtacccttacgggttacgggtttactaaacgttccgtctttacgtccgtacggtcctaccgtaacgtcgtaacggtaccaaccgtacccggtacccttcccgtacaaccgtaccttaccgtcggtacggtccctaccggtaccggtcgtaacgggacggtaaccgggtacggtacgtttacggttaacgttttaaccgttacgttacggaccgtaccgttacttaccgtttagtttaacctacgtaacgttccggttaaagggttacggttaccgggtttaacctttaggttaccggtttaaccgggtttaccggggttaaacggggttaacccgggtaacgggttaaccggttaaccggttacccgggttttaccggttaacccgggtttaccgggtaaccggaacccccgggtaccccggtaaacccccggttaaaccccccg

SEQ ID NO: 234063 - DNA, 269 bp, Homo sapiens
  misc_feature: GYAE6OF02HBN63.39.86.H09.1.454.CMB.1.raw
  modified_base (248)..(248): a, c, t, g, unknown or other
  misc_feature (248)..(248): n is a, c, g, or t
  modified_base (250)..(269): a, c, t, g, unknown or other
  misc_feature (250)..(269): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggcccaaccccactgtcactctcgttcccaccctcctcactagtgcgactgagcgggctggcaaggcgcatagngnnnnnnnnnnnnnnnnnnnn

SEQ ID NO: 234064 - DNA, 570 bp, Homo sapiens
  misc_feature: GYAE6OF02FQ7XD.39.86.H09.1.454.CMB.1.raw
  modified_base (311)..(311): a, c, t, g, unknown or other
  misc_feature (311)..(311): n is a, c, g, or t
  modified_base (361)..(361): a, c, t, g, unknown or other
  misc_feature (361)..(361): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctcctgcactggaaccagcagtgacgttgggggttatgactatgtctcctggtaccagcaatatccaggcacacgacccccaaactccatctatttangagtcagtaatccggcctcgagggtttcaatcgcttctcgtgctcgatcngacacgccgcctcctcgacctatctcgtcggcctccgaggtcgtacggacggacggtaggtccgtagtacgtttattactcgcacgtcttactatttcgactaacgtcgtagtcgtaggtcctttagtcggttacgttacgggtaacggtcgggtaaaccgtaggtcctaacggttcgtaccgtaggtccacggtaccccgtaacccgg

SEQ ID NO: 234065 - DNA, 276 bp, Homo sapiens
  misc_feature: GYAE6OF02IKVKO.39.86.H09.1.454.CMB.1.raw
  modified_base (252)..(252): a, c, t, g, unknown or other
  misc_feature (252)..(252): n is a, c, g, or t
  modified_base (254)..(255): a, c, t, g, unknown or other
  misc_feature (254)..(255): n is a, c, g, or t
  modified_base (257)..(276): a, c, t, g, unknown or other
  misc_feature (257)..(276): n is a, c, g, or t
tcagtcgcactagtcacgaccggtgctcgatttagtgctatagacttgggtttgggggtttggtggtcgtccactcccgccttgacgaggctgattattactgcagctcatttgcaatcagtgaggcttatgtcttcggaagtgggaccaaggtcatcgtcctaggtcagcccaaggccaaccccatcgtcactctgttcccaccctcctcactagtcgccgactgagcgggctggcaaggcgacagtagcngnngnnnnnnnnnnnnnnnnnnnn

SEQ ID NO: 234066 - DNA, 654 bp, Homo sapiens
  misc_feature: GYAE6OF02HNAKI.39.86.H09.1.454.CMB.1.raw
  modified_base (421)..(421): a, c, t, g, unknown or other
  misc_feature (421)..(421): n is a, c, g, or t
  modified_base (436)..(436): a, c, t, g, unknown or other
  misc_feature (436)..(436): n is a, c, g, or t
  modified_base (482)..(482): a, c, t, g, unknown or other
  misc_feature (482)..(482): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcacgtaggaaccagcagtggacggttgggggttatgactatcgtctccgtagtaccagacaatactccgagcacgaccgacccccaaactcactctatttagtggtacgtactaagtaacgtccggtccctaggttacgggtttactagttcctcttcctcgtcgtctacgtaagtcgtcggaccacgccggtccctcctacgacctntccgtcgtcggtccnccgaggccgtaggacggcgtacggtacgttagtaattacgttacgngtacgaccgttcgtattaccgtttgaccgttaacgttcggtacgtaacgggttagtaccgttttatccggttttaacgggttacgggaaccggttacggggttaacccgtaggttcgtaaccggttccggttaaccgttccgggtacgtaccccggtaaccgtaacccccgg

SEQ ID NO: 234067 - DNA, 688 bp, Homo sapiens
  misc_feature: GYAE6OF02IVPY2.39.86.H09.1.454.CMB.1.raw
  modified_base (329)..(329): a, c, t, g, unknown or other
  misc_feature (329)..(329): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtcgtgggtctctaggacagtcgatcaccatctctgcacgtcgaaccagcaggtggacggttggggttatgtactagtcgtacctccgtacggtaaccagtactaatactccgaggccaacgaccgaccccctaaagtcactctaatttagngacggtactaagttacgtccggtacccgttaggtacgggtttactaagtccgttacttccgtacgtcgtacctacgtaagtcgtacggaacctaaccggacccgtcccgtaccgtcgtaaccctatccggtacgtaccgggtaccttacggacgtacggtaacgggaaccggacggtaacggtccttaagttacgttagttaccacggtacgtacgttactacttaagttctagtacttacggtaagttcggtacgttacttacgttacggtttcccggtaagggtaacggttacgggtaaccgtaacggtacctacggtttccggtaacgtacggtaccgtaccgacccgtaacccgg

SEQ ID NO: 234068 - DNA, 642 bp, Homo sapiens
  misc_feature: GYAE6OF02H6RAO.39.86.H09.1.454.CMB.1.raw
  modified_base (275)..(275): a, c, t, g, unknown or other
  misc_feature (275)..(275): n is a, c, g, or t
  modified_base (303)..(303): a, c, t, g, unknown or other
  misc_feature (303)..(303): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcgtggtaccagcaatntcgagcacacgccccaaatcatcattangtagtcaagtaactcggtcctcgtagggtttacaacgttcgtacttctcgtggctaccgtaagtctggaccaacgtaccggtcccttcccgtacgaccctacttccgtaccgtcgggtcctccgaggtccgtagggacggaaccggtaggtcgtagttaattacttacgtacgacgtagtcctctaagttttcgaactaaacgttcgtaaggttagtacggtactttacgttcggtttaccgttcggggtaacggttaccggggaaccgttaaacgggttaccgtacggttcccggtaccgttaaccgggttccgaacccggtaccccgtaaaccccgg

SEQ ID NO: 234069 - DNA, 809 bp, Homo sapiens
  misc_feature: GYAE6OF02JKQET.39.86.H09.1.454.CMB.1.raw
  modified_base (275)..(275): a, c, t, g, unknown or other
  misc_feature (275)..(275): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctcctgcactggaaccagcagtgacggttgggggttatggactatgtcctcctggtaccagcaaatntccaggcacgacgacccccaaatcatctaatttatgaggtcaagtaactccggtcccctagtacggggttttacctaagtccggtctttaccgtccgttcgggtccttaaccgtaaacggttccgttacgggacccgtaaaccccgtaacccggggtccccctttacccccgtacggtaaacccctaccttttacccgttcccggttacgggggtaccccttcccggtaacgggtacccgtttagggaaaccggggtaacccgggtaacgggttcccttacggttaaacgttttaacttttaacccgggtcgtacccgtaacgggttaccctttacccgttaagtttttacccggaacttaaacgtttacccggaagggtttacgggtaaccggttacgttttacttacggggttaccggttttaacggggaaaccggggtttaacggggaaccccgttaaacggggttcccttaaccggtttacccggtaccggtttacgggacccgtacccggttaacccccgaaacccggg

SEQ ID NO: 234070 - DNA, 630 bp, Homo sapiens
  misc_feature: GYAE6OF02FHE6B.39.86.H09.1.454.CMB.1.raw
  modified_base (226)..(226): a, c, t, g, unknown or other
  misc_feature (226)..(226): n is a, c, g, or t
tcagtcgcactagtcacgaccggtgctcgatttagtgctatagacttggggggggggtctcaggaggcagcgctctcaggacttatctccaccatggcctgggctctgctgctcctcaccctcctcactcagggcacagggtcctgggcccagtctgccctgactcaggctgcctccgtgtctgggtctctaggacagtcgatcaccatctcctgcactcggaccngcagtgacggtttgggggttatgtactatgtctccgtggtaccagcaatatccgaggccacacgccccccaaactcatctatttatgtagtcagtaactccggtccctgtagggtttctaagtcgtcttctcgtcggcctaccgaagttctacggaccaaccgacccggtccccttcccgtacggaaccctagtccttccggtacgggccttcccgagggtccttagggaacgggtaccggcggttacctggttaacttttacgttaacgtcgtaccgacgtcttactagttttcgacaattcgagttaggacgtctttagtcgtacgttacgggaacggttacggacctaaggtccgtacgttccgtaccgtacggtccaccggtaccccgacgtaacccccc

SEQ ID NO: 234071 - DNA, 475 bp, Homo sapiens
  misc_feature: GYAE6OF02IRSI9.39.86.H09.1.454.CMB.1.raw
  modified_base (322)..(322): a, c, t, g, unknown or other
  misc_feature (322)..(322): n is a, c, g, or t
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
  modified_base (447)..(475): a, c, t, g, unknown or other
  misc_feature (447)..(475): n is a, c, g, or t
tcagtcgcactagtcacgaccggtgctcgatttagtgctatagacttgggtttggatgggatggatcagcggcgccaacggtaagacattgtattcagagaacttccaggacagagtctccctcaccagtgacacatccgcgaacacagtctacatggaaatgaggagcctcacatctaaagacacggctctatattactgcgcgagacacggttattgtcctgagactggctgcgaggcgctgttccacccctggggccagggaaccctggtcaccgtctccccagcctccaccaagggcccagtccggtccttcccccgnggccgccctcgcctccaggacgccacctccgagacgcacaggccggcccgtggggcttgccgtggtccaaaggctaccgtccaacttagcgcactgaggcgggctgggctaacgggngcagancnnnnnnnnnnnnnnnnnnnnnnnnnnnnn

SEQ ID NO: 234072 - DNA, 675 bp, Homo sapiens
  misc_feature: GYAE6OF02JCCT3.39.86.H09.1.454.CMB.1.raw
  modified_base (221)..(221): a, c, t, g, unknown or other
  misc_feature (221)..(221): n is a, c, g, or t
  modified_base (263)..(263): a, c, t, g, unknown or other
  misc_feature (263)..(263): n is a, c, g, or t
  modified_base (303)..(303): a, c, t, g, unknown or other
  misc_feature (303)..(303): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcagcctgcctccgtgtctggtctccgtggacagtcgatcaccatctctgcactggaancagcagtgacgttggtgtataactatgtctcgtgtaccaacncgcaccgaggacaaacgaccccaaactcatgtaactttancgacggtacagttaacgtccggacccgttagtacggggtttacctaaacgtccgtcctttctccgtaggtcctaccgtaagtccgtaggacctaaccggtaccgtacccgttaccctacggtaacccacgtttcgtccggttacgggcccttacccgagggtcgtacgggtacggtaacgggacgtcgtacggtaaacgttttacgtaacgtcgacggtacgtccttaacgtaacttaacgtaacgtaaacggtccaacgttacgacgtaaccgttacctttggtacggttcggttaaccggttcgggacgggtaaccggacgtaggccgttaccggtacccgttaccggtaacgtaccgtacgaaccccgg

SEQ ID NO: 234073 - DNA, 784 bp, Homo sapiens
  misc_feature: GYAE6OF02JPSC6.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctcgccctgactcaggctcgcctccgtgtcgtgggtctcgtaggacagtcgatccaccatcctcctcgaccacgtacggaaccacgacgtaggtacggtacgggtttgggggttaactcggtaacttcgttcgtcgtccgttacggtaaccaggtactaatctaccggaacggccaaaccgacccgaaccccccttaaagtcctaacgttacctaagttttaggacggtaacgggttactaacgggtaccgtcccggtacccgttagggttaccggggtttactaacgggttccgtttcttcgttcgtacggtcctaaccgtacggttccgtacgacctaaccggtacccggtcccttccgtaccgacctcgttaccttcgggtccggtccgttacggacggtcgtaacgggtacggtacggcgttacgttacgtaacgttctacgtcgtaacgtcgtacgttccgttgttaaccgtactaaacgtttccgaaggttacggtaacgttccgttaaggttcccggtttaccggggtaacggtaacggtaccgggtttaaacgtaccgttacggttacggttaccttacccgggttacggtaacccggtacccggtacccggtaaacccc

SEQ ID NO: 234074 - DNA, 518 bp, Homo sapiens
  misc_feature: GYAE6OF02F6LE7.39.86.H09.1.454.CMB.1.raw
  modified_base (310)..(310): a, c, t, g, unknown or other
  misc_feature (310)..(310): n is a, c, g, or t
  modified_base (329)..(329): a, c, t, g, unknown or other
  misc_feature (329)..(329): n is a, c, g, or t
  modified_base (363)..(363): a, c, t, g, unknown or other
  misc_feature (363)..(363): n is a, c, g, or t
  modified_base (371)..(371): a, c, t, g, unknown or other
  misc_feature (371)..(371): n is a, c, g, or t
  modified_base (450)..(450): a, c, t, g, unknown or other
  misc_feature (450)..(450): n is a, c, g, or t
tcagtcgcactagtcacgaccggtgctcgatttagtgctatagacttgggtttggggggggcctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctcctgcactggaaccagcagtgacggttgggggttatgactatgtctcctggtaccagcaatatccaggcacaccgacccccaaactcatcatttangagtacagtactcgcctgnggtttacatcgtcttctctgctcagtgtgacacncgcctccngacatctcgtcggcctcgagcgtgaggacgagtctgtacttatcacgtctagctctaatttgactaagtctagtgagtnttatgttacgttaggacgtacgggaacctaaggtctagttccgtacgtagtacgtacgaccgtaaccg

SEQ ID NO: 234075 - DNA, 831 bp, Homo sapiens
  misc_feature: GYAE6OF02JC9FC.39.86.H09.1.454.CMB.1.raw
tcagtcgcactagtcacgaccggtgctcgatttagtgctatagacttgggttggggggtctcgaggaggcctagtcgctctctaggacatcgtccaccgatggcctgggctctgctgctcctcaccctcctcactcagggcacagggtcctgggcccagtctgccctgactcaggctgcctcgtgtcgtgggtctcgtaggactagtcgatcaccatctcctgcactggaccagcagtggacggttggggtatgtactatgtctccgtaggtaccagactaatactccgaggcctaacgaccgaccccctaaaatcctaactcctaatttaacgtacggtaacgggttacaacggttaacgtccccggtacccgttacggtacgggggttttaacctaacgttccggtacctttccggttaaccgtggtaccgtacccgttaaacgggttcgttacgggaacccgaaaccgtacccggggtccccttacccggtaccggtaaccctacgttccgttaccggttacgggtaccctaccgtaagggtacccgttagggaacggggaaccggttagggtaccttacgggttaaactttaacggtttaccgacgttaccgtaacggtacctttaccgtttaagttccgtaaacgtaacgtttccggtaacgggtaacgggttaacgttaacgtttaccgttacggttttaacccgggttaaacggggtaaccgggttaaccggggtaaaccgttaaacgggtttaccgtaacggtttaccccggttaccggttaacgggtaccccgtaaccgggtttaacccccggaaacccggg

SEQ ID NO: 234076 - DNA, 562 bp, Homo sapiens
  misc_feature: GYAE6OF02GWZI0.39.86.H09.1.454.CMB.1.raw
  modified_base (230)..(230): a, c, t, g, unknown or other
  misc_feature (230)..(230): n is a, c, g, or t
  modified_base (311)..(311): a, c, t, g, unknown or other
  misc_feature (311)..(311): n is a, c, g, or t
  modified_base (368)..(368): a, c, t, g, unknown or other
  misc_feature (368)..(368): n is a, c, g, or t
  modified_base (383)..(383): a, c, t, g, unknown or other
  misc_feature (383)..(383): n is a, c, g, or t
  modified_base (420)..(420): a, c, t, g, unknown or other
  misc_feature (420)..(420): n is a, c, g, or t
tcagtcgcactagtcacgaccggtgctcgatttagtgctatagacttggttttgggggggggtctcaggaggcagcgctctcaggacatctccaccatggcctgggctctgctgctcctcaccctcctcactcagggcacagggtcctgggcccagtctgccctgactcaggctgcctccgtgtctgggtctcgtaggacagtcgatcaccatctcctgcactggaaccngcagtgattggttgggggttatggactatgtctcctggtaccagcaatatccaggcacgacgccccaaatcatacatttangagtcaagtaacgtccggcctgtagggtttctaagtcgtcttctgtcgctacagtcnggacacgcgcctccnaccatctcgtgggcctacgaggtcctaggacggacgnggtctagtatttacttacgtcgacagtcctacttagttacgactaatcgagtacggacgttcttagttccgtttacgtacggggtaaggtcgggaaccgtaggtactacggttccgttacgtaggtccgaccgtaaccccgg

SEQ ID NO: 234077 - DNA, 710 bp, Homo sapiens
  misc_feature: GYAE6OF02IYS48.39.86.H09.1.454.CMB.1.raw
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (613)..(613): a, c, t, g, unknown or other
  misc_feature (613)..(613): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcgagggcacagggtcctgggcccagtctgcctacgtgactcgacgcctcgcccgttcgtgttcgttcggggtccttaccgtgacgtacggttcaactcctaccngtccttccgncctacgtgggtaaacgcgaacgtcgtaaggttcgtacgggttgggttaggtttaactacgtattcggttcttaccgttacggaaacccaagactaccaaccgacgaccgtaaacccgcccctaaatcagttacgttattacggaggtactacgtacgtacgtcccggtcctagggttacggttactaacgttctccgttaccgtcctggtccttaacgtacgtcgccggaacgtacccgccggttccctcgcgtaccctactccggtcgtcgggttcccacggtgtaccgttacggggacgtaacgggcgtaacgttacgggttatttaacctacgtgcgaacgttacctagaattacgaatacgaancgactacgtcttaccgttggttacggttcgttaacggtacgggcgggtaaccgtacggtacgccttaacggtccggtacgtaccggtactacccggg

SEQ ID NO: 234078 - DNA, 767 bp, Homo sapiens
  misc_feature: GYAE6OF02FLQEJ.39.86.H09.1.454.CMB.1.raw
  modified_base (310)..(310): a, c, t, g, unknown or other
  misc_feature (310)..(310): n is a, c, g, or t
  modified_base (324)..(324): a, c, t, g, unknown or other
  misc_feature (324)..(324): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctcgtgtctgggtctctaggacagtcgatcaccatctcctgcacgtaggaaccagcaggtgacggttgggggttatgactatgtcctcctggtaccagacaatatccaggcacaccgacccccaaactcatctatttanggagtacagtaacnccggtcctacgtaggggttactaacgtccgtacttcgtacgtcggtacctaccgtaacgtcgtacggaccaaccgtacccggacccttcccgtacggacctaacgttccgttaccggtcgggtaccttacccggacgggttaccgttacgggaacggggtaacccggtagggtaccgtttaaggttaaccgtttaacgtttaccggtccgtaacggttaccggtacctttacgttaacgttttacggtaccgttaaacttccgggtaaacgggttaaccggtacgggtttacccttttaggttccgggtttaacccggggttttaaccggtaacggggtttaaccggggtaaacccggttaacggttaccgttaaccggtttaccgggttaacccgtttaacggggtaccccgtaaccgggtacccccggttaaacccccggg

SEQ ID NO: 234079 - DNA, 807 bp, Homo sapiens
  misc_feature: GYAE6OF02IJO8K.39.86.H09.1.454.CMB.1.raw
  modified_base (197)..(197): a, c, t, g, unknown or other
  misc_feature (197)..(197): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcgagggcacagggtcctgggcccagtctgccctgacctcaggctgcctccgtgtctgggtctctaggacngtcgatcacatcctcctgctacgtaggaacctagcctagtggtaccgggtttgggggttatggtaacttcgttcgttccttccgtacggtaaccagacctaaattactccgaggacctaccggaaccccggtaacccccctaaatctaacttaccttaatttttacggtaggtacggttaccgtaaggttaaccgtcccgggtacccgttacgggttaacgggggttttacctaacgtcgtttacccttccgttcgtacggtccctaacccgtagttacccgtacggaacctaaccccggtaccggtcccccttacccgtaccggtaaccctaacgtttcccgttccggtccgggtacccttaccgggacgggtccgttaacgggaccggggttaacggtacggttcgttaacggttactttacgtacgcgttcaccggttccttagtttacgtttacgacttaacgttacggtacggttaacggtgttaaccctttggtttaccgggtttacggtttaacggggtaacgggttaccgggaacgttaccgttaggtacccgtttacgggtacccggttagggaccctaccccggtaacccgtaaccccgg

SEQ ID NO: 234080 - DNA, 636 bp, Homo sapiens
  misc_feature: GYAE6OF02JG0UH.39.86.H09.1.454.CMB.1.raw
  modified_base (360)..(360): a, c, t, g, unknown or other
  misc_feature (360)..(360): n is a, c, g, or t
tcagtcgcactagtcacgaccggtgctcgatttagtgctatagacttggggggggtcgtcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactgaaccagcagtgacgttggggttatgactatgtctcgttaggtaccagcaatactccgaggctacacgacccccaaatccactcatttatggacggttacaagttaagtccggaccctggtacgggtttctaagtccgtacttntccgtgtcctaccgaagttcctacggaccaaccgtaccggtccctcccgtacgaaccctagtcccgtcgtacggggcccttaccgaggtccgtaggacgggaccgaggtctagtaactttagttaccgtgacgtacgtcgtacttagtttacgactaacgttcgtaagtcgtaggtactttagttcgttacggtacgggtaaggtaccggtacctaacggttcacgttacccggttacgtacggttacccgacggtaccccgtaacggtacccccg

SEQ ID NO: 234081 - DNA, 722 bp, Homo sapiens
  misc_feature: GYAE6OF02HNK1Y.39.86.H09.1.454.CMB.1.raw
tcagtcgcactagtcacgaccggtgctcgatttagtgctatagacttgggggggggggtctcagggaggcagcgctctcaggacatctccaccatggcctgggctctgctgctcctcaccctcctcactcagggcacgagggtcctgggcccagtctgccctgactcaggctgcctccgtgtcgtgggtctcgtaggacagtcgatccacatctcctgcacgtggaaccagcaggtgtacggttggggttatgacttagtcgtccttaccgtggtaccaggacaatactccgacggacaccgaccgaccccccaaagtccaagtacctatttagtacgggacggttctaaggttaacgtcccggtacccgttaggtacgggttttactaacgttccgtactttcgtacgtacggtacccttacggtaacgttcgtacggacaacccggtccggtacccttcccgtacgtaccgtacttccgtaccggtcgggtaccctaccggaggacgtagggaacgggtacggacgttgttacggtactttaacgtcgtacgacttacgtacttacgttagtttacgacgtaacgttgaaccggttggaacgtttctaaggttccgttacgggttaaccgggtagggtaaccggtaacggtaacgggtccttaggttacccggtaaccggttaccggacccgaacccggtacccggaaccggtaaccccc

SEQ ID NO: 234082 - DNA, 692 bp, Homo sapiens
  misc_feature: GYAE6OF02IKOXX.39.86.H09.1.454.CMB.1.raw
  modified_base (256)..(256): a, c, t, g, unknown or other
  misc_feature (256)..(256): n is a, c, g, or t
  modified_base (517)..(517): a, c, t, g, unknown or other
  misc_feature (517)..(517): n is a, c, g, or t
tcagtcgcactagtcacgaccggtgctcgatttagtgctatagacttgggttgggggtctcaggaggcagcgctctcaggacatctccaccatggcctgggctctgctgctcctcacctcctcactcgagggcacgacgggtcctcgggcccagtcgtcgccctgactcgacggctcgcctcgtgtcgtggtctactaggacagtcgactcacactctcgtgcacgtagacctagcaggtgtacggttggggttanacgtactgtcgtctaccgtaggtaccgagtactaactacgtcgacggtaccacgaaccgacccctaaatctaactacttacgtttacgacggtacgttacgtaacggttaaccgttcccggtacccggttacggtttaacgggtttactaaccggtccgtttccgtaccgttcgtacggttacctaacgttaccggtctaaccgggtacaaccggtcccgtccttaccgtacgaccttacgtcgtccggtcgtcctacggngttaccgaggacgacgggttactacgttacttagttaaccgtgaccggaatcggtactacgttacgtacgtactaaaggttccgaggtccgtagtttcgtacttcggttacgggtaacggacggttacggacgttaagtcgtacgtcgttaccgaggttccacggtacccgaacg

SEQ ID NO: 234083 - DNA, 658 bp, Homo sapiens
  misc_feature: GYAE6OF02IGCTX.39.86.H09.1.454.CMB.1.raw
  modified_base (226)..(226): a, c, t, g, unknown or other
  misc_feature (226)..(226): n is a, c, g, or t
  modified_base (304)..(304): a, c, t, g, unknown or other
  misc_feature (304)..(304): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacgagggtcctggcccagtctgccctgactcaggctgcctcgtgtcgtggtctcgtaggacagtcgatcaccatctcctgcactgaacngcagtgtacggttgggtatgactatcgtctcgtgaccagactaatactcgagcaccaccgacccaatcattctattangtacgtacagttacgtccggacttacggtacgggtttacaacgttcgtcttaccgtctcggtacctacgtaaggtccgtaggacctaaacgtacccggttccctacccgtacggtaacctaccgttcgttaccggtccgggttaccttaccggacggtaccgtacggggtaacgggtacggtaacggttccgttacggttaacgtttacgttccgaacgtccgtaactacgttcgttacgtttagaacctacgttacgtaggtacggtacgtttactgttacgttcggttaacggacggtaacgggaacctagtcgtacgtcgttaccggtagtcgtacccgaccgtaacccgg

SEQ ID NO: 234084 - DNA, 809 bp, Homo sapiens
  misc_feature: GYAE6OF02JSWV4.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacgagggtcctgggcccagtctgccctgactcaggctgcctcgtgtcgtggtctcgtagacagtcgatccacatcctcctgcctacgtacggaacccagccgtagtcggtacggttgggggttaactcggacttagtcgtccgttaccgttcggttaaccaggtactaaagttacgtaccgaaggaccaacccgacccgtaacccccccaaaacttccgtaacgttacttaacgttttacgtacgggtaaccggttactaaacggttaaccgtccccggggtaccccgttacggtttaacgggggttttactaaccggttccgttcctttccgtaccgtttcgggtacccttaaccgtaacggttccgtacgggtaaccgtaacccgtacccgggtcccctttaaccccgtaccgtaccctaacgttccgttccgggaaccggtcccgtacggtaccgggtacggttaaccggggaccggtaacgggttacggtaccgttaaggtttaaccgttaacgttccgtacggtacgttaccggtacttacgttacgtcaacgttacgtacggtacgtaacggtacgtttacgttacggttacggtaacggtacggttaacgggacgtaccgtagtacgttcgtacgtaccgtggaaccgtacccgtcgtaaccccg

SEQ ID NO: 234085 - DNA, 563 bp, Homo sapiens
  misc_feature: GYAE6OF02HXEBB.39.86.H09.1.454.CMB.1.raw
  modified_base (303)..(303): a, c, t, g, unknown or other
  misc_feature (303)..(303): n is a, c, g, or t
tcagtcgcactagtcacgaccggtgctcgatttagtgctatagacttgggttgggggtctcaggaggcagcgctctcaggacatctccaccatggcctgggctctgactgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatctatttangaggtcagtaatcggccctcgaggggtttcaagtcgcttctctgctccaagtctggcaacgcggccctccctgaccctatctctgggctccagctgaggcgagctgattatacgtgcacgctctatttgactaatcgacgtgtacggtctttagttcgttaccgttacgggaacgttacgggggtaacccgtaaacggggttcctaaacgttccggttaacccggttacggtaccgtaccgggtaccccctaaacccggg

SEQ ID NO: 234086 - DNA, 620 bp, Homo sapiens
  misc_feature: GYAE6OF02G83H1.39.86.H09.1.454.CMB.1.raw
tcagtcgcactagtcacgaccggtgctcgatttagtgctatagacttggggggggggtctcaggaggcagcgctctcaggacatctccaccatggcctgggctctgctgctcctcaccctcctcactcgagggcacagggtcctgggcccagtctgccctgactcaggctgcctccgtgtctgggtctctaggacagtcgatcaccatctcctgcactggaaccagcagtgacggttgggggttatgactagtgtctcctggtaccagcaatactccaggacacacgcccccaaactcaatctaatttatgaagtcagttaagttcgccctacgtagggtttctaagtcgtcttctctcgctcgaagttcgtcgtacaacgaccggtccctaccgtacgaacctactccgtcgtcgggtccctaccgcggcgtacggaggaccggacggtactgtaacgtttacttacgtcgtacgacgtccgttacttagtttacgacgttaacgtcgttaggtacgtacgttacgttacgttgttaccggttagggtaacggacgggtaaccgtaaggttaccgtacgtaccgttcggtacggtaccgaccgacccgtacgaaccccg

SEQ ID NO: 234087 - DNA, 773 bp, Homo sapiens
  misc_feature: GYAE6OF02FZGRK.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacgagggtcctgggccccagtctcgccctgactcaggctcgccttccggtgtcgtgggttctacgtaggactaggtcgactcaccactcccctgcacgtcggaaccagcaggtcggtacgggtttggggtactcgtactagttcgtccgtaccgtaggtaacccagtacctaaagtcgtaccgacggaccaaccaacccggaacccccctaaaagtcctaagttccttaagtttagtacggttagggtaacctaaggttaaccgtccccgggtacccgttacgggttaacgggttttaccctaacgtttccggtacccgtttcgttccggtacgggtcccttaccggtaacgttcgaccggtaacctacccgtacccggttccctacccgtagtacccttatcccggtttggccgggtaccctacggtacgaccggtaacgggacggaccgggtagtacgttacggttaatttaaccgtcgtacggtacccgagttaccgtacgttacgtttccgaagtacttacggagttcgggtacgtttattaccgtggttaacgtacgggtaacgttagggaccgttaacgtacgtaacggttcgtaaccggtaccgtaccgtaccggtacccggcctaacccccg

SEQ ID NO: 234088 - DNA, 645 bp, Homo sapiens
  misc_feature: GYAE6OF02G0VE3.39.86.H09.1.454.CMB.1.raw
tcagtcgcactagtcacgaccggtgctcgatttagtgctatagacttggggggggggtctcaggaggcagcgctctcaggacatctccaccatggcctgggctctgctgctcctcaccctcctcactcagggcacagggtcctgggcccagtctgccctgactcaggctgcctcgtgtctgggtctcgtaggacagtcgatcaccatctcctgcactggaaccagcagtggtacggttgggggttatgtactatgtctccgtggtaccagctaatatccgagcacacgtacccccaaatcactctatttatgaggtacagtaacgtccggtccctaggtagggtttactacgtccgtctttctcgtggcctcgaagtctggactaacgccggtcctacccgtacgtaccctacgttcctcgtcgggtcctaccgtaggtcgtaggacggacggtacggtacgtagttaactttacgttacgtacgactcgtacttacctagtttaccgactaaacgttcgaggttaggtacgttaccgtttagttccgtttacggtttaacggggtaacgggttacgggtacccgtaaggttctaacggttcgtaccggttaggacccgtacggtaacccggaccgtaacccccg

SEQ ID NO: 234089 - DNA, 259 bp, Homo sapiens
  misc_feature: GYAE6OF02G517O.39.86.H09.1.454.CMB.1.raw
  modified_base (248)..(259): a, c, t, g, unknown or other
  misc_feature (248)..(259): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttccccgccctcctcactagtgcgactgagcgggctggcaaggcgcatagnnnnnnnnnnnn

SEQ ID NO: 234090 - DNA, 678 bp, Homo sapiens
  misc_feature: GYAE6OF02ISHUJ.39.86.H09.1.454.CMB.1.raw
  modified_base (128)..(128): a, c, t, g, unknown or other
  misc_feature (128)..(128): n is a, c, g, or t
  modified_base (490)..(490): a, c, t, g, unknown or other
  misc_feature (490)..(490): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctnactcagggcacagggtcctgggcccagtctgccctgactcaggctgcctccgtgtctggtctcgtaggacagtcgatcaccatcctctgcactggaaccagcagtgacggttggggtatgactatcgtctcctcggtaccagcaatactcaggacacaccgaccccaatcctatctaatttatgacggtacagtaacgtccggtcctacgtacgggttactaacgtcgtcttcctctgccgtcgtaacgtcgtacgtaccaaccgtaccgggcccttcccgtagacccgtattcccgtacgttccgggccttaccgaggtaccgtaggacggacggacgtcgttacgtaattacttacccgngtaccgtagtacccgttgttacgttacgtacgtaacgttcgtaacgggttactaagggtttccgttactttacggttaccggtacgggtttaaacgggttacggtaaaccggtaaccgtttacggaaccgtttccgggttaaccccggtaagggttaaccgtaccccgggtaaaccccgtaacccggg

SEQ ID NO: 234091 - DNA, 756 bp, Homo sapiens
  misc_feature: GYAE6OF02HJWPJ.39.86.H09.1.454.CMB.1.raw
tcagtcgcactagtcacgaccggtgctcgatttagtgctatagacttgggtttggggggggttcgtcgagggaggcgagcgctctcaggacatctccaccatcggcctgggctctgctgctcctccaccctcctcactcgagggcacgacgggtccgtcgggaccacgtcgtcgccctgacctcgacgctcgccgtcgtgtcgtcggtctcgtagacagtcgatcacactctacctgaccactacgggaacacgacaggtacgtacggttgggggttaactggaacttacgtaggttcctaccggtacgtaccgaagactaaactacgtaccgacgggaaccacgaaccgaacccccgaactacctaattacttaactttagtaacgtacggtacgtaacggttagtaccggaccctacggttagggttaacttacgcgtctttacgtctaccggtactacgtaagtcctggtaaccgaacgtccgtacccgtacccgtacgtacctacgttccgttcgacggtacccttaccggaacgttcgggaaacggttcgggaacgggttcgagttagtaactttaacgtcgacgtaccgacgttaacttgtacgttcgaaacttccgtaaggtatccgggtaaacgtcgttacgttacggttaccggtaagggtaaccgggttacggaacccggttaagggcctaacgggttcccgtttaaacggttccgggaacccttaccgaaccccgggtaaacccg

SEQ ID NO: 234092 - DNA, 603 bp, Homo sapiens
  misc_feature: GYAE6OF02FPIF2.39.86.H09.1.454.CMB.1.raw
  modified_base (487)..(487): a, c, t, g, unknown or other
  misc_feature (487)..(487): n is a, c, g, or t
  modified_base (491)..(491): a, c, t, g, unknown or other
  misc_feature (491)..(491): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtggacggttgggggttatgactatgtctcctggtaccagcaatatcgaggcacacgcccccaaactcctactatttatgtacggtcaagttaacgtccgccccggggtactagggggtttactaacgtccgtactttcctcgtcggtcctacctaacggttctacgggacaaccgacggtccctccgtacgacctaactcctcggcggtcctccgagcgtaggacggacgaggtacgtgtaattacttacgtanacgngtcctactagttcgactaactcgtaggtgtacggtacttgtacgttcgtacgggtaaggtcggaaccgtagtcgacgttacgtcgtacgtccgacgtacccgagaacccccg

SEQ ID NO: 234093 - DNA, 735 bp, Homo sapiens
  misc_feature: GYAE6OF02H1M6J.39.86.H09.1.454.CMB.1.raw
  modified_base (249)..(249): a, c, t, g, unknown or other
  misc_feature (249)..(249): n is a, c, g, or t
  modified_base (433)..(433): a, c, t, g, unknown or other
  misc_feature (433)..(433): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcgagggcacgagggtcctgggcccagtcctggccctgactcgaggctcgcctccgtgtcgtgggtctccgtaggacagtcgactccaaccatcctcctggctacgtacggaaacccngctacggtaggtaccggggttttagggggttactaggtacctagttcggtccttaccggttaggaacccggataaccgtaattacctaccggacggaccaaccctaccgaaccccctaaatccaactttcctaagttcgtagacggtactaaggtaactccggtccgtaggttacggttaaccngttcctacgttctcggtcgacctacgtagttacgcgaaccacgccgtaccctcgtcaccgtctacgtcgaccggtcaccggacggtcggtcgaacggcggtacgtactacggttaactttacgtacgtccgtaagtacccgtcgttaccgtttaacgttaccacgttaaaccgttagtacggtaaccggttagttccttacgttccgggtttaacgggtacggggtaacgtcgggtaaaccgttacgtacgtttacggaaccggttccttaaccggtaccggaccgaaccccgtaaccccgg

SEQ ID NO: 234094 - DNA, 638 bp, Homo sapiens
  misc_feature: GYAE6OF02GSFI0.39.86.H09.1.454.CMB.1.raw
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
tcagtcgcactagtcacgaccggtgctcgatttagtgctatagacttgggggggggggtctcaggaggcagcgctctcaggacatctccaccatggcctgggctctgctgctcctcaccctctcactcagggcacagggtcctgggcccagtctgccctgactcaggctcgcctcgtgtcgtgggtctcgtaggacagtcgatcacatctcctgcactggaaccagctaagtggacggtttggggttancgtatntcgtctcgtacggtacagactaatcaccgacgaccaccgaacccgaaccccctaaatctaacttctaattacgtaggtacgtactaacgtacgtccgtccgtaggttacggttactacgtcgtccttctcgtcgtactacgtacgtcgtacgaacctaccgtccgtccctaccgactactctcgtccgcgtcctcgtacgcgtacgacggaggtcgtacgttaagttaacttactacgtcgcgtacgttctacgttacttacgaactagtcgtagtacggtacgttattacggttcgttacggttaacgggtaacggaccggtaacgtagttactaccggttccgtacggtcgtaaccgaccggtacccggaccgtaaccccg

SEQ ID NO: 234095 - DNA, 541 bp, Homo sapiens
  misc_feature: GYAE6OF02F5D4H.39.86.H09.1.454.CMB.1.raw
  modified_base (302)..(302): a, c, t, g, unknown or other
  misc_feature (302)..(302): n is a, c, g, or t
  modified_base (377)..(377): a, c, t, g, unknown or other
  misc_feature (377)..(377): n is a, c, g, or t
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctctgtaccagcaatatccagcacacgcccccaaactcatcatttangaggtcagtaactcggccctgtagggtttctaatcgtcttctctggctccaagtctggacaacaccggcctcctnaccactcgtctgggcctcgaggctggaggacgaggctagtattattactgctagctctagtttcgactaatcgagtgagtacttagtcgttacgttcgggaagttacggggaaccctaaggttccacgttccggtaccgttagggtccacggacccgtaaccgg

SEQ ID NO: 234096 - DNA, 644 bp, Homo sapiens
  misc_feature: GYAE6OF02GQSWG.39.86.H09.1.454.CMB.1.raw
  modified_base (543)..(543): a, c, t, g, unknown or other
  misc_feature (543)..(543): n is a, c, g, or t
  modified_base (557)..(557): a, c, t, g, unknown or other
  misc_feature (557)..(557): n is a, c, g, or t
  modified_base (565)..(565): a, c, t, g, unknown or other
  misc_feature (565)..(565): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacgagggtcctgggcccagtctcgccctgactcaggctgcctccgtgtcgtgggtctcgtaggacagtcatcaccatcctcctgcacgtcggaaccagcagtggtacggttggggggtactagtgtatagtcgtcctcgtacggtacgacgactaactacgtacgacggacaccgacccgaacccctaactctactacttattagtaggtacggtactaacgtaccgtccgttaccgttacgggttacggtttactacgtccgttactcgttcgcgtactacgtacgtcgacggtacaccgtccgtccctaccgtcaccttcgtctccggcgtccgtacggacggtcggtacggaacggtcgggtactcgtaagttattacgtacgtcacgtctctagttcgtancgtactgtagggtntacgtttntcggttacggttcggtaagggtacggtaccgtacgtaggtaccttaggtcccgtaaggtaccggaccaccggtaacccg

SEQ ID NO: 234097 - DNA, 843 bp, Homo sapiens
  misc_feature: GYAE6OF02HFPA5.39.86.H09.1.454.CMB.1.raw
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctcgggcccagtctcgcctgactcaggctcgcctccgtgtcgtgggtctcgtacggacagtcgactcacctatcctcctcgactacgtacggaaccagcctaggttacggtacggggttttaggggggttactacggtaacgttagttcgttccgttaccggttacggtaacccgtagtaactaacttacgaccgacggaccaaccgaacccgaaccccctaaactcctaacgtacttaagtttacgtacggtaacggtactaaaggttaaccgtcccggtaccgttacgggttaacgggtttacttaacgtccgttaccttcgttacgtacggtacctaccggtacggttccgtaccggtaacctaacccggtacccggttcccttaccccggtacttacccgtacttcccggtttacgggtcccggtaccgtaccggacggtacggtacggggaacgggaccggtaccgggttagttacttaaacgttttaccgtaccgtaccggtataccgttacgttactaagttaccgaccgttaaacgttacggtacggacggtttaacgttaccgtttagggttcccggtttaacggggtacgggttaacgggtacccggtaaacggttaaccgtccggttaaccggtttccggtacccggtaacgggtccctaaccccggacccggttaaacccccggg

SEQ ID NO: 234098 - DNA, 261 bp, Homo sapiens
  misc_feature: GYAE6OF02F1T7J.39.86.H09.1.454.CMB.1.raw
  modified_base (248)..(261): a, c, t, g, unknown or other
  misc_feature (248)..(261): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggcccaaccccactgtcactctgttccccacctcctcactagtgcgactgagcgggctggcaaggcgcatagnnnnnnnnnnnnnn

SEQ ID NO: 234099 - DNA, 594 bp, Homo sapiens
  misc_feature: GYAE6OF02HPNBI.39.86.H09.1.454.CMB.1.raw
  modified_base (305)..(305): a, c, t, g, unknown or other
  misc_feature (305)..(305): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctcctgcacgtgaaccagcagtgacggttggggtatgactatcgtctcgtggtaccagcaatctccaggcacaccgaccccaactcatctatttagngagtcagtacgtccgacctggtaggtttactagtccgtcttctcgtcgcctacgagtcgtagaccacgaccgtccctccgtacgaccctagttcctcggtcggtccctacgagggtctagggacggacgtacggtctagttacttagttacctggactagtcctacgtacgtttcgactaagtctaaggtgtacgttcttagttcggttacggtaacgggtaaggtacggtaaccgttaaggtcttacggttccggtaccgtaagggtaccaccggtaccctaacccgg

SEQ ID NO: 234100 - DNA, 311 bp, Homo sapiens
  misc_feature: GYAE6OF02JA1KR.39.86.H09.1.454.CMB.1.raw
  modified_base (132)..(132): a, c, t, g, unknown or other
  misc_feature (132)..(132): n is a, c, g, or t
  modified_base (262)..(263): a, c, t, g, unknown or other
  misc_feature (262)..(263): n is a, c, g, or t
  modified_base (267)..(268): a, c, t, g, unknown or other
  misc_feature (267)..(268): n is a, c, g, or t
  modified_base (270)..(270): a, c, t, g, unknown or other
  misc_feature (270)..(270): n is a, c, g, or t
  modified_base (274)..(311): a, c, t, g, unknown or other
  misc_feature (274)..(311): n is a, c, g, or t
tcagtcgcactagtcacgaccggtgctcgatttagtgctatagacttgggtttggggggtttggtggtcgtccactcccgccttgacgaggctgattattactgcagctcatttgcaatcagtgaggcttangtcttcggaagtgggaccaaggtcatcgtcctaggtcagcccaagcccaaccccactgtcactctgttccccacctcctccactagtcgaccgactgacgtccgggctggcctaagggccaccattagcnncacnngnactnnnnnnnnnnnnnnnnnnnnnnnnnnnnnnnnnnnnnn

SEQ ID NO: 234101 - DNA, 735 bp, Homo sapiens
  misc_feature: GYAE6OF02H6O8W.39.86.H09.1.454.CMB.1.raw
  modified_base (196)..(196): a, c, t, g, unknown or other
  misc_feature (196)..(196): n is a, c, g, or t
  modified_base (320)..(320): a, c, t, g, unknown or other
  misc_feature (320)..(320): n is a, c, g, or t
tcagtcgcactagtcacgaccggtgctcgatttagtgctatagacttgggggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacngtcgatcaccatctcctgcagtcggaaccagcgagtggacgggtttgggggttatggacttatgtcctccgtggtaccagacaatctccgaggacacaccgacccccaaatcatacctatttanggaggtacagtaacgtccggccttacggtacgggtttctaagtccgtctttctcgtcggtctaccgtaagtccgtagacctaaccgtacccggtccctacccgtacgtaccgtaccttacctccggtcgggacctacccggtagggtaccggtaccgggtaacgggtaaccggtaacgggtccgtttacgtaaccgttttaacgtttaaccgtaggaccgtaccgttcttaacttacggtttttaccgaacttaaaccgttacgtaacggttacgggtacggttaccttttaggttacggtttacccggtttaaggggtaacgggttaacgggttaccgtaaacggttacgtaccgtttaccggttaacccgttacggtaccgtaacccggtaccccgtaaccggaaccccccgg

SEQ ID NO: 234102 - DNA, 691 bp, Homo sapiens
  misc_feature: GYAE6OF02HILIK.39.86.H09.1.454.CMB.1.raw
  modified_base (230)..(230): a, c, t, g, unknown or other
  misc_feature (230)..(230): n is a, c, g, or t
  modified_base (491)..(491): a, c, t, g, unknown or other
  misc_feature (491)..(491): n is a, c, g, or t
  modified_base (564)..(564): a, c, t, g, unknown or other
  misc_feature (564)..(564): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcaggcacagggtcctcgggcccagtctgccctgactcaggctgcctcgtgtctgggtctcctggacagtcgatccaccatcctcctgcacgtaggaacncagcagtgtacgttggtagttaataacgttatcgttcgtaccgtacggtaacccaacgacgacccaacccgacggaaccaaaaacccgtcccccctaaaaactctaaagtagttattttaagtacggtacggtacaagttaacgtcccggtacccttacggtacgggttttaccaacttccggtccttactcggtcggtacctacgtaacgtccgtagaccaacgtcccgtccttcccgacgtaccagttcgccgtggccncgaggtcaggacggacgtagtcgtagttacttacgttacgctacacgtctactataactagtaaacgccgtanacgtaacgtaccgttacgttcgttacggttacggttaccgggttaccggggaaccgggtaacggaacccgtaaccgtcggttaacccgtaccggttacccgggtacggtaccgacccggtaacccgg

SEQ ID NO: 234103 - DNA, 647 bp, Homo sapiens
  misc_feature: GYAE6OF02FQXZ1.39.86.H09.1.454.CMB.1.raw
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
  modified_base (489)..(489): a, c, t, g, unknown or other
  misc_feature (489)..(489): n is a, c, g, or t
tcagtcgcactagtcacgaccggtgctcgatttagtgctatagacttgggggggggggtctcaggaggcagcgctctcaggacatctccaccatggcctgggctctgctgctcctcaccctcctcactcagggcacagggtcctgggcccagtctcgccctgactcgaggctgccctccgtgtctgggtctcgtagacngtcgatcaccatctctgcactaggaaccngcagtggtacggttggggttatgacttagtcgttcctccgtggtaccagacaatctaccgaggcacaccgacccccaactcatctatttacgtggagtacgtagtaacgtccggtaccctggtacgggtttactaacgttccgtctttctcgtcgtctacaggtcgtcgactaacgccgtcctccgtcgacctattccgtcgtcggtcctcggtacggtcgtaggacggacggacggttctagttacgtttactacgtacnccggtactccgttacttacgtttcgactaacgttacgagtaggtacggttacgttgttcgttacggtttaaccgggtaagggtaccggttacgggtaacgttacgttacggttccgtaccgttacggtaccgtaaccggtacccgacccgtaaccccg

SEQ ID NO: 234104 - DNA, 783 bp, Homo sapiens
  misc_feature: GYAE6OF02FVHAH.39.86.H09.1.454.CMB.1.raw
  modified_base (311)..(311): a, c, t, g, unknown or other
  misc_feature (311)..(311): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtcgtgggtctctaggacagtcgatcaccatctcctgcactggaccagcagtgacgttggggtatgactatgtctccgtggtaccagacaatatccgaggcaacacgacccccaaatcatactagtttangaaggtctaagtaacgtccggtccctacggtacggggtttactaacgtccgtactttccgtccgttcgggtaccttaccgaaacggttccgtacgggtaacccaaacccggtaacccgggtcccctttaccccgtacggtaaccctaacgtttcccgttccggttacggggtaccccttaccggaacgggttccgtacgggaacggggtaaccgggtacgggtaccgttaggttaacttttaaacgtttaccggtacgtaccgtacggtaccttaccgtttaagttttaccgaaccgttaaacgttcgtaaacggttacggttacgggtttactttacgggttacggtttcccgggtttaaacggggtaaacgggttaccgggtaaacccggttaacggttacccgttaacgtttcccggttaacccggttaccgggtaacccgttacccgggaaccccgtaaacccccggg

SEQ ID NO: 234105 - DNA, 779 bp, Homo sapiens
  misc_feature: GYAE6OF02FJAEJ.39.86.H09.1.454.CMB.1.raw
tcagtcgcactagtcacgaccggtgctcgatttagtgctatagacttgggttggggggtctcaggaggcagcgctctcaggacatctccaccatggcctgggctctgctgctcctcaccctcctcactcagggcacagggtcctgggcccagtctgccctgactcaggctgcctccgtgtctgggtctcgtaggacagtcgactcaccactctcctcgcacgtcggacctagctagtcggtacggttgggggttatcgactatcgtcctccgtcggtaccagactaactacgtcccggacgtaccgaaccgaaccgtaccccaaaactcctaagttacctaacgtttgtacggtacggttaacgtaacgtaaccgtaccccgggtacccttacgggttaacggggtttacctaacgttcccggtctttcgtaccgtcggtaccctccgtaacgtaccgtacggacccaaccgtccggtccctcccgtaacgacctgtcccgtcggtcggtacctccgacggtctacgggacgggaccgtcggtactaacgtaccgtttacttccgcgtacaccggtctaacgttagttaaccgacgttaaccgtacgtacgggttagtaaccgggttacctttaggtaaccggtttacccgggttaaaccggggtaaccgggttaaccccgggttaaacccggtaaccgggtttaaccctaccggttacccgggttacccggtaaccggggtaccccgtaacccgggtaacccccgttaaccccccggg

SEQ ID NO: 234106 - DNA, 274 bp, Homo sapiens
  misc_feature: GYAE6OF02IAMYQ.39.86.H09.1.454.CMB.1.raw
  modified_base (185)..(185): a, c, t, g, unknown or other
  misc_feature (185)..(185): n is a, c, g, or t
  modified_base (248)..(248): a, c, t, g, unknown or other
  misc_feature (248)..(248): n is a, c, g, or t
  modified_base (250)..(274): a, c, t, g, unknown or other
  misc_feature (250)..(274): n is a, c, g, or t
tcagtcgcactagtcacgaccggtgctcgatttagtgctatagacttgggtttggggggtttgtggtctccactcccgccttgacgaggctgattattactgcagctcatttgcaatcagtgaggcttatgtcttcggaagtgggaccaaggtcatcgtcctaggtcagcccaaggccaaccccntgtcactctcgttcccgcctcctcactagtgcactgagcgggctggcaaggcgtacaagtagnannnnnnnnnnnnnnnnnnnnnnnnn

SEQ ID NO: 234107 - DNA, 686 bp, Homo sapiens
  misc_feature: GYAE6OF02JYRIB.39.86.H09.1.454.CMB.1.raw
  modified_base (528)..(528): a, c, t, g, unknown or other
  misc_feature (528)..(528): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacgagggtcctgggcccagtctgccctgactcaggctgcctccgtgtctggtctcgtaggacagtcgatcaccatcctcctgccacgtacggaaccagcctaggtggtacggtttgggggttaatgacttatgtcctccgtaggtaccagacaatactccaaggccaccgacgacccccaaactcatctaatttgagtagttccaaggtactccggtcccttaggtacgggtttactacgtccgttcttactcgtacggctactaacgtcgtacggacctaacgacccgttcccgtacccgtacgtaaccctacgtccgttaccggtcgggtacccttccgacggtaccgtaggaacgggacggtagtccgttaagtacgtttaagtccgngtccgaagttccgtactttaacgttcgacctaacttacgtagtaacggttacgtcgttaaggtcgtttaacggtacgggaacggttacgggtaacgttacggttccgtaacggtttccgtaaccggttacgtaccggtaccgtaccccggtaaccccg

SEQ ID NO: 234108 - DNA, 273 bp, Homo sapiens
  misc_feature: GYAE6OF02H6U4F.39.86.H09.1.454.CMB.1.raw
  modified_base (245)..(273): a, c, t, g, unknown or other
  misc_feature (245)..(273): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaaaccccatgtcactctgttcccacctcctcactagtgcgactgagcgggctggcaaggcgcatagnnnnnnnnnnnnnnnnnnnnnnnnnnnnn

SEQ ID NO: 234109 - DNA, 595 bp, Homo sapiens
  misc_feature: GYAE6OF02HOA14.39.86.H09.1.454.CMB.1.raw
  modified_base (276)..(276): a, c, t, g, unknown or other
  misc_feature (276)..(276): n is a, c, g, or t
  modified_base (310)..(310): a, c, t, g, unknown or other
  misc_feature (310)..(310): n is a, c, g, or t
  modified_base (323)..(323): a, c, t, g, unknown or other
  misc_feature (323)..(323): n is a, c, g, or t
  modified_base (385)..(385): a, c, t, g, unknown or other
  misc_feature (385)..(385): n is a, c, g, or t
tcagtcgcactagtcacgaccggtgctcgatttagtgctatagacttggttttggggggggtctcaggaggcagcgctctcaggacatctccaccatggcctgggctctgctgctcctcaccctcctcactcagggcacgagggtcctgggcccagtctgccctgactcaggctgcctcgtgtctgggtctctaggacagtcgatcaccatctcctgcacgtggaaccagcagtgacggtttggggttatgtactatgtctcgtgtaccagcaatntcctaggccacaccgaccccaaatcatctatttngacgtacagtacncggcctgtaggttactacgtcgtcttctcgtgctacagtctgacacgcgtcctcctagaccntccgtcgtcggcctacgaggtctaggacggacgacggtctagtactttactacgtcgactacgtacttcgtaagttcgaactaacgtccgtaaggtacggtacgttacctttaggtccgttaccggttaacggggacggttaacgggtaacccgttaaggtaccttacgtcccgtaacgtacgggtaccacccggtacccggtaacccgg

SEQ ID NO: 234110 - DNA, 691 bp, Homo sapiens
  misc_feature: GYAE6OF02HADGH.39.86.H09.1.454.CMB.1.raw
  modified_base (229)..(229): a, c, t, g, unknown or other
  misc_feature (229)..(229): n is a, c, g, or t
  modified_base (288)..(288): a, c, t, g, unknown or other
  misc_feature (288)..(288): n is a, c, g, or t
  modified_base (539)..(539): a, c, t, g, unknown or other
  misc_feature (539)..(539): n is a, c, g, or t
tcagtcgcactagtcacgaccggtgctcgatttagtgctatagacttgggtttgggggggggcctcaggaggcagcgctctcaggacatctccaccatggcctgggctctgctgctcctcaccctcctcactcagggcacgagggtcctgggcccagtctcgccctgactcaggctgcctcgtgtctgggtctcgtagacagtcgatcacatctcctgcactggaaccngcagtcggtacggttgggggttatgaacttagtgttctccgtggtaccagtacaattcncgagtccaaccgaccaccccaactcatctaatttacgagtacggtactaagtaacgtccggtccgtcggttacggggtttactaacgtccgttcttcgtacgtcgtaccgtaccgtaacgtcgtacgaaccaacggtcccgtaccctacccgtacgtaccctagttcccgtcgtcgggtcctacggacggcgttagggacggacggtacggacgtttacgaactttacgtactcggtacgtaacccggttnttacgttacttacgtaccgtaaacgttcaacggttggtaacgttctttagtccggtttacggttaacggtaacgggtacggtaccgtaagggttcctaacggtttccgtaaccgtaacgggtaccccgtaacggtaccccggtaaaaccccg

SEQ ID NO: 234111 - DNA, 761 bp, Homo sapiens
  misc_feature: GYAE6OF02JIF2E.39.86.H09.1.454.CMB.1.raw
  modified_base (247)..(247): a, c, t, g, unknown or other
  misc_feature (247)..(247): n is a, c, g, or t
  modified_base (627)..(627): a, c, t, g, unknown or other
  misc_feature (627)..(627): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctcgccctgactcgaggctcgcctcgtgtcgtggtctacgtaggactgtcgactaccacctacttcctcctcgacctacgtacggaaccncgcgaggtcggtacgggtttaggggtatagtaacttagtcgtccttccggtacggtaaccaggtacctaagttacctaccgacggtaccaacccgaacccgtaccccctaaactacctacgtacttaactttagacggtacggtacgtaagttaccggtcccggtacccgttagggttaccgggtttaactaccgttccgttaccgttccgtcggtaccgtaccgttaacgtacgttcgtaccggaacctaacccggtcccgtacccgtaccctaccggtacctaccgttccgtccggtaccgggtccctaccgggaggtcggaacggtaaccgggtacggtaacggttccttaaggttactttaccgttacgtccgtanaaccggttctacgttacttacgactagttacgtacggtagtacggttattcgttacgtacggttaaccgggtagtacggtacgtacgttacgtccgttacgtacccggttagaccggtacccgaccgtaacccg

SEQ ID NO: 234112 - DNA, 846 bp, Homo sapiens
  misc_feature: GYAE6OF02H7KUX.39.86.H09.1.454.CMB.1.raw
  modified_base (272)..(272): a, c, t, g, unknown or other
  misc_feature (272)..(272): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctctggtaccagcaatntccaggcacacgacccccaaaactcaactactatttacgtgtaacggtcaaggttaacgtccggacccttacggtaacgggggttttcctaaacgttccgtcctttaccgtccgttacggtccttaccgtaaacggttccgtacgggtacctaaacccgaacccgggttccccctttaccccgttaccggtaacccctaacgtttacccgttaccggtaccgggggtacccttacccggaacgggtcccgttagggaaccgggtaaaccgggtacgggtacgttacgggttaaaccgtttttaacgtttaaccgttacggtacccgtaacggttaccctttaccgtttaacgttttacggtaaccgttaaacgttaccggtaagggttaaccgggttaaccgggttaccgtttttaacggttccggttttaaccggtttttaccgggggttaaaaccgggtttccgggggttaaaaccccgttaaacgggttaacccgttaacggtttacccgggtttaaacccggttacggggttaaccccgtaacccgggttaacccccgtaaaccccgggg

SEQ ID NO: 234113 - DNA, 800 bp, Homo sapiens
  misc_feature: GYAE6OF02H7D07.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgctcctcaccctcctcactcaggcacagggtcctgggcccagtctgccctgactcaggctgcctccgtgtctgggtctctaggacagtcgatcaccatctcctgcactggaaccagcagtgacggttggggtatgactatgtctctggtacagcaatatccaggcaaccgacgacccccctaaaagtcacttacctaattttacgtaggtaacggttccaaaggttaacgtccggtccccttaggtaacgggggttttcctaaacgttcggtcctttcgttacgttcgggtacttaccgaacggtttcttacgggaccctaaaccgtaccgggtccccctttcccggtacgtaaacccgtactttaccccgttcggtaacggggtcccttaccgacggggttaccgtaggtaaacggggtaaccggtaggggttacccttaaggttaaaccgttttaacgttaaccgttaggaccttaacggtaccttcgttaagttttacggactttaaaacgtccgtaaaggttacggtaacggttacctttagttaccgggtttaccggtttaaacggggtaaacgggttccggggtaaaaccccgtttaaagggtacccttaaccggttacccgggttaaccccggttaacgggttaacccgtaaccccggttaaccccgtaaaacccccgggg

SEQ ID NO: 234114 - DNA, 673 bp, Homo sapiens
  misc_feature: GYAE6OF02JBTKI.39.86.H09.1.454.CMB.1.raw
  modified_base (177)..(177): a, c, t, g, unknown or other
  misc_feature (177)..(177): n is a, c, g, or t
  modified_base (239)..(239): a, c, t, g, unknown or other
  misc_feature (239)..(239): n is a, c, g, or t
  modified_base (263)..(263): a, c, t, g, unknown or other
  misc_feature (263)..(263): n is a, c, g, or t
  modified_base (332)..(332): a, c, t, g, unknown or other
  misc_feature (332)..(332): n is a, c, g, or t
  modified_base (339)..(339): a, c, t, g, unknown or other
  misc_feature (339)..(339): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacgagggtccgtcgggccccaggtcctcggcccctaggactcgngggctgccctccgtgtctgggtctctaggcagtcgatccacatctcctgctactaggaaccngcacgtggtacggttgggggttanggactagtcgtctccgtggtaacctgactaatctaccgaggacaccgaccgacccctaaagtcatactntttaagngaacggtctaacgtactcccggaccttacgggttcggttaactacgttccgtacttccgtagttccgaccttacgtacgtcgtcgaaccgtacaccggtcctccgtacgcctactcgttacgcggtacctcgtacgtacggtacggacgtcggtacgtaccgttgtaaacctttgtaccgtcgacgttacggtcctacgttagttacgacttaaccgtgtaacgtagggtactttacgtgttacggttacgggttaaccgaagggttacggtaaaccgtaactttccggtacttaccggttccgttaccggacaccccggttaacccggacccg

SEQ ID NO: 234115 - DNA, 842 bp, Homo sapiens
  misc_feature: GYAE6OF02IESPJ.39.86.H09.1.454.CMB.1.raw
  modified_base (211)..(211): a, c, t, g, unknown or other
  misc_feature (211)..(211): n is a, c, g, or t
  modified_base (241)..(241): a, c, t, g, unknown or other
  misc_feature (241)..(241): n is a, c, g, or t
  modified_base (353)..(353): a, c, t, g, unknown or other
  misc_feature (353)..(353): n is a, c, g, or t
tcagtcgcactagtcacgaccggtgctcgatttagtgctatagacttgggttggggtctcaggaggcagcgctctcaggacatctccaccatggcctgggctctgctgctcctcaccctcctcactcaggcacgagggtcctgggccctagtcgtgccctgactcagcctgcctcgtgtctggtctcctaggctagtcgacctacaccgtntcctcgtgactacgtacggaacctaggacnggtcgtaccgttggttcgttaacacgtaatcgtccttccgacggtacctaaacaaccgacccggtacaaccgcccccgaaagtcctacgtagttaacttagtcgtaaccgtntaaccgtaagtacccgaccgttacggtacgggttcgtactaacgtcctctttacctacgtcggtaccgcgtaacgttcgtacgggaacctaaccggacccggttaccctacccgtagtacccttagtacccttaccggacgggtccctaccggtaggtccttaacgggacgtaacggtaaggtccgttagttaacgtttaacgttaccgtggcccgtaaagtccgtttacaaacgttacgttaacggtaacgtaaaccggtcgttttaaaaccggtttaaccgttcggtttttaaacccccgggtttacgggggtacccgggtaaacgggggttaacctaaccccggttcggggttttaaccccctaaaccgggggttttaaccccggtaccgggtttaaacccgggtaacccggttacccccgggtaaaaagggggttccccccttttaaccccggggtccccccgtttaacggggttaaaccccccg

SEQ ID NO: 234116 - DNA, 624 bp, Homo sapiens
  misc_feature: GYAE6OF02I40R2.39.86.H09.1.454.CMB.1.raw
  modified_base (224)..(224): a, c, t, g, unknown or other
  misc_feature (224)..(224): n is a, c, g, or t
  modified_base (269)..(269): a, c, t, g, unknown or other
  misc_feature (269)..(269): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcacgtggaancagcagtgacgttggtagttataactatgtctcctggtaccaacngcaccgagacaaacgcccccaaactcatagtatttagtgaggtacaagtactcggacctcgtagggtttactagtcgtcttctcgtggctctaagtctgaccacgtaccggtccctcctacgacctactctcgtcgggtcctaccgacggtcgtacggacggacgacgggtctacgtatttaacgttacgtcgactagtcctactaacgtaactacgaacgtacgagacgagaccttaacgtttcggtttagtacgggttaccggtttacggggaccggggtaacgggtaaccgtaacggtccggttaaccgggtacccggtttacccgtacgggtaccgacccggtaaccccgg

SEQ ID NO: 234117 - DNA, 758 bp, Homo sapiens
  misc_feature: GYAE6OF02ISFOW.39.86.H09.1.454.CMB.1.raw
  modified_base (248)..(248): a, c, t, g, unknown or other
  misc_feature (248)..(248): n is a, c, g, or t
tcagtcgcactagtcacgaccggtgctcgatttagtgctatagacttgggttgggggtctcaggaggcagcgctctcaggacatctccaccatggcctgggctctgctgctcctccaccctcctcactcagggcacgagggtccgtcgggcccagtctcgcccgtgacctcgacggtctcgccctccgtgtcgtgggttctcgtacggacagtcgatccacctactcctcctgcctacgtaggaaccngacgaggtcgtacggggtttaggggttatgtaacttagttcgtccgttccggtacgtaccgtaagactaagttaccgtaccgacggaccacccgaacccgaacccccaaagtacacttaacttaacgtttgacgggttaacgtacgtaacgtaccggtccccggtaccgtacgggttacggtttacctacgtccgttccttctcgtcgtaccttacgacggttccgtaacgaccgaaaccggtccctccttaccctacgtaccctacttccgtacggtcccgtaccgtacgtacgggtccgaggtaccgggtcggtacgttcgttaaacgttacgttacgacgtcgtaactcggttacgtaccttacgtaccgtaacgtaacgttacgtacggtggttaacccgtttagttacggttgtttaaccgggtagggtaccgggtaacggttaacccgtagtaccgttacggttccggtaacggttccggaaccgtaccccgacgggtaacccc

SEQ ID NO: 234118 - DNA, 702 bp, Homo sapiens
  misc_feature: GYAE6OF02JAUXN.39.86.H09.1.454.CMB.1.raw
  modified_base (222)..(222): a, c, t, g, unknown or other
  misc_feature (222)..(222): n is a, c, g, or t
  modified_base (234)..(234): a, c, t, g, unknown or other
  misc_feature (234)..(234): n is a, c, g, or t
  modified_base (421)..(421): a, c, t, g, unknown or other
  misc_feature (421)..(421): n is a, c, g, or t
tcagtcgcactagtcacgaccggtgctcgatttagtgctatagacttggggtttgggggggggtctcaggaggcagcgctctcaggacatctccaccatggcctgggctctgctgctcctcaccctcctcactcgagggcacgagggtcctgggcccagtctgccctgactcaggctgtcctcgtgtcgtgggtctctaggacagtcgatcacctatctctncactaggaaccngcagtgtacggttgggtatgtactagtcgtctcgtagtaccagctaatacgtccgaggtaccaccgtaccgaccccctaaatccactcgtaactttgagtacgtacgtagtacgtccgtacctaggttacggttactacgtccgtcttacgtcgtcgtctactagtccgagtaccacgtccgctccncgtactacttccgtacggtcggtacctcgacggtcgtacggacggacggttacgtctagtaacgtttcgtacgtcgtaacgtccgtacttacgttaacgttaccgtaacgtacgttacgtacgggttacgtaacggttccgtttaggtttaaccggttaccgggttaaaccgggtaccgggggttaacggttaaacccgggttaaccggttacgttaacccgggttcgggttaaccccgttagggtacccccggttaaccggaccccggtaaacccccggg

SEQ ID NO: 234119 - DNA, 749 bp, Homo sapiens
  misc_feature: GYAE6OF02H60DK.39.86.H09.1.454.CMB.1.raw
  modified_base (184)..(184): a, c, t, g, unknown or other
  misc_feature (184)..(184): n is a, c, g, or t
tcagtcgcactagtcacgaccggtgctcgatttagtgctatagacttgggtttgggggctggggtctcaggaggcagcgctctcaggacatctccaccatggcctgggctctgctgctcctccacctcctcactcgacgggcacgtacgggtcctcgggaccctagtctcggccctagactacncgcctcgtcctccgtgtacgtgacgtacctcgtaggactagtaccgactacctacctactcctccgtagaccgtacgtacgaaccaggacaggttcggtacggttggtataactttaataagttcgttctccgttacgtagtaccaatcgtactgtacgacgtaccgcgacccggtaacctaagtttactaacgttggtacgacgttttccgtccggaccgtccgttaggtcgttctacggtctccgttccgccgtataccgtcgtactacggtaaccaccggtccgttccctacgtaactcctaaccgttcgttaaccgtacgtaccgttcgtaacggtacgtagggtaaccggtaggtaacccgttacgttaacggttaaacgttttccgtacggtacgacggttaccgtacgtttaataccgttaaggtacgttacgtaacgttacgtaaggtttaccgttccgacgttccggttcggtcgttaccggggaccggtaacggggtaacccttacggttacggacccgttaccggttaccggacgttcccggaaccggtaccgg

SEQ ID NO: 234120 - DNA, 623 bp, Homo sapiens
  misc_feature: GYAE6OF02JDJN0.39.86.H09.1.454.CMB.1.raw
  modified_base (285)..(285): a, c, t, g, unknown or other
  misc_feature (285)..(285): n is a, c, g, or t
  modified_base (306)..(306): a, c, t, g, unknown or other
  misc_feature (306)..(306): n is a, c, g, or t
  modified_base (318)..(318): a, c, t, g, unknown or other
  misc_feature (318)..(318): n is a, c, g, or t
  modified_base (467)..(467): a, c, t, g, unknown or other
  misc_feature (467)..(467): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacgagggtcctgggcccagtctcgccctgactcaggctgcctccgtgtcgtgggtctctaggacagtcgatcaccattcctcctgcactaggaaccagcagtggtacggtttggggttatgtactatgtcctaccgtgtacagactaatacncgagcacaccgaccccaactnactctatttagngtagtacagtagtccgcctggtacggttactagtctcttctcgtcggacctacgacgtcgtacgaccaacgtcccgccctcctacgtacctacgtcgtcgtacgggccctcgacggtcgtaggacggagaggtctagttacttactcgngtactcgtaccttagttacttagtaccagttacgtaggtacgtcgttacttagttcgttaaccgggtttaagggaacggttacgggtaaacgttaacgggttacctacggttaccggttaccgtacggtacccgaccggtaaccccggtaaccccg

SEQ ID NO: 234121 - DNA, 593 bp, Homo sapiens
  misc_feature: GYAE6OF02FVMG3.39.86.H09.1.454.CMB.1.raw
  modified_base (247)..(247): a, c, t, g, unknown or other
  misc_feature (247)..(247): n is a, c, g, or t
  modified_base (303)..(303): a, c, t, g, unknown or other
  misc_feature (303)..(303): n is a, c, g, or t
  modified_base (444)..(444): a, c, t, g, unknown or other
  misc_feature (444)..(444): n is a, c, g, or t
  modified_base (457)..(457): a, c, t, g, unknown or other
  misc_feature (457)..(457): n is a, c, g, or t
tcagtcgcactagtcacgaccggtgctcgatttagtgctatagacttggggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctcctgcactggaaccagcagtgtacggttgggggttangactatgtctccgtggtaccagcaatatccgaggcacacgcccccaatcatcattngagtcagtactcggcctgtagggttactatcgtcttctcgtgctacaagtctggacaacgcggtccctcccgtgaccctatccgtcgtcggcctccgaggcgttaggacggacgtaggctagttacttagttacgtgaccngtctattagtttnactacgtcgtagtgtacgtcttacgttggttaccgttacgggtaacgggtaccggtaaccggtaacggttaccacggtttcccgttaccgggtacgggtaccctaacccgggtaccccgaacccgggtaacccccc

SEQ ID NO: 234122 - DNA, 667 bp, Homo sapiens
  misc_feature: GYAE6OF02HG9AZ.39.86.H09.1.454.CMB.1.raw
  modified_base (599)..(599): a, c, t, g, unknown or other
  misc_feature (599)..(599): n is a, c, g, or t
  modified_base (647)..(647): a, c, t, g, unknown or other
  misc_feature (647)..(647): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgtacggttgggggttatgactagtcgtaccgtctggtacccagactaacttactccgaaggactaacccgaccgtaaccccccaaagtactactacttaactttaacgaggtacggtcaagttaccggtaccggtacccgttacggttacggggtttaccttaaacgtccgtcctttaccgtcgtaccggtaccgttacctaacggttcgtcgggtaccaaaccggtaccggtccctacccgtaacgacccgtaacttccgtccggttcggaccttccggacgcggtaggacggacggttcggtacgttacggatttaactccggagttccgagttctacgtattgacttacgtgagtagacgttacgtnttcggtacgtagggagttccggaacgtagtaccttggtccgttaccgngtaccacggtacccaaccgg

SEQ ID NO: 234123 - DNA, 707 bp, Homo sapiens
  misc_feature: GYAE6OF02I3NZ3.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctcgtaggacagtcgatcaccatctctgcactggaaccagccagtgacggttggggttatgtactatgtctcgtaggtaccagacaatactaccacggtacaccacgacccccaaactcactactaatttacagtagtcaagttacgcgtaccctacgtagggtttactaagtcgtacttctacgtcggtactacgtaacgttcgtagacccaaacgtaccggtccctaccgtcgaaccctaactcgtaaccggtcgggtcctaccggtacggttcctaggtaacggtaccggtaacgggtcgtaacgttatttaaaccgtacgttcgaccgtaacttacgtaccgtaagtttccgtaacgaaccgttgtaacgttaacgggtaccgtttaacttacggttacggtttaaccggttaacggggaaacggttaaccgggaacccgttaacgggttacgtacggtttacccggttaaccggttaaccgtaccgggttaaccccgaccgggttaaaacccccggg

SEQ ID NO: 234124 - DNA, 252 bp, Homo sapiens
  misc_feature: GYAE6OF02GDKFC.39.86.H09.1.454.CMB.1.raw
  modified_base (241)..(241): a, c, t, g, unknown or other
  misc_feature (241)..(241): n is a, c, g, or t
  modified_base (246)..(252): a, c, t, g, unknown or other
  misc_feature (246)..(252): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccaccctcctcactagtgcgactgagcgggctggcaaggcncatgnnnnnnn

SEQ ID NO: 234125 - DNA, 716 bp, Homo sapiens
  misc_feature: GYAE6OF02FQ6OQ.39.86.H09.1.454.CMB.1.raw
tcagtcgcactagtcacgaccggtgctcgatttagtgctatagacttgggtttggggggggggtctcaggaggcagcgctctcaggacatctccaccatggcctgggctctgctgctcctcaccctcctcactcagggcacagggtcctgggcccagtctgccctgactcaggctgcctccgtgtcgtgggtctctaggacagtcgatcaccatcctcctgcactggaaccagcagtggtacggtttggggggttatgactatcgtctccgtggtaccagcaatactccgaggcacaccgacccccaaactccactactaatttataggtacggtactagtaacgtccggcccttacggtacgggtttactacgtccgtctttctcgtcggtacctccgtaacgtcgtacgtaccaaccgacccgtccctccgtaccgacctacgttccgtcggtccgggtcctcccgacgggtcgtacgggaacgggacggtaacggtcgttaagttaacttacgttacgtcgtactaccggttaccttcttaacgtttcggaacttaacgttacggtaagggttacggtagttaccgtttacgttccggttaggtttaaccgggtaacggggttacggggtaaacccggttaacggttacgttaacggttcccggttaccggttaaccgggttaccggacccggtaacccccgtaaaccccggg

SEQ ID NO: 234126 - DNA, 701 bp, Homo sapiens
  misc_feature: GYAE6OF02IZQ3A.39.86.H09.1.454.CMB.1.raw
  modified_base (212)..(212): a, c, t, g, unknown or other
  misc_feature (212)..(212): n is a, c, g, or t
tcagtcgcactagtcacgaccggtgctcgatttagtgctatagacttgggttgggggtctcaggaggcagcgctctcaggacatctccaccatggcctggctctgctgctcctcaccctcctcactcagggcacagggtcctgggcccagtctgccctgactcaggctgcctcgtgtccgtgggtctctaggacacggtacgactcaacctntaccgtccctgccaacgtcggaaacccagccgtaaggtcggtacgggtttagggggttaatcggaactagttcgtccgtccgttaggtaaccctaggacctaattacgtacacggaacaacccgaccgaacccctaatccacgttaactaattaggtagtaacgtacaacgttacgtcccgaaccgtgtaacggtttctaagtctacgttcacgttcgacgttacaacgtccgtacgtaaccaaccgtaccgggtaccccttacgtaccgtaactactccgtaccgttcgggtacccgtacggaccggttacgacggtaacggaaggtacgtacgtacgttaattacgttacacgtccgtaacgtagtacgtttactacgacgttaactgttaaaccgtcggtaacttctacgtttacgtacggtaaacggtggtaaacgacggtaacgtacgtacgtacgtaccgtacgaccgtacgaccgtaacccg

SEQ ID NO: 234127 - DNA, 639 bp, Homo sapiens
  misc_feature: GYAE6OF02IXWD5.39.86.H09.1.454.CMB.1.raw
  modified_base (159)..(159): a, c, t, g, unknown or other
  misc_feature (159)..(159): n is a, c, g, or t
  modified_base (213)..(213): a, c, t, g, unknown or other
  misc_feature (213)..(213): n is a, c, g, or t
  modified_base (334)..(334): a, c, t, g, unknown or other
  misc_feature (334)..(334): n is a, c, g, or t
tcagtcgcactagtcacgaccggtgctcgatttagtgctatagacttgggttgggggtctcaggaggcagcgctctcaggacatctccaccatggcctgggctctgctgctctcacctcctcactcaggcacaggtcctggccagtctgccctgacctnaggctcgcctccgtgtcgtgggtctcgtaggacgtagtcgatcaccatctcgtncactggaacctagcagtagtacggttggggttatggacttagtcgtccgttccgtacggtacctacgactaactagtccgaggtaccacaccgtaaccccaaatccaacttataatttacnggtacgtacaagttaactccggtacctacggttacgggtttactaacgccgttacttccgtacgtcggtactttaccgtagttaccgtgtaccaaacgtaccggtcctcccgtactaacgtactccgttacgtcggccgtaactgtacgtagcggaacggtagtactacgtaattacgtactcgactacgtctactgtttacgactaagtctaaggtcgtagtcttagttcgttacggtcgttaaacgggtctaacggtacgtaccgcgttaactagtcccggttaacgacgacccgtaacccgg

SEQ ID NO: 234128 - DNA, 749 bp, Homo sapiens
  misc_feature: GYAE6OF02GXVZL.39.86.H09.1.454.CMB.1.raw
  modified_base (597)..(597): a, c, t, g, unknown or other
  misc_feature (597)..(597): n is a, c, g, or t
  modified_base (632)..(632): a, c, t, g, unknown or other
  misc_feature (632)..(632): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggccacgagggtcctgggcccagtctcgccctgactcaggctcgcctccgtgtcgtggtctcgtagacgagtcgatccacatcctctgaccacgtaggaaccagtcagtggtacggtttagggggttatacggtacttagttcgtccgtaccgtacggtaaccgtataacgtaatacgtccgaacggacctaaccgaccccgtaaccccctaaaatcctaagttaccttaagtttaacgcgtaacgttactaagttaaccgtcccggaccttacgggtaacggtttacctaacggtccttaccgttcgtaccggtacgtaccgtaaccgtaacgttcgttaccggaaccctaaaccggtcccggtaccccttaacccggtccggtaacccttacggtccgtccgggtaccgccgtaccgtacgggacgtacggaggtacgacggtcttaagtaatttcctaaggtcncggaccgttctaccgttattacgaacgttaaccgngttaaccggtaggttacctttacggtagtttaacggtcccgttaaggggtaagtaccccggtaagtacgtcgtaaccgttcgtaaccggtaccggctaaccccgacggtaacccccg

SEQ ID NO: 234129 - DNA, 784 bp, Homo sapiens
  misc_feature: GYAE6OF02FN6UE.39.86.H09.1.454.CMB.1.raw
  modified_base (165)..(165): a, c, t, g, unknown or other
  misc_feature (165)..(165): n is a, c, g, or t
  modified_base (218)..(218): a, c, t, g, unknown or other
  misc_feature (218)..(218): n is a, c, g, or t
  modified_base (257)..(257): a, c, t, g, unknown or other
  misc_feature (257)..(257): n is a, c, g, or t
  modified_base (505)..(505): a, c, t, g, unknown or other
  misc_feature (505)..(505): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcgagggcacagggtcctgggcccagtctgccctgactnacggctgcctccgtgtcgtgggtctacgtaggacagtcgatcaccatcctccngccactcggaaccagcaggtggtacggtttgggggttancgtacttatcggttaccttccggtacgtaccgagtactaaataccgtccgaaggacccaccgaccggaccccctaaaactcctaagttactaagtttacgcggtaacggtactaacggtacgtcccggtacccttaggttaacgggtttcctaatcccggttctttaccgttcggacgttaccgttacctacggttccgtaacgggaccttaaacccggcccgttcccttaacccgtccggtaacccncggtttctccgggtacccggtaccgttaccggacgggtccggtaacggaaccggggtcggtaacggttcgttacgttaagtttacccgtttaagtccgacgttacgtacccttacgttacgttaccgacgttaaccgttcgtaacggttagttaacgggttctttaccgtacggttacgggttaaccggttaacggggtaccggtaaccgttacggtacccgttacggttaccccggtagtttacccgggtacccgtaacccggtaacccggaaccccg

SEQ ID NO: 234130 - DNA, 748 bp, Homo sapiens
  misc_feature: GYAE6OF02JMEYJ.39.86.H09.1.454.CMB.1.raw
  modified_base (129)..(129): a, c, t, g, unknown or other
  misc_feature (129)..(129): n is a, c, g, or t
  modified_base (233)..(233): a, c, t, g, unknown or other
  misc_feature (233)..(233): n is a, c, g, or t
tcagtcgcactagtcacgaccggtgctcgatttagtgctatagacttgggtttggggggggtctcaggaggcagcgctctcaggacatcctccaccatggcctgggctctgctgctcctccaccgtccncactcgagggcacgtagggtcctcgggcccagttctcggccctgacctcgaggtctcgcctccgtgtcttgggttctacgtacggactacgtcgatccaccgtntcctccgtagccacgtacggaccaggctaggtcggtacggtttggggtactcgttactagtcgtacctcgtacggtacgacgtactaactacgtaccgacggacctacgtacccgaacccctaacgtacctacgttacctttaagttacgtaggttacgtacttaacgttaccggttcccggtacccggttacggttaaccggggttttcctaacggttccttcgtttaccgtaccgtacggtaccctaaccggtagttccgtaccggtacaacccggtcccgtccctaccgtaccgtaccgtactcgttaaaaacggtccggtaccgtccgtacgtacggtacggacggtacggtacggtacgttacgttacttacgttacgtacgtcgtacgtaccgttacgttacgttacgtacgtacgtacggtacggtacggtacgttcgttacgttacgttacggtacggtacggtacgtacgtacgtacgtacgtcgtcgtacgtcgtacgacgaccg

SEQ ID NO: 234131 - DNA, 583 bp, Homo sapiens
  misc_feature: GYAE6OF02HF7P2.39.86.H09.1.454.CMB.1.raw
  modified_base (219)..(219): a, c, t, g, unknown or other
  misc_feature (219)..(219): n is a, c, g, or t
  modified_base (248)..(248): a, c, t, g, unknown or other
  misc_feature (248)..(248): n is a, c, g, or t
  modified_base (515)..(515): a, c, t, g, unknown or other
  misc_feature (515)..(515): n is a, c, g, or t
  modified_base (529)..(529): a, c, t, g, unknown or other
  misc_feature (529)..(529): n is a, c, g, or t
  modified_base (535)..(536): a, c, t, g, unknown or other
  misc_feature (535)..(536): n is a, c, g, or t
  modified_base (538)..(538): a, c, t, g, unknown or other
  misc_feature (538)..(538): n is a, c, g, or t
  modified_base (540)..(541): a, c, t, g, unknown or other
  misc_feature (540)..(541): n is a, c, g, or t
  modified_base (543)..(543): a, c, t, g, unknown or other
  misc_feature (543)..(543): n is a, c, g, or t
  modified_base (546)..(546): a, c, t, g, unknown or other
  misc_feature (546)..(546): n is a, c, g, or t
  modified_base (550)..(550): a, c, t, g, unknown or other
  misc_feature (550)..(550): n is a, c, g, or t
  modified_base (561)..(561): a, c, t, g, unknown or other
  misc_feature (561)..(561): n is a, c, g, or t
  modified_base (581)..(581): a, c, t, g, unknown or other
  misc_feature (581)..(581): n is a, c, g, or t
tcagtcgcactagtcacgaccggtgctcgatttagtgctatagacttgggtttgggggctgtgcctggatattgctggaaccagcagtgacgttggggttatgactatgtctcctggtaccagcaatatccaggcacagccccccaaatcatcatttactgaggtcagtaatcggccctgagggtttcaatcgcttctctggcctcaagtctggcaacncggccctcctgaccatctcgtggctccgnggctgaggacgaggctagattacttactacgctagcttactatttttgactaagtctagtggaaggtctttagtcggtcgtttacggaaggtaccgggtaccaaggttcatcccggtacttagggtccaaacgtccccggaaggacccccaaccccgttgtacgtcacttcccgtcggttacccccaccccgttctaccgtacctagtcgcgtaccgtcggacgggtcccgggtacgtcggaaccgtaagggtccacgttagtacgntcgtactgctacgntacgcnncncnngngcngagngtcgtcgtctngtagcgcgactgacgacgtnac

SEQ ID NO: 234132 - DNA, 814 bp, Homo sapiens
  misc_feature: GYAE6OF02H7LI6.39.86.H09.1.454.CMB.1.raw
  modified_base (124)..(124): a, c, t, g, unknown or other
  misc_feature (124)..(124): n is a, c, g, or t
  modified_base (129)..(129): a, c, t, g, unknown or other
  misc_feature (129)..(129): n is a, c, g, or t
  modified_base (278)..(278): a, c, t, g, unknown or other
  misc_feature (278)..(278): n is a, c, g, or t
tcagtcgcactagtcacgaccggtgctcgatttagtgctatagacttgggttgggggtctcaggaggcagcgctctcaggacatctccaccatggcctgggctctgctgctcctccaccctccncactnagggcacagggtccgtcgggcccagtcgtcgccctgactcaggctgcctccgtgtctgggtctcgtagacagtcgatccacatcctctgctacctggaaccgagcgagtcgacggttggggttaatgacttatcgtcctcctcgtaccngacaatctaccgaggacaccgaaccgtaccccctaactacctactacttacgttacgtaggtaccggtacgtaacgttaaccgtaccggttcccgttaacggttacggggttttaacctacgttccggtttcttccgttccgtacgggttacctaccgttaacgtccgtacgggacccacccgtacccggtcccttaaccctccggaaccttacctccggttcgcggtaccgaccgtacggtacgtcggggtaaacggtacgggacgttacgttaacgttacggttttaaactaaccgttcggtaaacttcgggttacctttaaccgggttatttaacccgttacggaaaccttacggttacgggtaacccggggtttaacgttaccgttttaccgggtttccggtttaaacgggttttaacccggggaacgggggttaaccgggttaaaccggttccggttaaccgttacccggtttccgggtttacccgggtaacccgttaaaccgggtacccgtaaccccgtaaacccccggg

SEQ ID NO: 234133 - DNA, 762 bp, Homo sapiens
  misc_feature: GYAE6OF02JGSZP.39.86.H09.1.454.CMB.1.raw
  modified_base (119)..(119): a, c, t, g, unknown or other
  misc_feature (119)..(119): n is a, c, g, or t
tcagtcgcactagtcacgaccggtgctcgatttagtgctatagacttgggtttggggggggtctcaggaggcagcgctctcaggacatctccaccatggcctgggctctgctgctcctnaccctctcactcagggcacagggtcctgggcccagtctgcctgactcaggctgcctcgtgtctggtctctaggactagtcgatcaccattctcctgacactaggaccagcaggtgcgtttaggggtactgactagttcgtcctactacggtaccaggtacctaagtacgtaccgaggtacctaccgaccgtaccccctaaacgtctaacgtccgttaacgtttagtcggtaacgtacgtaacggtacgttaccggtcccgttacggtaggggtttaccctaagggttccttccgttacgttccgtacggtaccgttactaggttacttacggaccgtaaaccggtccgtacccgttaccggtacgtaccttaacgtccgtacggttacccggtccttacggtacggtcccggttaaggaccggtacggtaaccggttagttaaccgtaagtttaccgtaccgttaccggtacgtaccggttacgttaccgttaagtttccgaacgttaactaccggtacggttaacgtacggttaccctttaggttacccggtacggtttaacggaccggtacggtaaccggttcggttactacccgggttacgtaccggttacggttaccgaccgttaacccggtaaccggg

SEQ ID NO: 234134 - DNA, 577 bp, Homo sapiens
  misc_feature: GYAE6OF02JIS4X.39.86.H09.1.454.CMB.1.raw
  modified_base (429)..(429): a, c, t, g, unknown or other
  misc_feature (429)..(429): n is a, c, g, or t
  modified_base (445)..(445): a, c, t, g, unknown or other
  misc_feature (445)..(445): n is a, c, g, or t
  modified_base (461)..(461): a, c, t, g, unknown or other
  misc_feature (461)..(461): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactgaaccagcagtgacgttgggggtatgactatgtctcgtaggtaccagctaatactccaggcacaccgacccccaactcatctatttatgagtacagtaactccggtcctacgtagggtttactaacgtcgtcttctcgtcgtcctacgtaacgttcgtaggaccacgaccgtccctcccgtacgacctactctcgtcggtcctacgnggtctaggacggacgngcgtgtacttagtacngcgatctacgtagttcgactactcgtagtgtacgttcttaggttcgtcggttacgggacgtacgggtacctaaggtctcgttaccggtaccgttaggcccgtacgacccgtaaccg

SEQ ID NO: 234135 - DNA, 752 bp, Homo sapiens
  misc_feature: GYAE6OF02G39L5.39.86.H09.1.454.CMB.1.raw
tcagtcgcactagtcacgaccggtgctcgatttagtgctatagacttgggggggggggtctcaggaggcagcgctctcaggacatctccaccatggcctgggctctgctgctcctcaccctcctcactcagggcacgagggtcctgggcccagtctgccctgactcaggctgcctccgtgtctgggtctctaggacagtcgatccaccatctcctgcactggaaccagcagtgtacggttggggtatggacttagtgtctccgtgtaccagactaatatccaggccaacaccgacccccaaatcactcgtaatttactggtacggtacaagttaacgtcccgtccctacggttacgggtttactaacgtcgtacctttctcgtacggtcctacgtaagttcgtacggaaccgaacgacccggtccctttaccgtacgtaaccctacttccgttaccgtcgggtaccctaccggacgggtcgtacgggtaacgggaccgtaggtacgttagttaaacttacgttacggttacgaccgttacggttacccttacgtttacgtttacggaaaccttaacgttaccgtaagggttacggtacgggtttaccgtttacgtttaccgggtttaccgggtttaacggggtaaacgggttaccgggtaaacccggttaaacgggttaccgtaacgtttcccggttaacccggttacggttacccggaaccccggttaccccggaaaccggtaaccccccg

SEQ ID NO: 234136 - DNA, 837 bp, Homo sapiens
  misc_feature: GYAE6OF02ISTRF.39.86.H09.1.454.CMB.1.raw
  modified_base (205)..(205): a, c, t, g, unknown or other
  misc_feature (205)..(205): n is a, c, g, or t
tcagtcgcactagtcacgaccggtgctcgatttagtgctatagacttgggtttgggggtctcaggaggcagcgctctcaggacatctccaccatggcctggctctgctgctcctcaccctcctcactcagggcacgagggtccgtcgggacccagtctcgccctgactcaggctcgccgtccgtgtcgtgggtcctcgtaggacngtcgactcacatcctctgcacgtggaaccagcgagtcggtaggtttgggggtatacgtacttagttcgttcctaccgtaccgtaccgacgacctaacttacgtacccgaggaccctaaccgaccccgaacccccaaaccttacctaacctttacttaacgttttaacgtcgggttaacggttaccgtaaacggttaaccgtccccggtacccggtttacggttacgggtttacttaacgttccgttcctttcgttcgttccggttcttaaccgtacggttccgtacggtaacccgaacccggtacccggtcccttaccgacccgtacgtccttaccgtcccgttcggtacccgtcggtaacggtccgtacgggaacggtcggtacggtcgtaacgttagtttacgtccttacgcgttaacgccgttacgttaccgttacgtaacgttaccgtttcggtaaacggtttaacggtaccgtttaacggttttaccgttaacggggttttccggtttaaccggggtaaccggggttaaccggggtaaccggtttaaaccggttccggtttaaccggttccgggtttaaccggtacccgggtaccccggttacccggtaccccccgtaaaccccggg

SEQ ID NO: 234137 - DNA, 711 bp, Homo sapiens
  misc_feature: GYAE6OF02HZAK4.39.86.H09.1.454.CMB.1.raw
  modified_base (233)..(233): a, c, t, g, unknown or other
  misc_feature (233)..(233): n is a, c, g, or t
tcagtcgcactagtcacgaccggtgctcgatttagtgctatagacttgggtttgggggctggggtctcaggaggcagcgctctcaggacatctccaccatggcctgggctctgctgctcctcaccctcctcactcaggcacagggtcctgggcccagtctgccctgactcaggctgcctcgtgtctgggtctcgtaggcagtcgatcaccatcctcctgacacgtggaaaccngcaggtcgtacgggtttaggggttatgaacttagtcgtcctccgtcggtaaccaggtactaaaatactaccgaggaccaaccgaaccggacccccaaaatcctaataccttaattttacgaggtaacgttacctaaggttaaaccgtccggtcccgtacggttaagggggttttaccttaacgtcggtccttttcgtacgtacggtcctaaccgtaaggttcaaccgggtaactaacccgacccggttaccctaccccgtagtaacccctaagtttccgtcgttaccgggtacctaccgtacggtaccgtacgggaacggtacgacgggtacttagtaactttaaccgttagcgtaacgacgtacttacgttatttacgaactaagtcgtaagtcgtagtctttacgtcggttagttacgggaaacgttcgggaaccttaaggtcctaagttccggtaacggtccgtaaccgaaccgg

SEQ ID NO: 234138 - DNA, 699 bp, Homo sapiens
  misc_feature: GYAE6OF02HJ2IH.39.86.H09.1.454.CMB.1.raw
  modified_base (224)..(224): a, c, t, g, unknown or other
  misc_feature (224)..(224): n is a, c, g, or t
  modified_base (228)..(228): a, c, t, g, unknown or other
  misc_feature (228)..(228): n is a, c, g, or t
  modified_base (305)..(305): a, c, t, g, unknown or other
  misc_feature (305)..(305): n is a, c, g, or t
  modified_base (467)..(467): a, c, t, g, unknown or other
  misc_feature (467)..(467): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcgagggcacgagggtcctgggcccagtctgccctgactcaggctgcctcgtgtcgtggtctcgtaggacagtcgatcacatctctgcacgtagaccngacngtcggacggtttaggggtactaggacttagtcgtctccgtaggtaccaagtactaactacgtccgaagaccgaaccnccccgtaacccctaactctaactacttatttaggacgtaaggactaacgtacggtccgccgttaggttacggtttacctaagtccgttccttacgtgacgtacctacgtactacgtacgaccaaaccgtccgtacctacctacgtacctcgtccgttacggngggtcctaacggacgttaccgaaggacgggtaacccgtaggtacccgtaagtttacttaaagttcccgtagccgtacggttactaactttcgttaacgtaaccgttaacgtcgtaaaggagtacggttagtttaccgtaggtttaccgggtaacggtagggtaaaccggtaacggtaacgtcttaaccgggtccggtaaccgtaggtacccggaccgtacccggtaaacccg

SEQ ID NO: 234139 - DNA, 639 bp, Homo sapiens
  misc_feature: GYAE6OF02JEDNJ.39.86.H09.1.454.CMB.1.raw
  modified_base (338)..(338): a, c, t, g, unknown or other
  misc_feature (338)..(338): n is a, c, g, or t
  modified_base (341)..(341): a, c, t, g, unknown or other
  misc_feature (341)..(341): n is a, c, g, or t
  modified_base (473)..(473): a, c, t, g, unknown or other
  misc_feature (473)..(473): n is a, c, g, or t
  modified_base (494)..(494): a, c, t, g, unknown or other
  misc_feature (494)..(494): n is a, c, g, or t
  modified_base (521)..(521): a, c, t, g, unknown or other
  misc_feature (521)..(521): n is a, c, g, or t
tcagtcgcactagtcacgaccggtgctcgatttagtgctatagacttgggggggggggtctcaggaggcagcgctctcaggacatctccaccatggcctgggctctgctgctcctcaccctcctcactcagggcacagggtcctgggcccagtctgccctgactcaggctgcctccgtgtcgtcgggtctcgtaggacagtcgactccacccattcctcctggccagtcggaaccagcctaggtggtaacgggtttgggggttatacgtactagttcgtccgtcctggtaccagtctaatactcaggccaacgaccgacccccaatcactctacttanagngtacagttactccggtccttacgtacgggtttactaacgtcgtacctttcgtcgacggtcctactaacggtcgtcggaacccacgtcccggtcccttccgtaccgtaacctacttccgtcggtacggtcccnccgtaggctaggacggtacgnggtctacgtattacgttcgagccgtanctacgttagtccgataacgtccgagggtactggttactagtcgttacgttacgggtaaggtcggtaaccgtaggccgttagtcccgttagtaccggtcaacgggtacccacgtccccg

SEQ ID NO: 234140 - DNA, 670 bp, Homo sapiens
  misc_feature: GYAE6OF02FZLP3.39.86.H09.1.454.CMB.1.raw
  modified_base (314)..(314): a, c, t, g, unknown or other
  misc_feature (314)..(314): n is a, c, g, or t
tcagtcgcactagtcacgaccggtgctcgatttagtgctatagacttgggggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctcctgcactggaaccagcagtgtacggttgggggttatggactagtgtctccgtggtaccagcaatatccaggcacacgacccccaaactcactctactttagngacggtcaagttaacgtccggtacccttcggtaacggggttttctaaacgttccgtactttccgtcgtcggtccttacccgtaaacgtcgtcggaaccgaaaccgtaccggtacccctcccgtacgacctacgttccgttccggtcgggtcctacccggagggtccgtacgggtaacggaccggaacgggtcgtagttaagtttacgttacgtcgacgtacgtctacgtattaacgtacgacgacgagacacgtacctacgttgtttacggtacgggttacggtccggggacgggaacggaacccgtaaggtccgttaccggtacccgttacggtacggtaccgaccggtacccgg

SEQ ID NO: 234141 - DNA, 759 bp, Homo sapiens
  misc_feature: GYAE6OF02F7WVO.39.86.H09.1.454.CMB.1.raw
  modified_base (217)..(217): a, c, t, g, unknown or other
  misc_feature (217)..(217): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacgagggtcctgggcccagtctcgccctgactcaggctcgcctccgtgtctgggtctcgtaggacagtcgatcaccatcctccngcactacggaaccagcaggtacggtacgggtttgggggttatcgactatcgtctccgtacggtacacgacaagtactccgaggtccaaccgtacccggaaccccccctaaaactaccctaacttaccttaagtttaacgtagggtaacggttactaaacggttaaccggtacccggtcccgttaccgggttaacggggttttactaaacggttccttaccctttcgtcgtccggtacctaccgttaacggtccgtacggaacccaaccggtcccgttacccctacccgtaccaccgtacttcccgttacggtccgggtccgtaccggtacggtacggacgggtaacgggttaaccggcggtaacgttacggttaacgttaacgtttaccgtgtaaccgtgtaccttcgttaagttcgtaacttaacgtaacgtacggtagtacgtttacttagttcggttaaccggttacgggtaacgtacgggtaacgtacggtacgttacccggttacgtacgtacggtactaccggtaccgaaccccgg

SEQ ID NO: 234142 - DNA, 622 bp, Homo sapiens
  misc_feature: GYAE6OF02JI8Z1.39.86.H09.1.454.CMB.1.raw
  modified_base (319)..(319): a, c, t, g, unknown or other
  misc_feature (319)..(319): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaccagcagtggacgttgggggttatgactatcgtctccgtgtaccagcaatactccgaggcaccacgacccccctaaatccaatcctatttacgngtaggtactaagttacgtccggggaccctcggtagggtttctaagtccgtcttctcgtcggctaccaagttctggtaccaacctccggccctccgtcgacctatccgtcgtaggtccctaccgaggtcctaggacggtacgtacgtccgttagtacttacttacgacgctagtacttcgtatttcgactaattcgtaggtcgtacggtctttacgtacgttcggttaacggaaggttaccggaacgtaacggttcctacgttaccggtacccttagggtccctaccggtaccccgtaacccgg

SEQ ID NO: 234143 - DNA, 657 bp, Homo sapiens
  misc_feature: GYAE6OF02IAT04.39.86.H09.1.454.CMB.1.raw
  modified_base (171)..(171): a, c, t, g, unknown or other
  misc_feature (171)..(171): n is a, c, g, or t
  modified_base (519)..(519): a, c, t, g, unknown or other
  misc_feature (519)..(519): n is a, c, g, or t
tcagtcgcactagtcacgaccggtgctcgatttagtgctatagacttgggggggggggtctcaggaggcagcgctctcaggacatctccaccatggcctgggctctgctgctcctcaccctcctcactcagggcacagggtcctgggcccagtctgccctgactcaggctncctccgtgtctgggtctcgtaggacgtagtcgatccacctacttctcctgacctaccgtaggaaccagccgaggtggtacgggtttggggttatagacttatgtcctcctacggtaccagctaatactccgaggacctacgaacccgacccccaaacgtcctactactatttataggacgtacgtaatacgtcccggcctcggttaacgggtttctaagtccgtcttactcgtacgcctacacgttcacgaccacggaccgtaccctccctacgtaacctgtcctcgtcggtacctcgagtcgacggaggcgaggtctagtaattaccgttagcgtcagtcctacgtnttacgaactacgttacgtaggtacggtagtcttagttcggttacggtaacgggtaagggtaccggtaacgtaacggttactacggttaccgtaaccggttacggtaccccgaccggtaacccgacccggtaacccccg

SEQ ID NO: 234144 - DNA, 611 bp, Homo sapiens
  misc_feature: GYAE6OF02HOIV2.39.86.H09.1.454.CMB.1.raw
  modified_base (340)..(340): a, c, t, g, unknown or other
  misc_feature (340)..(340): n is a, c, g, or t
  modified_base (377)..(377): a, c, t, g, unknown or other
  misc_feature (377)..(377): n is a, c, g, or t
  modified_base (539)..(539): a, c, t, g, unknown or other
  misc_feature (539)..(539): n is a, c, g, or t
  modified_base (544)..(544): a, c, t, g, unknown or other
  misc_feature (544)..(544): n is a, c, g, or t
  modified_base (579)..(579): a, c, t, g, unknown or other
  misc_feature (579)..(579): n is a, c, g, or t
  modified_base (587)..(587): a, c, t, g, unknown or other
  misc_feature (587)..(587): n is a, c, g, or t
  modified_base (589)..(589): a, c, t, g, unknown or other
  misc_feature (589)..(589): n is a, c, g, or t
  modified_base (595)..(595): a, c, t, g, unknown or other
  misc_feature (595)..(595): n is a, c, g, or t
  modified_base (606)..(606): a, c, t, g, unknown or other
  misc_feature (606)..(606): n is a, c, g, or t
tcagtcgcactagtcacgaccggtgctcgatttagtgctatagacttgggtttgggggctgtgcctggatattgctggaaccagcagtgacgttggggttatgactatgtctctggtaccagcaatatccaggccacagacccccaaatcaatctatttatgacggtcagtaatcggccctctaaggggtttctaaatcgtcttcgtcctggccttaccaacgtctcggactaaccgacggccttacctgaaccacttccgtccgtgggacctcccgaggccgttaggaccgggaacgtaggaccgtagtacgtttaacttacgtggacccaggtccctntaagtttcgacctaatcgaagtcggaagttctttaancggtacttaggacgtcggacctaggtcaactcgtacgtaggcacgtacgacggaccctacccagtcgtaccacgtcttcccgtaccctacccgtcctacgtaacctagcgacgtactcgaggtcgtccgtacggtacgaacgttacggctaaacgtggaatntacgncgatccggaatgagcctgaccgagttgataggtancgatacgnanagagancgcgtacgacncatac

SEQ ID NO: 234145 - DNA, 712 bp, Homo sapiens
  misc_feature: GYAE6OF02G6JH1.39.86.H09.1.454.CMB.1.raw
  modified_base (267)..(267): a, c, t, g, unknown or other
  misc_feature (267)..(267): n is a, c, g, or t
tcagtcgcactagtcacgaccggtgctcgatttagtgctatagacttggggggggggtctcaggaggcagcgctctcaggacatctccaccatggcctgggctctgctgctcctcaccctcctcactcagggcacagggtcctgggcccagtctgccctgactcaggctgcctccgtgtctggtctctaggacagtcgatcaccatctcctgcactggaaccagcagtgacgttggggtatgactatgtctcgtggtaccagcaatntccaggcacaccgaccccaaactcactctatttatggtacgtacacgttaagccggtacctacgtagggttactaacgttcgcctttacgtcgtggtcctaccgtaagtccgtcggacctaaccggaccggtccccgtacccgtacgaccctacgttaccgttaccgttccgggtacccgtcccggacggtaccggacggttttttaacgggaaccggtacggttaccgttacggttaacgtttaacgtttacgttacgacgtacgtaccgttaccgttaaccgtttcgtaacgttaacgttacgtacggttacggtaacggttaccgtttagttacggtttcgggtttaaccggggtaacgggttacgggtaaccggtaacggtaccgtaccgttacggttccggttacggtaccgacccggtaccccggaaccgtaacccccg

SEQ ID NO: 234146 - DNA, 653 bp, Homo sapiens
  misc_feature: GYAE6OF02GJLSX.39.86.H09.1.454.CMB.1.raw
  modified_base (229)..(229): a, c, t, g, unknown or other
  misc_feature (229)..(229): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcacctcagggcacagggtcctgggcccagtctgccctgactcaggctgcctccgtgtctgggtctctaggacagtcgatcaccatctcctgcactggaaccngcagtgacggttggggtatgactatgtctcctggtaccagcaatatccaggcacacgacccccaaatcatcatttatgagtcagtaactccggccctcgtagggtttactaagtcgcttctctcggctaccgaagtctggacctaacgaccggtccctcccgtagaaccctctccgtccgtcgggtcctaccggaggtccgtcggacggaccggtacgccgttagtactttactaccgtcgacgtacgtaccttacgttacgtttacgacttaaacgttcgtaaggttacgtacggttaccgtttagttcggtttaccggttaacggggtaacggttaaccggggtaaccgtaacggttaccgttacgtttacccgggttacccggttacggttacccgtaccgggttaccccgaaaccccggg

SEQ ID NO: 234147 - DNA, 697 bp, Homo sapiens
  misc_feature: GYAE6OF02GRGEJ.39.86.H09.1.454.CMB.1.raw
  modified_base (200)..(200): a, c, t, g, unknown or other
  misc_feature (200)..(200): n is a, c, g, or t
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacngtcgatcaccatctcctncactcggaacngcagtggacgttggggttatgactatgtctccgtcgtacagcaactatccgagccacgaccacccccaaatcgaactctaatttagtagtacggttctaaggtaaccgtcccggacccgttcggtacggggtttacgtacgttaacttccggtctttccgtcgtacggtcctaccgtaacgtcgttcggacaaccgtccggtccctacccgtacgtacctacgtaccttcggtacgggcctaccggtacggtcgtaggtaaccggacggacggtcttagtactttaacgtaccgttcgacgtaaccgtcttacgttaagttaacttacgaagtacgtaacgttaacttaccgttaccgtttacccggtttacgggaccgggttaaccgggtacctaaccgggtaccgtaccggttacccgttccggttaaccggtacccgtacccggaccggttaacccggtccccgg

SEQ ID NO: 234148 - DNA, 704 bp, Homo sapiens
  misc_feature: GYAE6OF02GQ218.39.86.H09.1.454.CMB.1.raw
  modified_base (228)..(228): a, c, t, g, unknown or other
  misc_feature (228)..(228): n is a, c, g, or t
tcagtcgcactagtcacgaccggtgctcgatttagtgctatagacttgggggggggggtctcaggaggcagcgctctcaggacatctccaccatggcctgggctctgctgctcctcaccctcctcactcagggcacagggtcctgggcccagtctgccctgactcaggctgcctccgtgtcctgggtctcgtaggacagtcgatcacatcctactgcacgtggaaccngcgagtgacgggtttgggtatgactatcgtactctcgtaccagtcaatctccgaggccacaccgacccccaaactctaactacctaattttacgtcggtaggtacaaggttaaccgtccggtaccctcgggttaacgggttttacctaaacgttccgttccttacgttcgtcggtacccgtacctaaggtccgttcggaactacccggaacccggtccctacccgtacaccctacgttccttacgggtccggtacctacccggagggtcccgtaggaacggggaccgacggtcggtttagttaactttagttacgttacgtcgacggtactacgtacttaacgtataacggtaacgtaactacgttacggacttaccgcggttacggtcgtttgggtaaccggtacgggtaacgggttaaccgtagggttacccggacgttacccgtacgggtaccgtacccggaccgtaaccggg

SEQ ID NO: 234149 - DNA, 652 bp, Homo sapiens
  misc_feature: GYAE6OF02HBDON.39.86.H09.1.454.CMB.1.raw
  modified_base (308)..(308): a, c, t, g, unknown or other
  misc_feature (308)..(308): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggcagtcgatcaccatctcctgcactggaccagcagtggacggttgggggttatgactatgtctccgtggtaccagcaatactccaggcacaccgaccccctaactcatctatttagngtaggtcagtaactccggtcccgtacgtacgggtttactacgtcgtcttcgtcgtcgccttaccaagttccgtacggaccaaccgacccggtccctcccgtacgtaccctacgttccgttccggtcggggtccctaccggacggtccgtaggacgggacggtcggcgttagtactttacgttacgtcgtcgtagtccttaccgttagtttcgactaacgttgtacgtcgtacgggttacttagttcggttaccggttacggggtaacggttacggggtaacccgtaggttaccgtacgttcccggttaccgttacgggtacccgacggtacccccgtaacccgg

SEQ ID NO: 234150 - DNA, 756 bp, Homo sapiens
  misc_feature: GYAE6OF02GCH94.39.86.H09.1.454.CMB.1.raw
  modified_base (318)..(318): a, c, t, g, unknown or other
  misc_feature (318)..(318): n is a, c, g, or t
  modified_base (578)..(578): a, c, t, g, unknown or other
  misc_feature (578)..(578): n is a, c, g, or t
tcagtcgcactagtcacgaccggtgctcgatttagtgctatagacttgggggggggggtctcaggaggcagcgctctcaggacatctccaccatggcctgggctctgctgctcctcaccctcctcactcagggcacagggtcctagggcccagtctgccctgactcaggctgcctccgtgtctgggtctctaggacagtcgatcaccattcctcctgcactggaaccagcagtgacggttgggggttatgactatgtctccgtggtaccagcaatctccgaggccaacgacccgaccccctaaatcactctaatttanggtacgtcaagtaaccgtccggtacccgtacggtacggggttttactaacgttccgtacgtttcctcggtcggtcccttaaccgtaaggttcccgtacgggtaaacctaaacccggcccggtacccctttccccgtaggtaacccctaacggttcccttccgggtacgggccccgttacccgggtagggacccgttaggggaaccgggtaaccgaggggttactttaaggtaaacttttacgttaccgtcggtaacccgngttaccttacgttaacgtttacgaaccttaagttaccgttaaggggtacggtaaacgggttcttttaaggtcggtttaacggttacgggtaacggttaccggggtaactaaacgggttcttaaccgtccggtttacgttaccgggacctacccggtaacccgaaccggtaaccccccc

SEQ ID NO: 234151 - DNA, 657 bp, Homo sapiens
  misc_feature: GYAE6OF02GI876.39.86.H09.1.454.CMB.1.raw
  modified_base (232)..(232): a, c, t, g, unknown or other
  misc_feature (232)..(232): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctctgctacgtacggaaccngctaggtcgtacgggttggggtatgactagtcgtctccgtaggtaccagactaatactccgagaccacgaccgacccctaaatcgatactatttagcggacgtacacgtacgtccgtcctgtacggttactactcgtcttctcgtcgctacagtcgcgaccacgtccgtcctcgtacgactacgttcgtcgtcggtcctacggtcggtacgtaggacgggacgttacggtcgttagttaactttacgtaccgtgtacgtacgtacttaccgtagtttaccgattaacgtcgtacgggtacggtacgttactttacggttaccggttacggttaacgggtaaccgggttaccgggtaaccgttacggtacgttaccgttccggttaccggttaaccggaccgtaacccggtacccgtaaccccggg

SEQ ID NO: 234152 - DNA, 714 bp, Homo sapiens
  misc_feature: GYAE6OF02I5E58.39.86.H09.1.454.CMB.1.raw
  modified_base (246)..(246): a, c, t, g, unknown or other
  misc_feature (246)..(246): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctcctcactcgagggcacgaggtcctgggcccagtctcgccctgactcgaggctcgcctccgtgtctggtctctaggacagtcatcaccatctctgcacgtcgacagcagtcggtaggttggggtangtactagtcgtctcgtacgacagactaaatcgtccgacggaccaccgacccgtaaccccctaaacgtcaacttactaagtttaacgtacggtacgtaacgtaacgtaaccgtcccggtaccgttacggttacgggtttactacgttccgtccttacgtcggtacgtacctacgtacgtcgtacgacctaacgacccgtccctccgtaccgtaaccgtctttcccgttccggtacgggttcccgtacggttacgtaccgggtaacggaacgggtaccggttacggttacgttacgttaacgtttacgttaccgtacgtaccgttagtaccgttacttagttacccgaattacgttacgtaggtacgttaacgttgttaccgttacgggttacgtaacgggttaggtaccggaaacgtacgtacgttaccggttccgtaaccgtacggtccgtaaccgcccgtaaccccg

SEQ ID NO: 234153 - DNA, 701 bp, Homo sapiens
  misc_feature: GYAE6OF02ISYBH.39.86.H09.1.454.CMB.1.raw
  modified_base (240)..(240): a, c, t, g, unknown or other
  misc_feature (240)..(240): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcgagggcacgagggtccgtgggcccagtcctcgccctgactcaggtctgcctccgtgtcgtgggtctcgtaggacagtcgatcaccgatctctgacactacggaaccngacaggtcgtacgggttggggttatgtactatggtcctcgttacggtaccagtactaactacgtccgacggacctaaccgaccgtaacccctaaagtcaacttctaatttacgcggtacggtactaaacggtacgtccggtaccctacggttacgggttactaacgttccgttacttccttcggtacggtacctacgtaacgtcgtacgtaaccgaaccgtccggtcccttacgacgacctgtcgtcgtacggtctacggacgtcgtacggaaggccggtacgtacgttaataactttaaccgtactcggaccgtacttaccttagttacgttcgaaacccttatccggaaacgttgggtaccgttattacgttacggttaccgggtacggtaacggttccgggaaccttaacgttcgacggttaccgtccgtacggtaccgacccggtaccctaaaccgg

SEQ ID NO: 234154 - DNA, 607 bp, Homo sapiens
  misc_feature: GYAE6OF02GEB3A.39.86.H09.1.454.CMB.1.raw
  modified_base (304)..(304): a, c, t, g, unknown or other
  misc_feature (304)..(304): n is a, c, g, or t
  modified_base (309)..(309): a, c, t, g, unknown or other
  misc_feature (309)..(309): n is a, c, g, or t
  modified_base (343)..(343): a, c, t, g, unknown or other
  misc_feature (343)..(343): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcacatctcctgccactggaaccagcagtggacgttgggggttatgagtatgtctcctggtaccagacatactccgagcacaccaccccaactcatcatttangagtnagtatccgcctagtaggttctaactctacttctntggctacgagtcgtcggacaaccgtcccggccttcccgacgtaacctacgtcctcggtcgggtacctccgacggtaccgtaggacgggacgtacggtatagttacttacgtttcgcgtacgtcgtctagtactttacgacctatacgtacgtaggtacgtacgtttagttggttaccggttacggggtaacggtacggtaaccgttaacggtacgttaccgtacggttccgttaacggtaccgtaccggtacccgtaaccccgg

SEQ ID NO: 234155 - DNA, 672 bp, Homo sapiens
  misc_feature: GYAE6OF02J0VQQ.39.86.H09.1.454.CMB.1.raw
  modified_base (251)..(251): a, c, t, g, unknown or other
  misc_feature (251)..(251): n is a, c, g, or t
  modified_base (589)..(589): a, c, t, g, unknown or other
  misc_feature (589)..(589): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatccaccatctcctgcactggaaccagcagtgtacggttgggggttangactatgtctccgtggtaccagacaatctccgaggcacaccgacccccaaactcactactatttagcgacggtacaagtactccggtacccgtacggttacggggttacctaacgttcctcttcctcgtacggcctacctaacggttccgtacggaacctaaccggaccggtcccctaacccgtcgtaacccttacgtccgttccggtacgggtaccctacccggtacgggtaccgtagggaaccgggtaccgggtacggtacgttacggttaactttacgttacgtcgtacgtaccgtctacgttacttgaactactgtaaggtcgtacgttacgtnttacggtcggtaacggtaggttaccggaacgtaacgttcgtaacgttccggtacgtacggtaccaccggtacccgtaacccgg

SEQ ID NO: 234156 - DNA, 704 bp, Homo sapiens
  misc_feature: GYAE6OF02FZ0FI.39.86.H09.1.454.CMB.1.raw
  modified_base (237)..(237): a, c, t, g, unknown or other
  misc_feature (237)..(237): n is a, c, g, or t
tcagtcgcactagtcacgaccggtgctcgatttagtgctatagacttgggtttggggggggtctcaggaggcagcgctctcaggacatctccaccatggcctgggctctgctgcttcctcaccctcctcactcagggcacgagggtcctgggcccagtctgccctgactcaggtctgcctcgtgtcgtgggtctcgtaggactagtcgactcaccatcctcctgcacgtaggaaccngctaggtagacggtttaggggtatggacttattgtccgtcctacggttaccgacgtacgaacttacgtccgacggtccaaccgaccggaaccccctaaacgtcctacgtacttaagtttagaggtacggtacgtacgtacggtcccggtacccgttacggtacgggtttctaaccgtcgttccttacgtccgtcgggtacttcccgaaggttccgacgggtaccaaacccggtccctccgttaccccgtagacccgtagttccgtccggttacgggccttacccggagtccggtagggaaccggtcggtaacgtgttacgttattaaccgttacgtcgctacggtcttcgttattcgacttaacgcttacggtagtacgtcgtttagtcgttacgggttaacgtaacggtcggtaaccctaggtcctacgtttccgaaccggttacgccggtaacgcccggtaaccg

SEQ ID NO: 234157 - DNA, 647 bp, Homo sapiens
  misc_feature: GYAE6OF02JVJZD.39.86.H09.1.454.CMB.1.raw
  modified_base (219)..(219): a, c, t, g, unknown or other
  misc_feature (219)..(219): n is a, c, g, or t
  modified_base (259)..(259): a, c, t, g, unknown or other
  misc_feature (259)..(259): n is a, c, g, or t
  modified_base (282)..(282): a, c, t, g, unknown or other
  misc_feature (282)..(282): n is a, c, g, or t
  modified_base (529)..(529): a, c, t, g, unknown or other
  misc_feature (529)..(529): n is a, c, g, or t
  modified_base (562)..(562): a, c, t, g, unknown or other
  misc_feature (562)..(562): n is a, c, g, or t
tcagtcgcactagtcacgaccggtgctcgatttagtgctatagacttgggtttggggggggtctcaggaggcagcgctctcaggacatctccaccatggcctgggctctgctgcctcctcaccctcctcactcgagggcacgagggtcctcgggcccagtctcgccctagactcaggtctcgcctccgtcgtctggtctcgtaggacagtcgatcaccntctctgcacgtcggaacagcagtggtacggttggggttangtactgtcgtactcgtcgtaccngacatacacgacgtaccacgaccgtaccccaagtcattcgtatttacgagtacggtacgtaagttaacgcccggtaccgttcgggttaacggtttactacttcgtcgttcttcgtacggtacctacgtacgtcgacgtaccgaaaccgtccgtacccttccgtacgacctacgttcgtaccggtcggacctcggacgtacgacggacggacgtcgtacgtagttacttaccgtacgtcacgtacttntactagttcgatacgtcgacggttggaactttntacgttcggtacggttaggaacggttacggaacgttacggtacttacggttcgttaccgtccggtacgtacccgtacccgacccg

SEQ ID NO: 234158 - DNA, 782 bp, Homo sapiens
  misc_feature: GYAE6OF02I6ZNQ.39.86.H09.1.454.CMB.1.raw
  modified_base (350)..(350): a, c, t, g, unknown or other
  misc_feature (350)..(350): n is a, c, g, or t
tcagtcgcactagtcacgaccggtgctcgatttagtgctatagacttgggttgggggtctcaggaggcagcgctctcaggacatctccaccatggccgtgggctcgtgctgctcctcaccctcctcactcgaggcacgacgggtcctcgggaccagtctcgccctgacctcgaggctcgtcccgtcgtcgtcgtcggtctcgtagacgagtcgatccacctatcctctcgctacacggaccagtcgagtaggtacggtttggggtatcgtaacttcgttctccgtacgtacggtaccagactaacttacgaccgaggaacccaacccgtaacccgaaacccccttaaacnccgttaaacttaccgtaagttttaaacgtacggtacggtttaacctaaacggtttaacccgtccccggttaaccgttacgggttttaacgggtttaaccttaaccgttccggtttacctaccgttcggtaaccggttacctaacggttccggtacgtacggaaccaacccggtccgtacccgttaccgacgaccgtttacgccgttccgaccgtacgcggtacgggtcgttaaggaccgggtacgtcgtattacggtaaccttgtacgccgtaacgtctacttacgtacgtacgtacttaacgcccgttaaggttcgtacgttaccttagggttacggttacccgggttaaagtaaccggggtacttaaacggaccgttttacgacgtttaacccggacgtaacccggtaacgcccggttaaacccgacccg

SEQ ID NO: 234159 - DNA, 260 bp, Homo sapiens
  misc_feature: GYAE6OF02HKOHE.39.86.H09.1.454.CMB.1.raw
  modified_base (244)..(260): a, c, t, g, unknown or other
  misc_feature (244)..(260): n is a, c, g, or t
tcagtcgcactagtcacgaccggtgctcgatttagtgctatagacttgggtttgggggtttggtggtctccactcccgccttgacgaggctgattattactgcagctcattgcaatcagtgaggcttatgtcttcggaagtgggaccaaggtcatcgtcctaggtcagcccaaggccaaccccatgtcactctgttcccgcctcctcactagtgcgactgagcgggctggcaaggcgacatagnnnnnnnnnnnnnnnnn

SEQ ID NO: 234160 - DNA, 637 bp, Homo sapiens
  misc_feature: GYAE6OF02HWGJY.39.86.H09.1.454.CMB.1.raw
  modified_base (212)..(212): a, c, t, g, unknown or other
  misc_feature (212)..(212): n is a, c, g, or t
  modified_base (449)..(449): a, c, t, g, unknown or other
  misc_feature (449)..(449): n is a, c, g, or t
tcagtcgcactagtcacgaccggtgctcgatttagtgctatagacttggggtttggggggggggtctcaggaggcagcgctctcaggacatctccaccatggcctgggctctgctgctcctcaccctcctcaactcgagggcaacgagggtcctcgggcccagtctgccctagactcaggctgccctccgtgtcgtgggtactcgtaggacngtcgatcaccatctccgtgctacgtaggaaaccagcgaaggtggtacgggttggggtaactgtaactagtcgtctacgtacggtaccagactaatacgtccgaacggccacgtaccaacccctaaatctactctaatttagagacggtacacgttaacgccggtccgtaccggttaggggtttaacagttcgttactcgtcgttcgactaccgtagtcaggaccaacgtccgtcccncgtacgacacttcgtcgcggtctccgaggtcgtagaggacgttaaggcgttagactttactacgtcgacgtcgtacttacgttacttagaccaattcgaagtagtacgtctttagtcgttaaggtggtaaccggtagggtacaacggtctagttcccggtacgtacggtaccacccgaccggtaaccc

SEQ ID NO: 234161 - DNA, 255 bp, Homo sapiens
  misc_feature: GYAE6OF02IMOO9.39.86.H09.1.454.CMB.1.raw
  modified_base (248)..(255): a, c, t, g, unknown or other
  misc_feature (248)..(255): n is a, c, g, or t
tcagtcgcactagtcacgaccggtgctcgatttagtgctatagacttggggtttggggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccgccctcctcactagtgcgactgagcgggctggcaaggcgcatagnnnnnnnn

SEQ ID NO: 234162 - DNA, 266 bp, Homo sapiens
  misc_feature: GYAE6OF02IPG99.39.86.H09.1.454.CMB.1.raw
  modified_base (243)..(243): a, c, t, g, unknown or other
  misc_feature (243)..(243): n is a, c, g, or t
  modified_base (250)..(266): a, c, t, g, unknown or other
  misc_feature (250)..(266): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcgggaagtgggaccaaggtcatcgtcctaggtcagcccaaggcccaaccccactgtcactctcgttcccgccctctcactagtgcgatgagcgggctggacaaggcncagtagnnnnnnnnnnnnnnnnn

SEQ ID NO: 234163 - DNA, 720 bp, Homo sapiens
  misc_feature: GYAE6OF02H0TPT.39.86.H09.1.454.CMB.1.raw
  modified_base (124)..(124): a, c, t, g, unknown or other
  misc_feature (124)..(124): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctnactcagggcacagggtcctgggcccagtctgccctgactcaggctgcctccgtgtctgggtctctaggacagtcgatcaccatctcctgcactcggaaccagcaggtgacggtttgggggtatgatatcgtcctctggaccagactaatactcgaagccaacgacgacccccaagtcatcgtaatttcgtagaacggtcaagtaactccggtccctagtacggggtttactaacgtcgtacttctcgtacggtactaccgacttcgtacggaccaaccgtaccggtccccttacccgtacggaccctacgttccgttcggtccggtaccttaccgacggacgttacggaacggtaaccggtagggtccttaggttaaactttacgttaacgtaccgtacgtaacggtacttaccgtttaattttacggaacttaacgtttaacgacggtaacgtaacgggttttactttacggttaccggtttaacggttaacgggttaaccgggttaacggggtaacccgttaaacgggtaccgttacgttacccggttaacccgtacgggttaacccgtaccggtaacccccgtaaaccccggg

SEQ ID NO: 234164 - DNA, 673 bp, Homo sapiens
  misc_feature: GYAE6OF02HKNDK.39.86.H09.1.454.CMB.1.raw
  modified_base (230)..(230): a, c, t, g, unknown or other
  misc_feature (230)..(230): n is a, c, g, or t
  modified_base (271)..(272): a, c, t, g, unknown or other
  misc_feature (271)..(272): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctcgtgtcgtgggtctctaggacagtcgatcaccatcctcctgcactggaaccngcagtgtacgttggtgcttataattatgtctctcgtccaannctatcgagcagccgacccgtaactacttaatttagtcgtacgttcttcgtccggcccttacgtacggggtttctagtccgtccgttcgtcccggtctaccgtaagttccgtggacctaaccgcccggtaccctacccgtacgtaccctagtcctacgtacgaccgttccgacggtcgtacgggaacgggtaccggtaacgggtccgttagttaaaccgtttatttacgtttacgacctacggtaccttacaacgtttaactaacgtacgtaaagttactaacgttagtacctacgtacgttacggtcgttcgggttacgggcgggtaaccggtacgtaccggttacggaccggttaccgtacggtaccgtaccggtaacccgtacggtccccgtaccccgg

SEQ ID NO: 234165 - DNA, 552 bp, Homo sapiens
  misc_feature: GYAE6OF02HBNZI.39.86.H09.1.454.CMB.1.raw
  modified_base (199)..(199): a, c, t, g, unknown or other
  misc_feature (199)..(199): n is a, c, g, or t
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
  modified_base (518)..(519): a, c, t, g, unknown or other
  misc_feature (518)..(519): n is a, c, g, or t
  modified_base (522)..(525): a, c, t, g, unknown or other
  misc_feature (522)..(525): n is a, c, g, or t
  modified_base (527)..(528): a, c, t, g, unknown or other
  misc_feature (527)..(528): n is a, c, g, or t
  modified_base (530)..(530): a, c, t, g, unknown or other
  misc_feature (530)..(530): n is a, c, g, or t
  modified_base (532)..(535): a, c, t, g, unknown or other
  misc_feature (532)..(535): n is a, c, g, or t
  modified_base (537)..(552): a, c, t, g, unknown or other
  misc_feature (537)..(552): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacagccccccaaatcatcatttatgaggtcagtaatcggccctcagggtttctaatcgcttcnctggctccagtctggcaacncggccctccctgaccntctcgtgggcctcacgggctaggagacggaggctgtatttacttactggcagtcctctagtttcgacaatccgaagtggaggttctttacgtgtttccgttaagggaggttcgggaacctaaggtctacgtctccgtagtcacgacccacggacccaacccctagtcctaccacgttcctccggtttacccccacccttccgtcctaccgttacgtcgggtacccgacgttacgggcgtcccggggtacgtacgggaccgaacgggcctacgtagtaaggctnngcnnnncnncncnnnncnnnnnnnnnnnnnnnn

SEQ ID NO: 234166 - DNA, 683 bp, Homo sapiens
  misc_feature: GYAE6OF02HEFU1.39.86.H09.1.454.CMB.1.raw
  modified_base (553)..(553): a, c, t, g, unknown or other
  misc_feature (553)..(553): n is a, c, g, or t
tcagtcgcactagtcacgaccggtgctcgatttagtgctatagacttgggttggggggtctcaggaggcagcgctctcaggacatctccaccatggcctgggctctgctgctcctcaccctcctcactcgagggcacgagggtcctgggcccagtctcgccctgactcaggctgccctcgtgtcgtgggtctcgtaggacacgtcgatccaccacttcctcctgacctacgtacggaaaccaggacctaggtaggtacgggtttgggggttatgtactagtcgttctccgtacggtacagactaatactaccgaggaccaaccgaccgtaaccccccaaataccactacctaatttagtagtacggtactaagttaccgtaccggtcccgttacggtaggggtttactaacgtccgttacttctcgttacgtcctaaccgtagtacgtacggaaccgacggtacccggtccctaccgtacgaccctacgtccgttcgtcgggcctacggacgtacggtaggacggaacgtcgtacttaggtaactttcgtacncggtcagtctacgtacgttcaacgtacgactaggtaggattcttacggtgttacgggaacggtacgggtacgtaacggtacggtcttaccgttccggttaccgtaacgccgtacccggacccgtaacccg

SEQ ID NO: 234167 - DNA, 717 bp, Homo sapiens
  misc_feature: GYAE6OF02GHM15.39.86.H09.1.454.CMB.1.raw
  modified_base (321)..(321): a, c, t, g, unknown or other
  misc_feature (321)..(321): n is a, c, g, or t
tcagtcgcactagtcacgaccggtgctcgatttagtgctatagacttggggttgggggtctcaggaggcagcgctctcaggacatctccaccatggcctgggctctgctgctcctcaccctcctcactcagggcacagggtcctgggcccagtctgccctgactcaggctgcctccgtgtctgggtctcgtaggacagtcgatcaccatctcctgcactggaaccagcagtggtacggttgggggttatgtactattcgtctccgtaggtaccagacaattagccgtagccacacgaccccctaaatccatactatttagngtagtactagttacgtcggcccttaggtacggggtttactaacgtccgtacgtttcctacgtcggtacctacgtaacggttcgtacggtacctaaccgtacccggtccccttacccgtacgtaacctacgttccgtccgggttacggacccgttaccggacgggtaaccgttacgggaaacgggtaccggaacggtacgttaacgttaacgtttaacgtaccgtagggacctacggttaaccgttgttaaccggtttcaaccgttaacggttccgaaaggttcggtaacggttactttacgtacggttaccgggttaaggaaccggttaacgggtaacctaaggttacaccggttacggttcggaacggttaccgtaccggaacccgtaaacccgg

SEQ ID NO: 234168 - DNA, 661 bp, Homo sapiens
  misc_feature: GYAE6OF02IOUNU.39.86.H09.1.454.CMB.1.raw
  modified_base (511)..(511): a, c, t, g, unknown or other
  misc_feature (511)..(511): n is a, c, g, or t
tcagtcgcactagtcacgaccggtgctcgatttagtgctatagacttgggttgggggtctcagggaggcagcgctctcaggacatctccaccatggcctgggctctgctgctcctccaccctcctcactcgagggcacgagggtcctgggcccagtctcgccctgacctcgagctcgcctccgtgtcgtgggtctcgtaggctagtcgactcaccatcctcctgcacgtacggaaccagctaggtcggtaggtttcgggggttatcgtacttagttcgttcctccggttacgaccagtactaatacgtacgacgaccacccgaacccgaaccccctaaagtcctaacgttacttaactttagaggtacgtacgtaacgttacgccggtaccgtacgttacggttactaacgtctccttcgtcgtacggtaccttacgtacgtcgacgacctaccgcggtcccttacgacactctcgtcgtacggctacgagcgtacggacgacggtacgtntagttacgttatcgtcgacgtacgtacttacgtcgttaacacgtacgttgacgttgtacgttacgttagttcggttacggtaagggtaacggtaccggtagtacgttagccttaccggtaccgtacggaccgtaccggaccctaacccgg

SEQ ID NO: 234169 - DNA, 780 bp, Homo sapiens
  misc_feature: GYAE6OF02G1HGL.39.86.H09.1.454.CMB.1.raw
  modified_base (234)..(234): a, c, t, g, unknown or other
  misc_feature (234)..(234): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacgagggtcctgggccctagtctcgccctgactcaggctgcctccgtgtcgtgggtctcgtaggacagtcgatcaccatctctgcactaggaaccngcaggtggtacgggtttgggggttatcggtacttagtcgttccgtaccgttacggtaaccagactaatacgtaccgaggtccaaccgacccgacccccctaaaactccaactttacctaattttacggtaggtaacggtaccgttaacggttaacgttccccggtacccgttacggttaacggggttttacctaaccgttccgttcctttacgttccgttcggtacccttaccgtagttcggtacgaccgtaaaccggtcccggtaccctacccgtacggtacccttacgttccgttaccgggttccggggaccttaccgggtaccggtacgttacggggaaaccgggtacggtaacggtaccggtttacttaacgttttaccgttacgccgggactaccggtcctttacgttacttcgaactaacgttcgtaaggtaacgtcgtttaccgtttagtccggttacgtaacggggtaacggtccggaaaccttgggtacctaggtttcccggtacgtaacgtcccggaaccgttaccggaaccccgg

SEQ ID NO: 234170 - DNA, 580 bp, Homo sapiens
  misc_feature: GYAE6OF02FM19W.39.86.H09.1.454.CMB.1.raw
  modified_base (242)..(242): a, c, t, g, unknown or other
  misc_feature (242)..(242): n is a, c, g, or t
  modified_base (301)..(301): a, c, t, g, unknown or other
  misc_feature (301)..(301): n is a, c, g, or t
  modified_base (488)..(488): a, c, t, g, unknown or other
  misc_feature (488)..(488): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactgaaccagcagtgacgttggggttangactatgtctcgtaggtaccagcaatatccaggcacacgcccccaaatcatctatttangagtcagtaatccggccctgtaggggtttactaagtcgtcttcgtctggccttaccgaaacgttcgtaggaccaaccgaccgggtccctcccgtcgaccacttccgttcgtcgggcctccgacggtctaggacggacgtacggctgtaactttatactgtaccatccgtactactttagacgtaacncgtagtacgagttacttagtggtccgttacggaggttaccgggaacgtacggtccgtagttccgtaccgttaggcccagtaccccgaaccgg

SEQ ID NO: 234171 - DNA, 177 bp, Homo sapiens
  misc_feature: GYAE6OF02ICWN8.39.86.H09.1.454.CMB.1.raw
  modified_base (139)..(139): a, c, t, g, unknown or other
  misc_feature (139)..(139): n is a, c, g, or t
  modified_base (144)..(144): a, c, t, g, unknown or other
  misc_feature (144)..(144): n is a, c, g, or t
  modified_base (150)..(177): a, c, t, g, unknown or other
  misc_feature (150)..(177): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctctcactcaggcacngtcgnggcctnnnnnnnnnnnnnnnnnnnnnnnnnnnn

SEQ ID NO: 234172 - DNA, 758 bp, Homo sapiens
  misc_feature: GYAE6OF02GLWI4.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggccccagtctgccctgactcaggctgcctcgtgtctggtctctaggacagtcgactcaccatcctcctgcactacgaaccagcagtgtacggttggggttatgtactatgtacctcgtacggtaccagactaagtactccgagccaacaccgaccccctaaactccattacctagtttactaggacgtaactaagttaaccgtcccggtacccttacggtaacggggttttactaaacgttccgttcctttaccgtccgttacggtacttaccgttaacggtccgtacgggtacctaaacccggtccggtaccccttacccgtaccgtacccgtacttcccgttacgtcggggtaccctccggaacggtccgtacggaacggaacggtacgtcgtaacgttacgttaacttaccggacgtacgacgttccttacttacgtttcgaaccgttaacgttacgtacggttaaccgtaaccggtttccgtttaagttcggttaaccgggtttaaccggggaaacggttacccgggtaaccgtttaacggtaccgttacggttacccggttacggttaaccggtaccgtaaccccggtacccgtaaaaccccgg

SEQ ID NO: 234173 - DNA, 636 bp, Homo sapiens
  misc_feature: GYAE6OF02FVJXV.39.86.H09.1.454.CMB.1.raw
  modified_base (250)..(250): a, c, t, g, unknown or other
  misc_feature (250)..(250): n is a, c, g, or t
  modified_base (305)..(305): a, c, t, g, unknown or other
  misc_feature (305)..(305): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtcgtgggtctcgtaggcagtcgatcaccatctcctgcactggaaccagcagtcgacggttggggtatgactntgtctctgtaccagactatactcgaggcacaccgacccccaatcatctatttagngtacgtctaagtactcggtccctagtacggggtttactaacgtcgtcttcgtcgtggctaccgtagtcgtgacaacgtccggtcctccgtacacctatctcgcgggtctccgtaggccgtaggacggacggtagggccttaggtactttaacgttacgtgaccgtacgtaccttgtacgttttcgaccttaaaggtccgtaaggttagggtacttaggtttagtcgttaccggtttaacgggtagggtaacggggtaaacccgttaagggttaccgttaacgttaccggttaccggtaaccgggtcctaacccggtacccgaaaccccggg

SEQ ID NO: 234174 - DNA, 766 bp, Homo sapiens
  misc_feature: GYAE6OF02GRMA8.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctcgtgtcgtgggtctcgtaggacaggtcgatcacactctcctgctactacggaaccagcctaggtcgtacgggtttagggggttactggtaacctattcgttccgttaccgttacgggtaaccctaggacctaaagttaccaccggtacggcccaaccgtacccgaacccccccgtaaaagtccctaacgttaccgtaacgttttaacgaggggtaacggttaaccgtaaggtttaaacccgtccccgggtaaccgttacgggttaaccggggttttactaaacgttccgttcctttaccgtccggtgtaccgtaccgttaagtccgtagaccgtaaccgtacccggtccctcccgtacacccgtatccgtacggtcggactcgtagtccgtaggacggtacgtaggtcctaggttaacttacgttcgacggtactaccggttctttacggatttaccgacttacgtagtagtacgggtacgttactttacgggtggttacccgttaagggtaacggttaccggggtaaacgttacggtccgttaacggtcccgttacggtaccggttacccgaacccggtacccgtaacccgg

SEQ ID NO: 234175 - DNA, 700 bp, Homo sapiens
  misc_feature: GYAE6OF02F0G2H.39.86.H09.1.454.CMB.1.raw
  modified_base (238)..(238): a, c, t, g, unknown or other
  misc_feature (238)..(238): n is a, c, g, or t
  modified_base (262)..(262): a, c, t, g, unknown or other
  misc_feature (262)..(262): n is a, c, g, or t
  modified_base (294)..(294): a, c, t, g, unknown or other
  misc_feature (294)..(294): n is a, c, g, or t
  modified_base (316)..(316): a, c, t, g, unknown or other
  misc_feature (316)..(316): n is a, c, g, or t
  modified_base (328)..(328): a, c, t, g, unknown or other
  misc_feature (328)..(328): n is a, c, g, or t
tcagtcgcactagtcacgaccggtgctcgatttagtgctatagacttgggtttgggggctggggtctcaggaggcagcgctctcaggacatctccaccatggcctgggctctgctgctcctcaccctcctcactcgagggcacgacgggtcctgggcccagtctcgccctgactcaggctcgccgtcgtgtcgtgggtctcgtaggacagtcgatcacatcctctgcacgtggaaccngcgagtcgtaggggttggggttancgtactatcgtcctcgtcgaccagacaatacncgagccaccacccgaccctaancgatctattagngagtacaagtcgtccgtaccttaggtacggttactactcgttacttcgtcgtgtaccgtaccgtagtccggtaacgacccgtaaccggccggtccccgttaccaacggtccctaacggttcggttccgccgggtacctaccggggtcggacgtaacgggtaaccggacgtacggttacgtaccgtttaattaccgaacgttccgaacggtcttcctaagtttaccgttaacgaccgttaaggtcggagggtttaggtaccgttagttttacgggtacccgggttacgggtttaacggggacggtaaccgggtacccgtaaggttcccttaaaccggtcccggttaacggttacccggaacgtaacccccggg

SEQ ID NO: 234176 - DNA, 715 bp, Homo sapiens
  misc_feature: GYAE6OF02IOFOW.39.86.H09.1.454.CMB.1.raw
  modified_base (106)..(106): a, c, t, g, unknown or other
  misc_feature (106)..(106): n is a, c, g, or t
  modified_base (179)..(179): a, c, t, g, unknown or other
  misc_feature (179)..(179): n is a, c, g, or t
  modified_base (582)..(582): a, c, t, g, unknown or other
  misc_feature (582)..(582): n is a, c, g, or t
tcagtcgcactagtcacgaccggtgctcgatttagtgctatagacttgggttgggggtctcagggaggcagcgctctcaggacatctccaccatcggcctgggctntgctgctcctcaccctcctcactcacgggcacgtacgggtccgtagggcctagtctcgcctgactcgaggtcncgtcctccgtgtcgtggtctacgtaggactagtacgactctaccatcctcgtcgaccgtaccgtacggaaccagactacgggtacggttacggggttacgggggttatacggtacgttagttcggttaccgttcccggtacggtaaccgtacgtaccgtaaacgtaccgtaccgaacggaccaacccacccgaaccccctaataccgtacttacgtaactttagacggtacgtacgtaacgtacgtccgtaccgttacggtacggttactagtcgtcttcgtcgtcgtcctacgtacgtcgtacgacaaccgtacccgtcctaccgacgtacctacgtcgtcgtaccggtactaccgtagcgagggtacggtacgtagtcgtaagttcttagtacgtgacctntacctagttacgtatacgacgtacgtaggtagtacgttatacggttcgttacgggttacggtacgggtaacggtaacgttagtcgttaaccggtcggttacgaccggttacgacccggtacccgtaaccccgg

SEQ ID NO: 234177 - DNA, 702 bp, Homo sapiens
  misc_feature: GYAE6OF02F26RN.39.86.H09.1.454.CMB.1.raw
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactcggaaccagcagtgacggttggggtatgactatgtctcctggtaccagctaatctccgagcaaccaccgaccccctaaatcaatctatttaagcggacgtactaagttaatccgtcgcccttacggtacgggtttactaacgtccgttactttccgtacgtcggtccttaaccgtaacggttccgtacgggaaccaaccgtcccggtacccttacccgtacgaccctacttccgttccggtccgggtacctccggacggtacctacgggaacgggttacgacgttcgtaacggttaacttttaactcggtacgacgtacgttacctacgttagtttcggaacttaacgtcgttaacggtacgttacggttactttacggttggtttaccggttaacggggtacggtaaccgggtaaaccgttacggtacccgttacggttacccggttaaccgttcggttaccgaccggtaaacccccgg

SEQ ID NO: 234178 - DNA, 718 bp, Homo sapiens
  misc_feature: GYAE6OF02GD2M6.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgctcctccaccctcctcactcgagggcacgacgggtccgtcgggcccagtctcgcccgtgactcgaggctcgcctccgtgtcgtggtctcgtagactagtcgactcaccatctctcgctacgtacgaaccagcgtacggtggtacgggtttaggggttatcgtacttcgtcgttcctccgtacggtaccagactaactactccgacgaccaaccgaccgaccccaaactctaactacttatttagtacgtacgttacgtaacgttaacgtccggtaccgttacggttacgggttttactaacgttcgttcttcgtcgttcggtacctacgtaacgttcgtacgaccgtaacgtccgtccctaccgtcgtacctacgtcgtcgtcggtcgtacgtcgtacggtacggacggtacggtacggtacgttacgttacgttacgttacgtcgtcgtacgtacgttacttacgttacgtactacgtacgtacgtacgtcgttaaaaaaaaaaacgttcgttacggttacggtaacggtaacgggtacggtaacggttaacgttacgtacgttaccggtaccggttacgtaccgtaccgtaacccgtaacccg

SEQ ID NO: 234179 - DNA, 663 bp, Homo sapiens
  misc_feature: GYAE6OF02G4G5M.39.86.H09.1.454.CMB.1.raw
  modified_base (247)..(247): a, c, t, g, unknown or other
  misc_feature (247)..(247): n is a, c, g, or t
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
tcagtcgcactagtcacgaccggtgctcgatttagtgctatagacttggggttgggggtctcaggaggcagcgctctcaggacatctccaccatggcctgggctctgctgctcctcaccctcctcactcagggcacgagggtcctgggcccagtctggccctgactcaggctgcctcgtgtcgtgggtctctaggacagtcgatcaccatctcctgcactggaaccagcagtgacggttggggttangactatgtctcgtgtacngcaatncctaggcacacgaccccaactcactcatttagngtacgtcagtaacgtcggaccttgtacggggtttcaaacgtcggtctttcgcttgggaccttccgaaagttccgtacgggccaaacggtccgcccttcctcgacctctctcgtcggtactcgacggtcgtacggaggtacgtaggtcgtgtagttactactcgcgtacgtcgtactagttgaccgtcgtaaaaaaaacgtggttacggtacgggttacgtttacgttacggtttaccgggtttacgggtaaacggtttacggggtaaccggttaaaccgggttaccgttaaccgggtttaccggttaacccggtttaccgggttaaccggttaccgggacccggttaaaacccccgggg

SEQ ID NO: 234180 - DNA, 261 bp, Homo sapiens
  misc_feature: GYAE6OF02F5POG.39.86.H09.1.454.CMB.1.raw
  modified_base (184)..(184): a, c, t, g, unknown or other
  misc_feature (184)..(184): n is a, c, g, or t
  modified_base (239)..(239): a, c, t, g, unknown or other
  misc_feature (239)..(239): n is a, c, g, or t
  modified_base (245)..(261): a, c, t, g, unknown or other
  misc_feature (245)..(261): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaacccntgtcactctgttcccgccctcctcactagtgccgactgagcgggctggcaaggcncatagnnnnnnnnnnnnnnnnn

SEQ ID NO: 234181 - DNA, 625 bp, Homo sapiens
  misc_feature: GYAE6OF02GFKME.39.86.H09.1.454.CMB.1.raw
  modified_base (223)..(223): a, c, t, g, unknown or other
  misc_feature (223)..(223): n is a, c, g, or t
  modified_base (306)..(306): a, c, t, g, unknown or other
  misc_feature (306)..(306): n is a, c, g, or t
  modified_base (537)..(537): a, c, t, g, unknown or other
  misc_feature (537)..(537): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggcagtcgatcaccatctcctgcactggaaccngcagtgacgttgggggttatgactatgtctcctaggtaccagcaatactccaggcacacgtacccccaaatcatctatttacngacgtcaagtactccggtcctcgtagggtttactaagtcctacttctactggccttaccgagtcctaggcctaacgtaccggccctcccgtagaaccctattcctcgtacggtccctcgacggtctaggacggtacggacggtacgtagtaacgtttaacttcgacggacctaggtccttaccgtagtttaccggaactaagtaccgtaaggtcggtaccgttagtttacncggtttacccgttagggtaacggtacggtaactacgggttactaacgttccgttaggttaaccgcgtacccggacccgttaaccccgg

SEQ ID NO: 234182 - DNA, 727 bp, Homo sapiens
  misc_feature: GYAE6OF02HM97P.39.86.H09.1.454.CMB.1.raw
  modified_base (248)..(248): a, c, t, g, unknown or other
  misc_feature (248)..(248): n is a, c, g, or t
  modified_base (593)..(593): a, c, t, g, unknown or other
  misc_feature (593)..(593): n is a, c, g, or t
  modified_base (660)..(660): a, c, t, g, unknown or other
  misc_feature (660)..(660): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcgagggctacgacgggtcctcgggccagtctcgccctgactcaggctcgcctcgtgtcgtggtactcgtaaggacacgtcgatcaacctattcctcctgcctacgtacggaaccgngtacgaggtacggtacgggtttaggggttactacgtaccgttagttcggtaccttaccggtacggtaacaacggtacttaaactaccggtaccgaacggacctaaccgaccccgtaaacccctaacgtactaacgttacttaacgtttacggacggttaacgtacgtaaacggttaccggtccggttaccgttacggggtttaaggtttaaccttaaccgtcgtttccgttacgtaccggttacggtaccgtacgttacgtcgtaccggtaacgaaccgccgtccgtaccgagtacccgttactacgttcgacggtacctcgacggtacgtacgggacgtacggngttacgtagttagtacgttagctaacgcgttaacgtatacgttagacttgtacgtcgtagtacgttntacgttcgtacggtaacggcggtacgtacgtaacgtctacgtcgacgtacgtacaccgacgtaaccg

SEQ ID NO: 234183 - DNA, 672 bp, Homo sapiens
  misc_feature: GYAE6OF02GKUEX.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtggacggttgggggttatgactatgtctccgtggtaccagacaatactccgaggaccacaccgaccccccaaaactccaactcctaattttagtacgggtacggtaccgtaaggttaaaccgtccgggtaccccgttacggttacggggttttacctaacgtccgttctttctcgtcggtcctaccgtaacgtctcggaccaacgtacccggtccctccgtacgaccctattccgtccgtcgggcctccgaggtcgtagggacgggcggaggtcttagtatttacgttacgtcgactacgtccttacgttacgtttcgactaacgttacgtaggtagtacggttacttagttcgttacggttacgggtaagggttacgggaaccgttaacggttctacggttccggttaaccgttaggtacccgtaccggaccccgtaacccgg

SEQ ID NO: 234184 - DNA, 261 bp, Homo sapiens
  misc_feature: GYAE6OF02FXCAY.39.86.H09.1.454.CMB.1.raw
  modified_base (248)..(261): a, c, t, g, unknown or other
  misc_feature (248)..(261): n is a, c, g, or t
tcagtcgcactagtcacgaccggtgctcgatttagtgctatagacttgggtttgggggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccgccctcctcactagtgcgactgagcgggctggcaaggcgcatagnnnnnnnnnnnnnn

SEQ ID NO: 234185 - DNA, 743 bp, Homo sapiens
  misc_feature: GYAE6OF02JZH4B.39.86.H09.1.454.CMB.1.raw
  modified_base (137)..(137): a, c, t, g, unknown or other
  misc_feature (137)..(137): n is a, c, g, or t
  modified_base (517)..(517): a, c, t, g, unknown or other
  misc_feature (517)..(517): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacgngggtcctgggcccagtctgccctgacctcaggctgcctccgtgtcgtgggtctcgtaggtaacaggtcgtatccaccatccgtctcgacacgtcggaacctgccgacggtggtacgggtttaggggttactacgtactaattcgttccgtccttacggtaccacgacgtaacgttactccgaacggaccaacccgaacccgtaccccctaaaacgtcctaacttccggtttaaatttagtacggtaggttaacccgtaagtaccggtaccggttaccctacgggtttaacgggttacttacgttactaccgtttctcggtacggtactaccgacgggttactcgacgaaacccgtcggtccccttaccgtacgtaacccncgtttcgcggttcccggtctaccggtacgtccgtaggtacggtaacggttcggtcgacggtttaacttaccgtttgccagttaaccgtacttacggttactcggtacttaccttagggacgttaggtagttacccgttattacgttcccggttaagggtaacgacccgggtaactaacgtccgttaacgtgggttacctacggaacgtacccggagttaaccccgg

SEQ ID NO: 234186 - DNA, 749 bp, Homo sapiens
  misc_feature: GYAE6OF02I87LM.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctcgtaggacagtcgatcaccatctcctgacactcggaaccagcagtcgtacggttgggggttatggactatgtccttccgtcggtaccaggactaatactccgaggctaaccaccgacccccgtaaaactctaccttactaattttaagacggtaggtctaaggttaacgttcccggcccttacggtaacggggttttcttaaacgttccggttacctttcgttacggttcggtaccttaccggtaaacgttccgtacggacccgtaaaccgtccccggtcccgttacccgtacggtaaccctaactttccgttcccgtaccgggtccgtaccggacggtacgtaggtaccgggacggtacggtcgttacgtacgtttaattacccggtagaccgtagtccttacttacgtttacgacgtaacgttacgaaggttcggtaaggttaccgtttaggttcggtttacggttaaccgggaagggttacggtaacccggttaagtccggttaaccgtttacgggtcccctttaacgggaccctaccggtaccccggtaaacccccgg

SEQ ID NO: 234187 - DNA, 787 bp, Homo sapiens
  misc_feature: GYAE6OF02JJ4GG.39.86.H09.1.454.CMB.1.raw
  modified_base (228)..(228): a, c, t, g, unknown or other
  misc_feature (228)..(228): n is a, c, g, or t
  modified_base (277)..(277): a, c, t, g, unknown or other
  misc_feature (277)..(277): n is a, c, g, or t
  modified_base (737)..(737): a, c, t, g, unknown or other
  misc_feature (737)..(737): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctctcactcgagggcacagggtcctgggcccagtctgccctgactcgaggtctcgaccgtcgtcgtcgtgggtctcgtaggacaggtcgatccaccgatccgtccnggtacctacgtacggaaccaggcctaggtacggtacggttggggttacngtacctagttcgtcctacgtacggtaccgagtacgtaactaccgtcgaacggtaccaccgtaaccctaacccccgtaaatcctaacgttaccgtaagttttccgtaacggacggttacctaacggtaaccgttcccgggtaaccccttacgggttaccggggtttacctaaccgttcccggttcgttacgtaccgggtttacgaacccgttaccgtaacgtacggtaccggtaaccgtaccccgtaccgggtaccccgttttacccgaacgtacccgttaacgttccgttacggggaccgggttcccctacgggtacggtaccgtacgggtaaccggtcgttaacggtacttcgtaaacttccgttagacgacttccgtacttactttaggtctaacgaacgtttccggagtaccggtattcgttcggttaacgcggttaacggaagggttccgtaaacncggtaacgtcgtaccggttaccggtaggtaccccaggtaccgtaacccgg

SEQ ID NO: 234188 - DNA, 650 bp, Homo sapiens
  misc_feature: GYAE6OF02I76A0.39.86.H09.1.454.CMB.1.raw
  modified_base (123)..(123): a, c, t, g, unknown or other
  misc_feature (123)..(123): n is a, c, g, or t
  modified_base (127)..(127): a, c, t, g, unknown or other
  misc_feature (127)..(127): n is a, c, g, or t
  modified_base (133)..(133): a, c, t, g, unknown or other
  misc_feature (133)..(133): n is a, c, g, or t
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (239)..(239): a, c, t, g, unknown or other
  misc_feature (239)..(239): n is a, c, g, or t
  modified_base (287)..(287): a, c, t, g, unknown or other
  misc_feature (287)..(287): n is a, c, g, or t
  modified_base (306)..(306): a, c, t, g, unknown or other
  misc_feature (306)..(306): n is a, c, g, or t
  modified_base (331)..(331): a, c, t, g, unknown or other
  misc_feature (331)..(331): n is a, c, g, or t
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
  modified_base (396)..(396): a, c, t, g, unknown or other
  misc_feature (396)..(396): n is a, c, g, or t
tcagtcgcactagtcacgaccggtgctcgatttagtgctatagacttgggttgggggtctcaggaggcagcgctctcaggacatctccaccatggcctgggctctgctgctcctcaccctctnactnggcacngggtcctggcccagtctcgcccgtgactcaggctcgtccctcggtgtctgggtcctggtagtacnggtacgactaccacgtacttctccngacaccgtcggaaccngacgtagtacggacgggtttggtatcgacgttatcgtctcgttcgacnagtaactgcgtacgcaacnccgacccaaatgaactgtacttagngtaacgtntaccggtanccggtctacgttaggtactatcgtctatcgtaccgtctaccgtagtcncgaaactccgtccgtccctacgaccgttcacgttccgtacggtccgacgtcgaacgtcggaaggcggaacggtacgttgaacgttactactcggtaccacgtaccgtgttacctacgttaagtaccgttaacgttagtaccgggtagttaccggtcgttcggtttaaaccggttcgtaaccgggttaggtacggtaaacgtaccgtaggtccgttaccggtacccgtaccggtacgtacccggacgtaaccccg

SEQ ID NO: 234189 - DNA, 251 bp, Homo sapiens
  misc_feature: GYAE6OF02GQ4MI.39.86.H09.1.454.CMB.1.raw
  modified_base (240)..(240): a, c, t, g, unknown or other
  misc_feature (240)..(240): n is a, c, g, or t
  modified_base (246)..(251): a, c, t, g, unknown or other
  misc_feature (246)..(251): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtgggaccaaggtcatcgtcctaggtcagcccaaggccaaccccactgtcactctgttcccgcctcctcactagtgcgactgagcgggctggcaaggcncatagnnnnnn

SEQ ID NO: 234190 - DNA, 706 bp, Homo sapiens
  misc_feature: GYAE6OF02IBYF6.39.86.H09.1.454.CMB.1.raw
  modified_base (225)..(225): a, c, t, g, unknown or other
  misc_feature (225)..(225): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctcgccctgactcaggctgcctccgtgtctggtctcgtaggacagtcgatcaccatctcctgcactggaaccngcagtaggacggttgggggttatgactatcgtctccgtgaccagactaatactccgacggcaccgtaaccgacccctaactctaatcttaatttagtacgaaggttcgaacgttaacgtcccggtacccgttacggttaacgggggtttaaccttaccgttacgttccttcgttccgtcggttaccctaccgtacggttcgtacggaccgtaaccgtaccggtccccttccgtaccgaccttacgtcctacgtcgggtaccgtccgaacggtcgtacgggacggtaaccgtagggtccgtttaacggaactttacgtaacgtcgacgtactacccgttcttacgttcgacgtaacgttacgacggttaacgggtacgtttacgttacgtttacgttcggttaaggtaccgggttacggaaacgttacggtacctacgttccggttaccgttaccggtacggtacccgtaaccgaaccccgg

SEQ ID NO: 234191 - DNA, 714 bp, Homo sapiens
  misc_feature: GYAE6OF02IS1SU.39.86.H09.1.454.CMB.1.raw
tcagtcgcactagtcacgaccggtgctcgatttagtgctatagacttgggtttgggggggggtctcacggaaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatggtactatgtctcctggtaccagcaatactccgaggcaacgaccgtaccccccaaagtccagtaccatttagtgtaggttacaacgttaactccggacccttacgtaaggggtttctaaacgtcgtcctttcgtcgtacggtctacgtaacgttctacggaccaaccgtaccggtcccttacccgtacgacccctaagttcccgtacgtccgggtccttaccggacggtccgtagggtaacgggaaccggtagggtaccgttagttaaccgtttaagttaaccgtcggtaacctacggtacgttaccttaacgtttcgaaccgttaattccgtaaggtcggtaacggttactttacgtacggtttaccgttaaccgggtaacggttccgggtaaaccgtaacggttcgtaaccggttaccggtacccttacgggtaccgtaccgtaaccccgtaaaccccggg

SEQ ID NO: 234192 - DNA, 741 bp, Homo sapiens
  misc_feature: GYAE6OF02IQ0UW.39.86.H09.1.454.CMB.1.raw
  modified_base (243)..(243): a, c, t, g, unknown or other
  misc_feature (243)..(243): n is a, c, g, or t
  modified_base (281)..(281): a, c, t, g, unknown or other
  misc_feature (281)..(281): n is a, c, g, or t
  modified_base (315)..(315): a, c, t, g, unknown or other
  misc_feature (315)..(315): n is a, c, g, or t
  modified_base (673)..(673): a, c, t, g, unknown or other
  misc_feature (673)..(673): n is a, c, g, or t
tcagtcgcactagtcacgaccggtgctcgatttagtgctatagacttggggtttggggggggggtctcaggaggcagcgctctcaggacatctccaccatggcctgggctctgctgctcctcaccctcctcactcgagggcacgagggtcctgggcccagtctcgccctgactcgaggctcgcctccgtgtcgtgggtctcgtaggacagtcgatccaccatctcctgctacgtacggaaccngacgaggttcggtacgggtttgggggttatgtaacttntcggttcctccgtacggtaccagactaagttacnccgaggccactaacccgacccctaaactctacttaccttaagtttagtacggtacgttacgaacgttaccggtcccggtacccgttagggtttaccggtttaacgtaacgttccgttccttcgttccggttccggtaaccttaccggtaacggttccgtaaccggtaaccctaaccgtcccgggttcccctaccggtacgtaacccttaccgttccgttaccgggtcggtcccttaccgggaggttaccggagggaaccggtacggtaacggttccttaaggttaacctttccggtaactcgggtaccttagttcccttaatttacgttacgacttaacgtggtacggtcttaagttnttgtacggtcggtacggtactacggacgttacgcgtacgttccggagttacggccacggtcccaaccg

SEQ ID NO: 234193 - DNA, 845 bp, Homo sapiens
  misc_feature: GYAE6OF02GYK9G.39.86.H09.1.454.CMB.1.raw
  modified_base (182)..(182): a, c, t, g, unknown or other
  misc_feature (182)..(182): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacgagggtcctgggcccagtctcggccctgactcgaggctcgcctcgtntcgtcggtctcgtaaggacagtcgatccacctatcctaccttgacctacgtaggaaccaggtactaggtcggtacgggtttagggggttaatcggaacgtttatcgtacctccggttacgtaaccgagacttaatacgtccgaacggaccgaacccaacccgtaaccccctaaaatcctaactacttaaacgttttacgacgggtacggtaaccgttaaacggttaaccgtcccgggtaccccgttaaggtttacgggggttttaacctaaagttcccgttccgtttacccgttcggttcggtaaccttaaccggtaacgtcccgttacggaaccgtaaaacccggccgtttacccccgttacccgtaacgaacccgtttacttaccgtcgggttaccggcccttaaccgggaacgggttcggaaccgggtaaacgggtaccggtaacgggtttccaaagtttaaccctttagtaaccggtgtaaccgtacgttaccgttatttaaccggttggaaaccttacggttaacgtagggttaacggtaccgtttacgttaacgggttccggttaaacggttaacgggggaaaccgttcggtaaacgtaacggttacctaacgggttaccgtacggtacccggtgaaccccggacgtaaacccccgg

SEQ ID NO: 234194 - DNA, 800 bp, Homo sapiens
  misc_feature: GYAE6OF02F0FOG.39.86.H09.1.454.CMB.1.raw
tcagtcgcactagtcacgaccggtgctcgatttagtgctatagacttggggttggggggtctcaggaggcagcgctctcaggacatctccaccatggcctgggctctgctgctcctcaccctcctcactcagggcacagggtcctgggcccagtctgccctgactcaggctgcctccgtgtcgtgggtctcgtaggacagtcgatcaccatcctctgcactggaaccagcaggtcggtacgggttgggggttactagtactaagttgtccgttccgttacggtaaccagactaaagttactacccgaggaccaacgaccgtaccccctaaacgtcaacttactaagtttaacgtaggtacggtactaagttaaccgtccggtacccgtacggttagggtttactaacgtccgttcgttacttcgtacggtacttaccgaacggttcgtcggaaccgtaaacgcccgggtaccctccgtacgtaaccacgtaccttacggtcgggtaccctacgacgggtacgtacgggaaccggaaccgggttaggtaccgtttacggttaacttttaaacccgttaccggttacggtaccgtacggtttaccgtaccgtttaacgtttgggtaacctaaacgttacggtacggttaaggttaccgggtttcgtttaacggtttacgggttacgggtttaaacggggtaacgggtttaaccgggtaaacccggttacggttaccgttaccggtttacccggttaacgggttaccggtacccggtaacccggtacccccgggtaaacccgg

SEQ ID NO: 234195 - DNA, 701 bp, Homo sapiens
  misc_feature: GYAE6OF02ITLI9.39.86.H09.1.454.CMB.1.raw
  modified_base (244)..(244): a, c, t, g, unknown or other
  misc_feature (244)..(244): n is a, c, g, or t
  modified_base (568)..(568): a, c, t, g, unknown or other
  misc_feature (568)..(568): n is a, c, g, or t
  modified_base (606)..(606): a, c, t, g, unknown or other
  misc_feature (606)..(606): n is a, c, g, or t
tcagtcgcactagtcacgaccggtgctcgatttagtgctatagacttgggtttgggggtctcaggaggcagcgctctcaggacatctccaccatggcctgggctctgctgctcctcaccctccctcactcagggcacacgggtcctggcccagtctcgcctgactcaggctgccttccggtgtcgtcgggttctcgtagggacgtagtcgactccacctatcctcctcgccacgtacggaaccncgacgtaggtcggtacgggtttgggggttaactcggtactagtcgttcctaccgtcggtacagactaatacgtcgacggacaccacccgaccccgaaatcacttactatttacgcgtacggtacgtaacgttacgtccggacccgttcggtacggtttactacgttacgtcttcgtcggtttacgtccgttaacctaacgttcggtacgaccgttaacccggcccgtttacccctacccgtacgaaacccttcgtaccgtccgggtccgtccggtaacgtaccgtcgtacggacgggagtacggtctaagttacttaacgtacncgtcgtactcttagtgttactcgtagttaccgaggttntaccgttagttcgttgttaccggtaggttaccggtacggtacgttaaggccgttaggttcccgtaacgtcggtacgtacccggtaccgaacccgg

SEQ ID NO: 234196 - DNA, 802 bp, Homo sapiens
  misc_feature: GYAE6OF02I0NJ0.39.86.H09.1.454.CMB.1.raw
  modified_base (217)..(217): a, c, t, g, unknown or other
  misc_feature (217)..(217): n is a, c, g, or t
tcagtcgcactagtcacgaccggtgctcgatttagtgctatagacttgggttgggggtctcaggaggcagcgctctcaggacatctccaccatgcctgggctctgctgctcctcaccctcctcactcgaggcacagggtcctgggcccagtctcgccctgactcaggctcgcctccgtgtcgtggtctcgtaggcagtcactcaccagtcctccgtnccacgtcggaaccagccgagttcggtacggtttagggggttactaggtactatgttcctacccgttcggttaacagtaccctaacttacgtcccgacggaccaaccggaccccgaaccccctaaacctcctaacgtaccttaattttagtaggtaacgttaaccgaagtttaaacccgtcggtaccccgttacgggttttaccgggtttaactagtccgtttcctttcgtaccgttcggaccttaccgtaaacgttcgccgtaccgaacccgtccggacccttacccgtccggacctacgtcgttacgtcggtacccttcgacgggtcgtaggacggtacgggagtacgttggtaaccttttaatccggtacttccgagtaccttagttactttacgaacgtttaaccgttaggttaccgggtacgtacggtttaggtttaacccgttttgggtttaccccggggttaaacggtaacgggggttaaacccgtaaacgggtttaaggacccggttttaacccgttacgggtttaccggtttaaacccgggttacccggtaccccgggaacccgttaaaccccccgg

SEQ ID NO: 234197 - DNA, 786 bp, Homo sapiens
  misc_feature: GYAE6OF02HW7A4.39.86.H09.1.454.CMB.1.raw
tcagtcgcactagtcacgaccggtgctcgatttagtgctatagacttggggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcacatctcctgctacgtggaaccagcagtggtacggttgggggtatgtactatcgtctccgtagtaccagactaatactccgaggtaccaccgaccgaccccaactacacttctatttagtggtacgtacgtaacgttacgtccggtacccgttacggtacggggtttactacgttcgtaccttcgtcgtacgtccttaccgacgttaccgtagggacctaacccggaccggttaccccttaccgtaccgtaaccctaccgttaccgtaccggtcccgggtacctcccggtaacgggtccggtaacgggaccggtaaccgggtacggtacgtttaaggttaaccgttttaacgttaccggtacgtaacggtaccgttaccgttaaccgttacgtttacgaaccgttaaacgttaccggtaaagtacgggttacggttacgtttaccgggttacggtttaccggtaacgggggtttaaccgggtaaccgggggtaaccggtaaccggggttaccgttaacccgggttccggttaacccgggttaacgggttacccggaccccggtaaccccgggtaaacccccgg

SEQ ID NO: 234198 - DNA, 666 bp, Homo sapiens
  misc_feature: GYAE6OF02JSAKD.39.86.H09.1.454.CMB.1.raw
  modified_base (171)..(171): a, c, t, g, unknown or other
  misc_feature (171)..(171): n is a, c, g, or t
  modified_base (215)..(215): a, c, t, g, unknown or other
  misc_feature (215)..(215): n is a, c, g, or t
  modified_base (222)..(222): a, c, t, g, unknown or other
  misc_feature (222)..(222): n is a, c, g, or t
  modified_base (478)..(478): a, c, t, g, unknown or other
  misc_feature (478)..(478): n is a, c, g, or t
tcagtcgcactagtcacgaccggtgctcgatttagtgctatagacttgggtttggggggggtctcaggaggcagcgctctcaggacatctccaccatggcctgggctctgctgctccgtcacctcctcactcagggcacagggtcctcggcccagtcctcgccctgacctnaggctgcctccgtgtctggtctactaggacagtcgactcacctntccttcngaccacgtacggtacccagcctagtacggtcggtttggggtaactggaactttgtcgttcctacgttggaaccgacgacgtaacttacgccggtacggtacaccgtccgaaccctaacttcgtacttcttattacgtgagttacgtagtacgtccggtccttaaggtcggttactacgtccgtcttccgacttcgacctaccgtacgtcgacgcaccgtaccgtcctacgtacacgttcgtcgttcggaccggtcnccggtagccgttaggacgggtacgcgttaccgtagttacgttataccgtccgaagccgttcgtagtaacgttctaacgtacctagtacggtaaccgtgttaacgtgttccgtggttaaaccgtcggttaaccggacttaacgccgtacgtttacggacccggttagaccctacggtaacctaacccgg

SEQ ID NO: 234199 - DNA, 764 bp, Homo sapiens
  misc_feature: GYAE6OF02G81FH.39.86.H09.1.454.CMB.1.raw
  modified_base (220)..(220): a, c, t, g, unknown or other
  misc_feature (220)..(220): n is a, c, g, or t
  modified_base (711)..(711): a, c, t, g, unknown or other
  misc_feature (711)..(711): n is a, c, g, or t
tcagtcgcactagtcacgaccggtgctcgatttagtgctatagacttgggttgggggtctcagggaggcagcgctctcaggacatctccaccatggcctgggctctgctgctcctcaccctcctcactcgaggcacgagggtcctcgggcccagtctcgccctgactcgaggctcgcctccgtgtcgtagggtctcgacggcaggtcgacttccaccgtntcctccgtcgcctacgtacggaaccagtccgtaggtaccggtacggggtttacggggttactacggtacttacgtccgttccgccgttaggaaccctagtaacgtaactttcgaccccgaggaccctaacccgtacccggtaacccctaaactccgtaacttacggttaattcggtaggtaaccggttacgtaacggtaccggttccccggaccgtttaagggttaccggttaacttaccgttcgttctttaccggcgtttacggaccgttacggttaactccggggtaccggtacctaacccggtccgtcccgttacccgtgtaaccctacgttccgtaccgtcggtaccgtccgacggttaccgacgggtacgtaaccggtacgttacggtcgttaacgtcgttcaacgggtcctacggtctttacgtaaccgtacgtacgttaacgtggtcgtaacgttgtcgttacgtcggtacgtaacggcggtanaccggttagtcgtaccgtcggtaaccgtcgggacctaccggtacctaacccgg

SEQ ID NO: 234200 - DNA, 703 bp, Homo sapiens
  misc_feature: GYAE6OF02F4RXM.39.86.H09.1.454.CMB.1.raw
  modified_base (352)..(352): a, c, t, g, unknown or other
  misc_feature (352)..(352): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctcctgcacgtacggaaccagcaggtacggtacgggttggggggttatacggacgttattacgtccttccgtacggttaccagactaactactaccgaggtccaacgacccgacccccaaacgtctactctaagtttanaggtagtctaagtacgtccggtcccgtggtacggttactaacgtccgtcttcgtcgtcgtctacgagtcgtacgaccaccgtacccggtcctaccgactaacctcgtcgttccgtccggtacccgtacgacggtcgtaggacgggacggtaaggtccgttaagtacgtttaactccgtagtacctacggccttaatcgtttaccgaacgtaccgtaacggtacggtacgtaagttccgttaacgttcggttaccggttaacgggaacgggtttacggaaacccgttaagggttccgtaacggttccggttaaaccgggccgttacggaacccggtacccgtaaaccccggg

SEQ ID NO: 234201 - DNA, 790 bp, Homo sapiens
  misc_feature: GYAE6OF02HZTYF.39.86.H09.1.454.CMB.1.raw
tcagtcgcactagtcacgaccggtgctcgatttagtgctatagacttgggggggggggggtctcaggaggcagcgctctcaggacatctccaccatggcctgggctctgctgctcctcaccctcctcactcagggcacggggtcctgggcccagtctgccctgactcaggctgcctcgtgtctgggtctctaggacagtcgatcacctatcctctgacactaggaaccagcgaggtgtacggttggggtatgactatgtctaccgtaggaccagcttaatactccgaagacaaccgacgaacccccaaatcattactaatttagacgtaggttacaacgttaactccggtaccgtacggttaacgggtttactaacgttcgtaccttccgttacgtcgtacctacgtaacgttccgtacggacctaaacccgacccggtccctaccgtacgtaccctacgttcccgtcgtacgggtaccctaccggtacggtacgtacgggaacgggtaacggtacggtacttacggttaactttaaccgtttaccgtacggtacctaaaccggttccctttaacgttaacgttttaccgaaacgttaaacgttcggtaaacgggtacgttaacggttaaccgttttacggttaaccggtttaccggtttaaccggggaacggggtttaaccgggaaacccggtttaacgggtaccgttaaccgtttcccgggttaaccgttaaccgggtaaccgtaaccccgggtaaaccgtaaccccggtaacccccgtaaaccccgg

SEQ ID NO: 234202 - DNA, 646 bp, Homo sapiens
  misc_feature: GYAE6OF02HJ5RZ.39.86.H09.1.454.CMB.1.raw
  modified_base (236)..(236): a, c, t, g, unknown or other
  misc_feature (236)..(236): n is a, c, g, or t
  modified_base (453)..(453): a, c, t, g, unknown or other
  misc_feature (453)..(453): n is a, c, g, or t
tcagtcgcactagtcacgaccggtgctcgatttagtgctatagacttgggtttggggggggggtctcaggaggcagcgctctcaggacatctccaccatggcctgggctctgctgctcctcaccctcctcactcagggcacgagggtcctcgggcccagtctcgccctgacctcaggctgcctccgtgtcgtgggtctcgtaggacagtcgatcacactctcctgtactcggaacnggcaggtggtacgggtttgggggttatcgacttagtcgtccttccgtcggtaccagactaatacgccaggccacgccaccccaaactcatctatttagtggacggtcaagtacgtcgcccgtacggtacggtttcagtcgctttcgtcgtcgctactacgtcgaggaccaaccgtccggacctcctaccgacctactcgtccggtcgccgtaccggngtcggacggaggtacggacgggtacttagttaacgtttacgtacttccggacgttacgacttcgttattcgtaactattacggagttcggtacggttacctttaaggtcggttagttacggggtaaacggtcgggtaaccgtaggtcctacggtccgtacggttacggcccgaacgtacccgaacccgtaccc

SEQ ID NO: 234203 - DNA, 995 bp, Homo sapiens
  misc_feature: GYAE6OF02I26MZ.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcgaggctgcctccgtgtcgtgggtctcgtaggacagtcgatcaccatctcctgcacgtacggaaccagccgtagtcggtaccggtttggggggttaactacggtaccttaagttcggttccttacccggttacggttaacccgaacggtaccctaaaagttaccgttacccggaacggtacccgtaaacccgaccccggaaccccccccgttaaaaacgttcctaaaccgttccgttaaaacgtttttaacgtacggttaaaccgggttacctaaagggtttaaaccgttccccggggtaaccccctttagggttaacccgggggttttaccttaaaaccgttcccggtttacctttccttaccgggtttacggacccgttaaccgtaaacggtttccgttaccggaaacccgaaaacccggttacccgggtccccctttaacccgtaccggtaaaccccgttcgttaccctttccgggttaccgggtccccttaaccggtccggttaacgtaacgggaaaccggggtaacggtaacgggtaccgtttacggttaaacttttaaacccgtttcggtaccggtaaacccgtgggttacccttttacgttaaacgtttccggtaaacctaaccgtttgggttaaaccggttcgggtaaacgggttttttcccttaagggttttcccggtttaacgggtttaaccgggggtaaacggggttacccggggtaaaccggttaaaccgggtttcccggttaaacggtttaccccgggttaaccgggttaaggtttaacccccggaacccgggtttaaccccggaaacccccggg

SEQ ID NO: 234204 - DNA, 748 bp, Homo sapiens
  misc_feature: GYAE6OF02IK9GW.39.86.H09.1.454.CMB.1.raw
  modified_base (180)..(180): a, c, t, g, unknown or other
  misc_feature (180)..(180): n is a, c, g, or t
  modified_base (546)..(546): a, c, t, g, unknown or other
  misc_feature (546)..(546): n is a, c, g, or t
  modified_base (656)..(656): a, c, t, g, unknown or other
  misc_feature (656)..(656): n is a, c, g, or t
  modified_base (677)..(677): a, c, t, g, unknown or other
  misc_feature (677)..(677): n is a, c, g, or t
  modified_base (705)..(705): a, c, t, g, unknown or other
  misc_feature (705)..(705): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctcgggcccagtctcgccctgactcacggctgcctcgtntcgtacggtctcgtaggactgtcgactcacctatccgtcctgtcacgtacggtaccagaccgagttcggacggtttagggggttactacggtacttacgtcggtacttccgtacggtaccgacggtactaactagtacccgtacggtcaacccgtaacccggacccccctaaaacgtccgtaacgttacctaaacgttttacgtacgggtacggttaacgaacggtttaaacgtccggggttaccccgttaacgggttaccgggggttttaactttaacgttcccgttcttccgttacgtcgtaccgtccgtaacgttccgtacggtacccgtacgaacccggtcccttaccgcggtacccttacnccgtttaacggtccgggtcgttacccgacgggtcgtaccggacgggtaccgaggttacctacggttaactttacgtacgtcgaacgtcggtacgtaccgttctaggtacncgtacgctagggtcgtccgtntttcgggtactcggggaacgtcggtaanccggttatcggttctaccggtacgtcacccgtccggtaacccg

SEQ ID NO: 234205 - DNA, 750 bp, Homo sapiens
  misc_feature: GYAE6OF02FRBTT.39.86.H09.1.454.CMB.1.raw
  modified_base (281)..(281): a, c, t, g, unknown or other
  misc_feature (281)..(281): n is a, c, g, or t
  modified_base (583)..(583): a, c, t, g, unknown or other
  misc_feature (583)..(583): n is a, c, g, or t
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcaggctgcctccgtgtcgtgggtctcgtaggacagtcgatcaccatctcctgcacgtcggaaccagacagtggtacggtttgggggttatgactatgtcctccgtaggtaccngactaatactccgaggaccacgaccgacccccaaatccattactaattttagacggtacggttacgtaaacgttaacgtcccggtcccttacggtacggggttttactaaacgttccgttcgtttacctccgttcggtcctaccgtaacgtccggtacggaaccctaaacccggtcccgggtccccttaccccgtacgtaaaccccgtctttaccccgttaccggtcgggtacccttccggtaacggtccggttaacgggacggtaccggtacggtacgttagttacgtttaacgttaccgnggtactaacggtcttaccgttagttttacaccgttaaacgtccgtaaggtggtacgttacgtttacgtacgggtttacgtcgggtaacgggtacggtaaaccggttaggttaccgttacggttacccgttaccggtaggacccgtaacccgggcctaaacccccggg

SEQ ID NO: 234206 - DNA, 309 bp, Homo sapiens
  misc_feature: GYAE6OF02IQRL5.39.86.H09.1.454.CMB.1.raw
  modified_base (138)..(138): a, c, t, g, unknown or other
  misc_feature (138)..(138): n is a, c, g, or t
  modified_base (170)..(170): a, c, t, g, unknown or other
  misc_feature (170)..(170): n is a, c, g, or t
  modified_base (206)..(206): a, c, t, g, unknown or other
  misc_feature (206)..(206): n is a, c, g, or t
  modified_base (225)..(225): a, c, t, g, unknown or other
  misc_feature (225)..(225): n is a, c, g, or t
  modified_base (238)..(238): a, c, t, g, unknown or other
  misc_feature (238)..(238): n is a, c, g, or t
  modified_base (247)..(309): a, c, t, g, unknown or other
  misc_feature (247)..(309): n is a, c, g, or t
tcagtcgcactagtcacgaccggtgctcgatttagtgctatagacttggggggggggggtctcaggaggcagcgctcgtcaggacatctccaccatggcctgggctctgctgctcctcaccctcctcactcgaggccngacggtccgtggcccagtctcgccctgctcgnggctcgccgtccgtgttccgtgggtcctgacggccnggtcactccacttccgtcncgcacgcgaaccngtccggtannnnnnnnnnnnnnnnnnnnnnnnnnnnnnnnnnnnnnnnnnnnnnnnnnnnnnnnnnnnnnn

SEQ ID NO: 234207 - DNA, 633 bp, Homo sapiens
  misc_feature: GYAE6OF02FN4ZE.39.86.H09.1.454.CMB.1.raw
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacgagggtcctgggcccagtctgccctgactcaggctgcctccgtgtctgggtctctaggacagtcgatcaccatctcctgcactggaaccagcagtgacggttgggggttatggactatgtctcctggtaccagcaatatcaggcacacgacccccaaatcatctaatttatgaaggtcaagtaactccggcctaggtagggtttctaacgtcgtcgttaccttcgtacggtcctaccgtagttcctagggaacctaacccgtaccgggtaccctccccgttagaccctaagttccgttcgtcggggtacctcccggtaggtcctaggaccgggtaacggcggtactagtaactttagtaacgtcgactacgtcttcgtaagtttcgacttaatcgtaacgtcgtagtcgttatcggttcgtttaacgggaacgttagggaacctacggttcgaagttccgtaccgttacggtacaccgtacccgtaacccggg

SEQ ID NO: 234208 - DNA, 754 bp, Homo sapiens
  misc_feature: GYAE6OF02H7HSU.39.86.H09.1.454.CMB.1.raw
  modified_base (241)..(241): a, c, t, g, unknown or other
  misc_feature (241)..(241): n is a, c, g, or t
  modified_base (268)..(268): a, c, t, g, unknown or other
  misc_feature (268)..(268): n is a, c, g, or t
  modified_base (354)..(354): a, c, t, g, unknown or other
  misc_feature (354)..(354): n is a, c, g, or t
tcagtcgcactagtcacgaccggtgctcgatttagtgctatagacttgggggggggggtctcaggaggcagcgctctcaggacatctccaccatggcctgggctctgctgctcctcaccctctcactcagggcacgagggtcctgggcccagtctgccctgactcaggctgcctcgtgtcgtgggtctcgtaggactagtcgatccgaacctattcctccgtcgaccacgtacggaaaccngctagtacgggtacggttgggggttancgtactagtcgttctccgtaggtaaccagtacctaatactccgaggaccaacaacccgacccctaaactctactactaagttttanacggtacggtactaacgttaacggtcccggtacccgttaggttaacgggtttactaacggtccgttactttcgtcgttcggtaccctacgtaacgttcgtacgaacctaaccgacccggtaccctacccgtacgacctacgtttccgtacggttcggtccgtaccggtaggtccgtaaggggtaaccgggtaacggtacgggtcgtttaagttaacgttaaccgttacgtacggtacctacgttacccgttactacgtttacgaacgttacgttacgtagtacggtacgttacgtttacgttacggttaccggttaacgggtacggtaacggtaccggtaacgttacacgggttaccgtcggtaacggtacccgaacccggtaccgaacccgtaaccccg

SEQ ID NO: 234209 - DNA, 335 bp, Homo sapiens
  misc_feature: GYAE6OF02IX9B3.39.86.H09.1.454.CMB.1.raw
  modified_base (247)..(247): a, c, t, g, unknown or other
  misc_feature (247)..(247): n is a, c, g, or t
  modified_base (261)..(261): a, c, t, g, unknown or other
  misc_feature (261)..(261): n is a, c, g, or t
  modified_base (266)..(269): a, c, t, g, unknown or other
  misc_feature (266)..(269): n is a, c, g, or t
  modified_base (272)..(273): a, c, t, g, unknown or other
  misc_feature (272)..(273): n is a, c, g, or t
  modified_base (277)..(335): a, c, t, g, unknown or other
  misc_feature (277)..(335): n is a, c, g, or t
tcagtcgcactagtcacgaccggtgctcgatttagtgctatagacttggggtttgggggggtttggtggtctccactcccgccttgacgaggctgattattactgcagctcatttgcaatcagtgaggcttatgtcttggaagtgggaccaaggtcatcgtcctaggtcagcccaaaggcccaaacccccagtgtaccacgtctcgttccccgccctcctcgacttagtcgcgtactggaggcgggntgggacagggccanagtgnnnngcnnacgnnnnnnnnnnnnnnnnnnnnnnnnnnnnnnnnnnnnnnnnnnnnnnnnnnnnnnnnnnn

SEQ ID NO: 234210 - DNA, 908 bp, Homo sapiens
  misc_feature: GYAE6OF02HI094.39.86.H09.1.454.CMB.1.raw
tcagtcgcactagtcacgaccggtgctcgatttagtgctatagacttggggtttgggggggggtctcaggaggcagcgctctcaggacatctccaccatggcctgggctctgctgctcctccaccctcctcactcgagggcacgcgggtcctcgggccctagtcgtcgcccgtagacctcgacggtctcgtcccgtccggttgtcgtgggttctcgtacggacgagtcgactcacctactctccgtcgacacgtacggaaccacggtacgtacggttacgggtacggggtttaggggttaactccggttaacgttcgtttccggtacccggttaccggttacggggtaacccaaggttaaccaaatttcccggaccggaacgggtacccaacctaaccccggtaccccctaaaacgttcgtaacttacctttaaggtttacgacggttaaccggttacgtaacggttaacccgtcccgggttaccgttaaacggggttttaggtttaaccctaccgttttacccgggtcttaccggttaaccggtttcgaaccccttaagggttaaacccgttccggaaccgtaaaccgggtaaccccgtccgttacccccgttacgacgtaacccttcgtccgggttccggaccggttcccgtaccgggacgtaaacggggtcgggtaacggtcgggtaacccgttgtaacgttacgtttaacgcgttccgaacggttgttacccgttagtacggttaacgtacgttaagttaccgggtaggttacccgttaggtttcccgttaagggtaccgttacgggttaacggtcgggttaccggtaaaccggttacgtttacccggtacgtttacccgggaaccgtttaccggaacccgtaccggtaaacccgaaccccggg

SEQ ID NO: 234211 - DNA, 881 bp, Homo sapiens
  misc_feature: GYAE6OF02IK7L8.39.86.H09.1.454.CMB.1.raw
tcagtcgcactagtcacgaccggtgctcgatttagtgctatagacttgggtttggggggggtctcaggaggcagcgctctcaggacatctccaccatggcctgggctctgctgcctccttaccctcctcactcgagggcacgtcgggtccgtgggtccccagtccgtcgtccctggacctcgaggtctcgccctccgtgttcgtcgggtctcgtacggactacggtctactccactactcctacccgtcgtactaccgtacggaaacctacgacgtacggtggtacgggtttaggggggttactacgtacgttagtcggtttccgttcgttacggtaacccgaactactaaacgtacttaccggtagacccgtaaccgtaaccccggaacccccctaaaccgtcctaacgttactaacgttttagtacgggtaacgtacgtacgtaacgtcccgtcccctacgggtttaacgggtttacctaacgtttccgtcctttaccgttccgtacggtacccttcggttaccgtcggttaccgacccgtaaacccggtcccggtacccccgttaccggtaaccgttacccttacgttaccccgttcgggtaccggttaccggtaccggttaccgggtccggttacggaaacgggaccgggttacgacgttacgttttaacttaacgttacccgttaccgtacggtccgtacgtttacctttaacgtcggtaacttaacgtagtaacgggttagacgtttaccgttacggtttaccgttaggtttaacccgggtacggttacccggggtaacgttaccgggttacgtaccggtttacgttaaccggtccgttaacccgggtacccggaaccccgtccgggtaaccccc

SEQ ID NO: 234212 - DNA, 649 bp, Homo sapiens
  misc_feature: GYAE6OF02FL0AV.39.86.H09.1.454.CMB.1.raw
  modified_base (251)..(251): a, c, t, g, unknown or other
  misc_feature (251)..(251): n is a, c, g, or t
  modified_base (271)..(271): a, c, t, g, unknown or other
  misc_feature (271)..(271): n is a, c, g, or t
  modified_base (318)..(318): a, c, t, g, unknown or other
  misc_feature (318)..(318): n is a, c, g, or t
  modified_base (427)..(427): a, c, t, g, unknown or other
  misc_feature (427)..(427): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctacactccagggacacagggtcctgggcccagtctgcctgactcgaggctgcctccgtagtctgggtctcgtaggacagtcgatcaccatctcctgcactggaacagcagtgacgttggggtatnagattgtctcctggtaaccngcaatagtccaggcaacacgacccctaaactcgaatccaatttacgnggtacgtcctaagtaactcgggccctagtacggggtttataactcgcttactcgtgaccgttcccgaagtccgtaggaccctaacgtccgtaccctccgtacaaccctntacgtccgtacgggcctaccgaggtaccgtggaacggtacgtaaccggctttacgaaactttacttactccacgtactcccttagtaactttcggaaccttacgttacccgaagttccggagttaccgttagttcccgttagggtacggtaacggtaccggggtaactaacggtccgtaactcccggttaaccgtacgtccggtaacccgacccgtaaccgg

SEQ ID NO: 234213 - DNA, 644 bp, Homo sapiens
  misc_feature: GYAE6OF02GWVZ9.39.86.H09.1.454.CMB.1.raw
  modified_base (416)..(416): a, c, t, g, unknown or other
  misc_feature (416)..(416): n is a, c, g, or t
  modified_base (435)..(435): a, c, t, g, unknown or other
  misc_feature (435)..(435): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggccccagtctgccctgactcaggctgcctccgtgtctgggtctctaggacagtcgatcaccatctcctgcactggaaccagcagtgacgttgggggttatgactatgtctcgtggtaccagcaatatccagcacacgaccccaactcatctatttatgagtcaagtagtccgcctcgtaggtttctaatcgtcttctcgtggtctcgtaagtcgtggtaccaacaccgtccctcccgtacgaccctatccgtacgtgggccctacgnggtccgtaggacggacggnggtactaggtaactttacgttacgtgccgtaacgtccttagttacgtttgtaactaacgttacggtacgttaagggtaccggttatttacgtacggtttccggttaacggggtaaaccggttacggggtaaacccgtaacggtttaccgtaaccggtttccgggttaccggttaacggtacccgtaacccggtacccggtaaaccccgg

SEQ ID NO: 234214 - DNA, 787 bp, Homo sapiens
  misc_feature: GYAE6OF02IP40K.39.86.H09.1.454.CMB.1.raw
  modified_base (122)..(122): a, c, t, g, unknown or other
  misc_feature (122)..(122): n is a, c, g, or t
  modified_base (141)..(141): a, c, t, g, unknown or other
  misc_feature (141)..(141): n is a, c, g, or t
  modified_base (521)..(521): a, c, t, g, unknown or other
  misc_feature (521)..(521): n is a, c, g, or t
tcagtcgcactagtcacgaccggtgctcgatttagtgctatagacttggggtttgggggggggtctcaggaggcagcgctctcaggacatctccaccatggcctgggctctgctgctcctcncctctcactcagggcacgngggtcctcgggcccagtcctgtcccgtagactcgaggtctcgcctcgtgtcgtggtctctaaggcagtcgactcaccatcctcctgacacgtacggaaccagtcgtaggtcggtacggtttaggggtatacgtacgttagtcgttccgtaccgtacggtacctaggtaactaatcctacgaacgccacggtaaccccaccctaaactctactccgttaaattggacgtagtacgtaacgtaaccgtccggtccgttaagggttacggtttacgtacgtccttcgttacgtcgtcgacgtcctaagttccacgacctaacgcccgtaccgtacacctacgtacttcggtcgtacgccgtacggcggcgaggacggtacggngtacgtacttacgtactttagcggtacgtaccgttcgtacgttaacgtttacggaaccgtttacgtaaacttacgggtacgggttaacgtttcccgttaacgggttttacgggttaaccgggttaaacgggggttacccggtttaaaccgggggtaaaccgtttaacggttaccggttaaaccccggtttttcccggggttaaacccggggttaaacccggtaacccgggttaaccccgggtaaaccccgttaaaacccccggggg

SEQ ID NO: 234215 - DNA, 762 bp, Homo sapiens
  misc_feature: GYAE6OF02HDV3V.39.86.H09.1.454.CMB.1.raw
  modified_base (662)..(662): a, c, t, g, unknown or other
  misc_feature (662)..(662): n is a, c, g, or t
  modified_base (668)..(668): a, c, t, g, unknown or other
  misc_feature (668)..(668): n is a, c, g, or t
tcagtcgcactagtcacgaccggtgctcgatttagtgctatagacttggggttgggggtctcaggaggcagcgctctcaggacatctccaccagtggcctgggctctgctgctcctcaccctcctcactcgagggctacgacgggtccgtcgggaccctagttcgtcgccctgactcgacggctcgccgtacgtgtagtcggtctacgtaggacagtcgactcacgtactcctcgtacgccaacgacggtaaccagacgtaacggttacggtacggggtttaggggttaactaggtaacgttagtcgttcgtaccgtacggaacagtactaatacgtccgaacggactacccgaacccgtaaccccgtaaactcaaccttcgtaacgtttagtacgggtaacggtaccgaaacggttacgtaccccggtccgtttaaggggtaacggtttattacccgacgtttccgttaccgttcggtcccgtacgtacgggtaatcccggtaacggaacccgtacccgccgggtttaaacccctcgtaaccgtaaccttacggttacccgttcggaccggttaccgtaccgacgggtacgtaacgggacgggtaacggagttacgtaacgttacttacgtacgacgtctaaccggtctacgtcacgtaanaccgtnacggttgtacgttggtagtaccgttaaggttaacgggtacgaacggtacgtaccgtgtacccggtagttcgaccgtacgaccgtacccggaacc

SEQ ID NO: 234216 - DNA, 579 bp, Homo sapiens
  misc_feature: GYAE6OF02JC82G.39.86.H09.1.454.CMB.1.raw
  modified_base (195)..(195): a, c, t, g, unknown or other
  misc_feature (195)..(195): n is a, c, g, or t
  modified_base (244)..(244): a, c, t, g, unknown or other
  misc_feature (244)..(244): n is a, c, g, or t
  modified_base (298)..(298): a, c, t, g, unknown or other
  misc_feature (298)..(298): n is a, c, g, or t
  modified_base (388)..(388): a, c, t, g, unknown or other
  misc_feature (388)..(388): n is a, c, g, or t
  modified_base (531)..(531): a, c, t, g, unknown or other
  misc_feature (531)..(531): n is a, c, g, or t
tcagtcgcactagtcacgaccggtgctcgatttagtgctatagacttgggggggggggtctcaggaggcagcgctctcaggacatctccaccatggcctgggctctgctgctcctcaccctctcactcagggcacagggtctgggcccagtctgccctgactcaggctgcctccgtgtctgggtactctaggacngtcgatcaccatctcctgcactcggaaccagcagtgacgttggggttangactatgtctctggtaccagcaagtatccgaggcacacgacccccaaactcacnctaatttagcgaggtactaagtaagtcggaccctaggtagggttctaactcgcttactcgtggctaccaagtctaggcaacgaccgtccncctacgccatcctgcggtctctaggctaggacggacgaggtctagtaacttaagtcctaggcctaagtctatacttgaccaagttcgaagtagacgttacgttgtcgtaccgttagggtaacggtacggtaccggtaaacgtntaacgttccgttacggtaacggttccaacggtacccaacggtaacccc

SEQ ID NO: 234217 - DNA, 700 bp, Homo sapiens
  misc_feature: GYAE6OF02HAGEP.39.86.H09.1.454.CMB.1.raw
  modified_base (256)..(256): a, c, t, g, unknown or other
  misc_feature (256)..(256): n is a, c, g, or t
tcagtcgcactagtcacgaccggtgctcgatttagtgctatagacttggggttcggggggggtctcaggaggcagcgctctcaggacatctccaccatggcctgggctctgctgctcctcaccctcctcactcgagggcacgagggtcctgggcccagtctcgccctgactcgaggctcgcctccgtgtctgggtctctaggcagtcgatcacctatcctcctgcactggaaccagcagtgtacggtttggggtangactagtcgtctccgtggtaccagtcaaatctaccgaggaccaccgaaccgacccccaaaactccgtatacctaagtttacgtacggtacgtacaagttaactccggacccgttaggtacggtttactaaactccggtcttcgttaccgtgtacctaccgtaacgttcgtacggaccgtaaaccgccggtaccctacccgtgtaacccctagtccttacggtacccgggtccgtaccggtacgggttaccgaagggtaaccggtaacgggtacgtacgttaacggttaattaaccttacggtacgtaccgaacggttaccttagttaacgtttcgacttaacgtacgtaggtacgtacgtctttagcgtttacggacggtaacggacggtacctacggttactcggtaccggtccgttaaccgacgtaccgacccgtaacccgg

SEQ ID NO: 234218 - DNA, 793 bp, Homo sapiens
  misc_feature: GYAE6OF02JZESV.39.86.H09.1.454.CMB.1.raw
  modified_base (196)..(196): a, c, t, g, unknown or other
  misc_feature (196)..(196): n is a, c, g, or t
  modified_base (727)..(727): a, c, t, g, unknown or other
  misc_feature (727)..(727): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctcgtaggacnggtacgatccactatctcctgctacgtacggaaaccgagactaggtacggtacgggtttagggggggttaactaggtaaccttagtcgttaccgtccgtacgggtaaccaggactaactacgtaccgagacaaccgtacccgaacccccaaatccaattaccttaattacgtaggtacgttacgaacggtaacgtcccggaccctttacgggtacggttttactaaccggttcctttcgttcctacgtcggcttaccgaacgttccgacggtaaccgaccggtacccggtccctccgtaccgactactccgttacggtccgtaccggaccgtacgggtccgtagggtaccggtaacgggtacgtaacggttcggttaaacttaaccgttaaggccgtaacggttaccgtcttaaccggttatttacggaaccgtttaagtacgtaccggttaacgggtaccgtttacgttacggttcggttaaaccggtttaaccgggtaacgggtccgggtaaaacccggttaaccggtnttaacccggtttacccgggttaacccggtcgggtaaccccgtacggtaacccccggtaaaccccgg

SEQ ID NO: 234219 - DNA, 783 bp, Homo sapiens
  misc_feature: GYAE6OF02I3KRF.39.86.H09.1.454.CMB.1.raw
  modified_base (224)..(224): a, c, t, g, unknown or other
  misc_feature (224)..(224): n is a, c, g, or t
  modified_base (229)..(229): a, c, t, g, unknown or other
  misc_feature (229)..(229): n is a, c, g, or t
  modified_base (231)..(232): a, c, t, g, unknown or other
  misc_feature (231)..(232): n is a, c, g, or t
tcagtcgcactagtcacgaccggtgctcgatttagtgctatagacttggggttgggggtctcaggaggcagcgctctcaggacatctccgaccagtcgggcctgggctcgtgctgtcctcctcaccctcctcactcgagggcacgcgggtcctcgggacccagtcctcgccctgactcgaggctcgcctccgtgtcgtaggtctcgtagacctagtcatccacnttccncnncacgtacggaacctgcgtaagtcggtaacgggtttgggttactacgtactagttcggtacctccgttacgaccgtacgaacgtaagttaccgcgtacggacctaacccgtaacccgacccccttaaagtctacttaacgttacgtttacgtacggtaacggtactacggttacgcccggttacgtcgggttaaggttacctacgtcgtttccttcgtacggttcggacccgttacggaaacgttcgtaacgaccctaaccgtcccggtacctccgtaacgtacctcgtcgtacggtcgtaccttcggaccgtaggtacgggacgtacggttacgtacgtttactacgttcgttaacgcgttaacccgtagtacgtttcgtaacgttccggaacttacttacgggtaacggtcggtaaccggtttaccttcgggtaaaccggttacccgggtaaacggtaaaccgggtccggttaaaaccggtaacccggttggtacccgtttaccgggttaacgttacccgtaacccggtccccgaacccggtaaccccgg

SEQ ID NO: 234220 - DNA, 258 bp, Homo sapiens
  misc_feature: GYAE6OF02JHZDN.39.86.H09.1.454.CMB.1.raw
  modified_base (246)..(258): a, c, t, g, unknown or other
  misc_feature (246)..(258): n is a, c, g, or t
tcagtcgcactagtcacgaccggtgctcgatttagtgctatagacttgggtttgggggtttggtggtctccactcccgccttgacgaggctgattattactgcagctcatttgcaatcagtgaggcttatgtcttcggaagtgggaccaaggtcatcgtcctaggtcagcccaaggccaacccactgtcactctgttccccgccctcctcactagtgcgactgagcgggctggcaaggcgcagtgnnnnnnnnnnnnn

SEQ ID NO: 234221 - DNA, 759 bp, Homo sapiens
  misc_feature: GYAE6OF02J2MM7.39.86.H09.1.454.CMB.1.raw
  modified_base (209)..(209): a, c, t, g, unknown or other
  misc_feature (209)..(209): n is a, c, g, or t
  modified_base (554)..(554): a, c, t, g, unknown or other
  misc_feature (554)..(554): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcacgtcagggccacgacgggtcctcgggcccagtctgccctgactcaggctgcctcgtgtctgggtctctaggcagtcgatcaccntctctgcacgtaggaccagcgagtacggtacggttacgggggttatcggtactagtcgtcctaccgtagggtaccaggtaactaatacgtccgagtaccaccgaccgacccctaaaactcgaattacctatttacgagggtaaccgtacgaacggttaaccgtccggacccttacggtaacggggttttaccctaacgtccggtttacttccgtttacgtccggtaccgttaaccgtaaacgggtttccgtacggaacccgtaaacggtcccggttacccggttaccccgtaagtacccgttacgttccgtacggggttcccggtacgttcccgacggggttacncgggaagggtaccgtacgggttctagttaaaccgttttactaccggtagtccgttaagtacccgttatttaccggttacggaacttaaccggtacggtacgtaacgggtacgttacttacggtccgtttacgggtcgggtaacggttcgtaaacggcgttaccgttctaccggtaccgttagggtaccaccggtaccccggtacg

SEQ ID NO: 234222 - DNA, 753 bp, Homo sapiens
  misc_feature: GYAE6OF02IVICC.39.86.H09.1.454.CMB.1.raw
tcagtcgcactagtcacgaccggtgctcgatttagtgctatagacttgggtttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggcagtcgatcaccatctcctgcactcggaaccagcagtgacggttggggttatgactatgtctctggtaccagtacaatcgtaccaggcaaccaccggtaccccccaaaattccacttccgttaattttagtacggggtaacgttaacgaacggtttaaaccgttcccggggtacccttacggttaaacgggggttttaccttaaacgttccgggtttacctttcgttccggtcgggtacccttaccgtaaagtccgtaacggtacccgtaaacgaccccgggtcccttaccccgtacggtacccctacgttccttccggttcgggtcccctaccggtaacggtccggttacgggaaccgggtaacgggtacggtaccttaaggtttaacgtttaaagtttcccgtaggtctaacggttccttacgtttaacgtttcggaactaacgttacggtaggtcgtaagggttcttacggttacgttcggttaacgggtacgtacggggtaaccctaaggttctaaccgtcggttaccgtacggacgacccgtaccggtaaccccg

SEQ ID NO: 234223 - DNA, 689 bp, Homo sapiens
  misc_feature: GYAE6OF02HPOAX.39.86.H09.1.454.CMB.1.raw
  modified_base (266)..(266): a, c, t, g, unknown or other
  misc_feature (266)..(266): n is a, c, g, or t
  modified_base (288)..(288): a, c, t, g, unknown or other
  misc_feature (288)..(288): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctcgtgtctgggtctcgtaggacagtcgatcaccatctcctgacactcggaaccagcagtgacggttggggtatgactatgtctccgtagtaccngtacaatctaccgagtccaacncccgtacccccaaactccaattcctaatttacgagtacgtctaacggtaacgtcccggtaccctcggttaacgggttaccttaagtccgtcctttaccgtacttcggacctaccgtaacgtccgttacgcgtaaacccggtaccgtaccccgtacccgtacgtaaaccctacgttcccgtaacggtccgggtaccgtaccgtacgggtcgtaacgggaacgggtacgtaacggtctaacggtattacgtacgtggtactccggtacctttacgtacgtttcaacgttacgtacgaggttcgacgttccttagtccggttacggtaacgggtcggttaacggaaccgttaaccggtagttaccgaccggttcgtaccggtacgtaacccggctaaaccccgg

SEQ ID NO: 234224 - DNA, 670 bp, Homo sapiens
  misc_feature: GYAE6OF02GRWFF.39.86.H09.1.454.CMB.1.raw
  modified_base (219)..(219): a, c, t, g, unknown or other
  misc_feature (219)..(219): n is a, c, g, or t
  modified_base (338)..(338): a, c, t, g, unknown or other
  misc_feature (338)..(338): n is a, c, g, or t
  modified_base (535)..(535): a, c, t, g, unknown or other
  misc_feature (535)..(535): n is a, c, g, or t
  modified_base (544)..(544): a, c, t, g, unknown or other
  misc_feature (544)..(544): n is a, c, g, or t
tcagtcgcactagtcacgaccggtgctcgatttagtgctatagacttggggggggggggtctcaggaggcagcgctctcaggacatctccaccatggcctgggctctgctgctcctcaccctcctcactcagggcactagggtcctgggcccagtctcgccctgacctcgacggctcgccttccggtgtccgtgggtctcgtaggacaggtcatcaacntcctctgcacgtagaaccagcaggtggtacgggttggggtactgactgtcgtcttacgtggtacctagctaatcgtacgaggcacgaccgacccctaaactctaacttacgtattaagnggtacgtacgtaggtaacctccggccccgttaggtaccggggttttataaaccggtcctccgtttctacggtccgtcttaaccgtaacgttcgacggtacctaaccggccggtccctacgtaccgtactaactccggttacgtccggccgttccggacgtcgtacggaggtaccggagtcgtaagtactttactagnacgcgttcngtacgttcgaagtacctggtaactcggtacgttagtctttaggtacggtacggtaacgggtaccggacttaacggtacctacggtcggtaccttacggacgtacccggaccgaacccggttaaccc

SEQ ID NO: 234225 - DNA, 810 bp, Homo sapiens
  misc_feature: GYAE6OF02HEFKN.39.86.H09.1.454.CMB.1.raw
  modified_base (128)..(128): a, c, t, g, unknown or other
  misc_feature (128)..(128): n is a, c, g, or t
tcagtcgcactagtcacgaccggtgctcgatttagtgctatagacttgggtttggggggggtctcaggaggcagcgctctcaggacatctccaccatggcctgggctctgctgctcctcaccctcctnactcagggcacgagggtcctgggcccagtctcgccctgactcaggctgcctccgtgtcgtgggtctctaggacagtcgatccaaccattcctccgtgacacgtagggaacccagcaggtcggtacgggtttgggggttactaggtacgttagtcgtccgttaccgtacggtaaccacgtactaaacgttacgtacccgaggacccaacgtaacccgaacccccctaaaacgttacctaacgttaaccgttaacttttaacggtacggtaacgggtactaaacggttaaccgttacccggtaccccgttacgggttaacggggttttacctaacgttccgttcgttaccgtacgtacgtaccgtaccgtaactcgtacgtaaccaacgtacccggtcctacccgtacgtaccgtactccgttaccggtacggtccgtacgtacgggtagtacggacgggtaaccggagttaccgtaagttacgttaacgttcgacgtacgtacgtacgttcgtaacgtttcggtaactacgtacgtaacggttagaccgggtttaactttacggttacggttacccgggttaacgggtaacgggtaaccgggtaaccgtaacgggtttactaacccggtttaccggttaaccggttaacgacccggttaaccccggaaccccgtaaaccccgg

SEQ ID NO: 234226 - DNA, 283 bp, Homo sapiens
  misc_feature: GYAE6OF02FU1VV.39.86.H09.1.454.CMB.1.raw
  modified_base (243)..(283): a, c, t, g, unknown or other
  misc_feature (243)..(283): n is a, c, g, or t
tcagtcgcactagtcacgaccggtgctcgatttagtgctatagacttgggtttgggggggtttggtggtctccactcccgccttgacgaggctgattattactgcagctcatttgcaatcagtgagcttatgtctcggagtgggaccaggtcatcgtctaggtcagcccaaggcccaacccactgtcactctcgttcccgccctctcactgtgcactgaggcggctggaccaggcgacatagnnnnnnnnnnnnnnnnnnnnnnnnnnnnnnnnnnnnnnnnn

SEQ ID NO: 234227 - DNA, 705 bp, Homo sapiens
  misc_feature: GYAE6OF02FXVJO.39.86.H09.1.454.CMB.1.raw
  modified_base (115)..(115): a, c, t, g, unknown or other
  misc_feature (115)..(115): n is a, c, g, or t
  modified_base (479)..(479): a, c, t, g, unknown or other
  misc_feature (479)..(479): n is a, c, g, or t
  modified_base (610)..(610): a, c, t, g, unknown or other
  misc_feature (610)..(610): n is a, c, g, or t
  modified_base (616)..(616): a, c, t, g, unknown or other
  misc_feature (616)..(616): n is a, c, g, or t
  modified_base (628)..(628): a, c, t, g, unknown or other
  misc_feature (628)..(628): n is a, c, g, or t
  modified_base (635)..(635): a, c, t, g, unknown or other
  misc_feature (635)..(635): n is a, c, g, or t
tcagtcgcactagtcacgaccggtgctcgatttagtgctatagacttgggtttgggggggggtctcaggaggcagcgctctcaggacatctccaccatggcctgggctctgctgntcctcaccctcctcactcacgggcacagggtcctgggcccagtctgccctgactcaggctgcctcctgtcctgggtctcgtagacagtcagttcaccgacttcctccgttgaccgtaccttcgggaaaacccctacggacgtacggttacggtaccgggttttacgggggggtttaattcgggtaactttaactcgggttccgttacccgttaacggggttaccacggaacctaagttaacttcccgaacgggtaccaaccaaccggtaaccccccctaaacgttaccacctaccttagttttaacgtccgtaaggtacaacggttagtaccggtccccttagtacggggttactaagtccgtnttacttccgtggtacctacccgagttacgtgggacctaaccggtaccgtcccgtccttacgaccgattccgaacggttcggtcctaccgtgccgtggacgtccggacggtcttagtacttagtcgtcggcngttacngttactgactancgtacgngtagcttagcttcgtacgggagttacggactacggtattacgcgtttacgcggtactacgaccggtaacc

SEQ ID NO: 234228 - DNA, 666 bp, Homo sapiens
  misc_feature: GYAE6OF02GOVBH.39.86.H09.1.454.CMB.1.raw
  modified_base (231)..(231): a, c, t, g, unknown or other
  misc_feature (231)..(231): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctcgccctgactcaggctgcctccgtgtcgtgggtctcgtaggacagtcgatcaccactctcctgccacgtcggaaccngcaggtggtacggtttggggtatgactagtgtcctcgtacggtaccagacaatactccgaggccaccgaccgacccctaaactcaactctatttagcggtacggtactaagttacgccggtccttcggtacggggtttactacggtcgtctttcctcgtcggccttacgaacgttcgacggactaaccgccggtcccttccgtcgtaaccctcgttcgttccggcgggtaccctcggaggtacgtacgggacggacggtacggcttagttacgttacttacgtcggacctacggtcttacgttagttacgaacgttagtacgtacggtacgtcgttacgtttacgtggtttaccggttagggtaacggtacggtaccgtaacggttactaccgttacggtaccctaacgggtccgtaaccgacccggtaacccgg

SEQ ID NO: 234229 - DNA, 791 bp, Homo sapiens
  misc_feature: GYAE6OF02GVATI.39.86.H09.1.454.CMB.1.raw
tcagtcgcactagtcacgaccggtgctcgatttagtgctatagacttgggtttgggggctggggtctcaggaggcagcgctctcaggacatctccaccatggcctgggctctgctgctcctcaccctcctcactcagggcacgagggtccctgggcccagtctgccctgactcaggctgccctcgtcgtcgtgggtctctaggacagtcgatccgaacctatcctccgtgaccacgtcgaaccagtcaggtcggtacggttggggttatcgtagtacgtcgtccgttccgtcgtaccagtactaactataccgacggaccaccgaaccgaacccccctaaactcctaagtccttaactttaacgtaggacggttagtaacggttaacgtccggtacccgttacggttacggggtttacttaacgtccgtactttcgtacgtcgtaccctacgtacgttccgacggacctaaccgtcccggtccctacccgtccgtaactaccgttccggttccggttcgggtacccgtccggtaaccgggtccgtacgggaacggtacgggtacggtacgtagtttaacttacgttaaccggtcgaaccggtcgttaccgttccgttaacgtttaccgaacgttaaacgtcgaacgggttaccggttacggttacgtttacgggttaccgtttaccgggtttaacgggtaaaccggggtttaaccggtaaaccggtaacgggtttacccgtaacggttttccccgggtaaccgtttaccgggtacccgtaaacccccgggg

SEQ ID NO: 234230 - DNA, 629 bp, Homo sapiens
  misc_feature: GYAE6OF02JN1W5.39.86.H09.1.454.CMB.1.raw
  modified_base (234)..(234): a, c, t, g, unknown or other
  misc_feature (234)..(234): n is a, c, g, or t
  modified_base (329)..(329): a, c, t, g, unknown or other
  misc_feature (329)..(329): n is a, c, g, or t
  modified_base (476)..(476): a, c, t, g, unknown or other
  misc_feature (476)..(476): n is a, c, g, or t
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
  modified_base (497)..(497): a, c, t, g, unknown or other
  misc_feature (497)..(497): n is a, c, g, or t
  modified_base (507)..(507): a, c, t, g, unknown or other
  misc_feature (507)..(507): n is a, c, g, or t
  modified_base (600)..(600): a, c, t, g, unknown or other
  misc_feature (600)..(600): n is a, c, g, or t
tcagtcgcactagtcacgaccggtgctcgatttagtgctatagacttgggtttgggggtctcaggaggcagcgctctcaggacatctccaccatggcctgggctctgctgctctcaccctctcactcagggcacgagggtcctgggacccagtctcgccctgactcaggctgcctcgtgtcgtggtcctccgtggacagtcgcctacacatcctccgtgacacgtacggaaccngccaggtacgtaggtttggtacgtaacaactgttcgtccgtcctaggtaaccaacctacccgaccccggaacaacccggtaccccgaagttactntacgttactttacgcggtaactacctaactaacgcccggtccgtaggtagggtctactaagtctcgtttctcgtcgctacgatcgtacgacaaccgccgccttaccgtacactctcgtcgtcgtacacgtgctggacgcggtgcttntatttacgcgngctancgtanattcacgtancgttaacttcgttacgttccggttccggttagggcccggtaagacccgtggtacttacccggtacgttccggacgtacctaccgggtacccgngggtcccctacccggtccgttacgtaccc

SEQ ID NO: 234231 - DNA, 866 bp, Homo sapiens
  misc_feature: GYAE6OF02FOVXX.39.86.H09.1.454.CMB.1.raw
  modified_base (224)..(224): a, c, t, g, unknown or other
  misc_feature (224)..(224): n is a, c, g, or t
  modified_base (539)..(539): a, c, t, g, unknown or other
  misc_feature (539)..(539): n is a, c, g, or t
tcagtcgcactagtcacgaccggtgctcgatttagtgctatagacttgggttgggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacggttgggggttatggactagtcgtcctcgtcgtaccagtactaactactcgacggccaacgacccgaacccctaactactactacttaagtttagacggtacgttaacgtaagttaccggtccccggtacccggttacgggttaaccgggttttaacctacggttccgttaccgtttccgttcggttaccggtacccgttaaccgtacggttaccggtaccggaacccgtaaacccggtaccccggttccccttaacccggtaccgtacctacgtttcccgtccgggttacggtacccctaccgggnggttaccggtaacggggaacggtacgggtaacgttcggttaagtttaaaccgtttaaccttacgggttaccaccggtttaacggttcccttaaggtttacgtttaccgaaaccgttaccgtttcggtaaagggttacggtttcccggtttaacggttttacgttacgggtttaacccggggttttaaacggggtaaaccgggggttaaacccggggttaacccgttttaaggggtttaccctttaacccgggtttacccgggtttaaacccgggttaacgtaacccccggggttaaacccgggtaccccccggttaaaaccccccgg

SEQ ID NO: 234232 - DNA, 623 bp, Homo sapiens
  misc_feature: GYAE6OF02JT44X.39.86.H09.1.454.CMB.1.raw
  modified_base (162)..(162): a, c, t, g, unknown or other
  misc_feature (162)..(162): n is a, c, g, or t
  modified_base (415)..(415): a, c, t, g, unknown or other
  misc_feature (415)..(415): n is a, c, g, or t
  modified_base (447)..(447): a, c, t, g, unknown or other
  misc_feature (447)..(447): n is a, c, g, or t
  modified_base (534)..(534): a, c, t, g, unknown or other
  misc_feature (534)..(534): n is a, c, g, or t
  modified_base (543)..(543): a, c, t, g, unknown or other
  misc_feature (543)..(543): n is a, c, g, or t
  modified_base (554)..(554): a, c, t, g, unknown or other
  misc_feature (554)..(554): n is a, c, g, or t
  modified_base (560)..(560): a, c, t, g, unknown or other
  misc_feature (560)..(560): n is a, c, g, or t
  modified_base (562)..(562): a, c, t, g, unknown or other
  misc_feature (562)..(562): n is a, c, g, or t
  modified_base (568)..(568): a, c, t, g, unknown or other
  misc_feature (568)..(568): n is a, c, g, or t
  modified_base (620)..(620): a, c, t, g, unknown or other
  misc_feature (620)..(620): n is a, c, g, or t
tcagtcgcactagtcacgaccggtgctcgatttagtgctatagacttgggtttgggggctgtgcctggatattgctggaaccagcagtcgacgttggggtatgactatgtctcctggtaccagcaagtatcccaggcacacgccccaaatcatcaagtttancgaaggttcacgtaagtccggccctagtagggtttctaactcgctttcgctggacctccgaacggttcacgggtacaacgaccgggtcctcccgtagaccctattcgtcgtcggaccttccgaggcgtacggacggaacgtaggccttagtaatttctaccgtggcctacggctaacttaacgttgacctaagtcctaaggtgaggtcctttagcgttcgtaggaacgtgggaaccaggtcagttccgtacgnggtaccacggaccacgaccccaactcgttacncgtactccgtcctcccgccttaccacgtacgtacgccggtacaacgtcggacgggtcgttaaccgacggtaaacgcggcgtaaccgngttagaccnggactcggacnccgtancngcgttnagacacgagtacagccgacgcatcacacgtacactacgtcgtcgacgtactntcg

SEQ ID NO: 234233 - DNA, 753 bp, Homo sapiens
  misc_feature: GYAE6OF02JPWLH.39.86.H09.1.454.CMB.1.raw
  modified_base (78)..(78): a, c, t, g, unknown or other
  misc_feature (78)..(78): n is a, c, g, or t
  modified_base (460)..(460): a, c, t, g, unknown or other
  misc_feature (460)..(460): n is a, c, g, or t
tcagtcgcactagtcacgaccggtgctcgatttagtgctatagacttggggtttggggggggtctcaggaggcagcgntctcaggacatctccaccatggcctgggctctgctgctcctcaccctctacactcgagggcacgagggttcctggggacccaggtcctcggcccttgaaccttcgacggctacggccttccgtaggtcgtgggtactgtacggactagtcgactcctaccatccgttccgtgaccgtacgtaggaaccaggtcctaaggttcgggacggtttggggggttactacggtaacttacgtcgttaccgtccgttaagggtaccaacgtacgtaactcgtccgacggtaccacgaacccgtacccctaaactcgacttacttacgttagtcgtacgactacggtactcggcctacggttggtactactcgttacgtcctcggtacnccgttaacgtacgtccgtacggaacctacccggtaccggtccctccgtaacgtaactcgttccgtaggtccggtaccgtcgtaacgggtcgtggtaaaccggtcggtaacggttcttaaacgtttcggtttaactaccggcgtacccgtacggttctaaccgtttaacgtcggtaacgttacctagggtacgttacgtaacttccgttacggttgttaacccggtaggttaccggaacgttacgttccggtacgttactcggtaccggtacggtacgacctaacccggacccg

SEQ ID NO: 234234 - DNA, 587 bp, Homo sapiens
  misc_feature: GYAE6OF02IOTEH.39.86.H09.1.454.CMB.1.raw
  modified_base (286)..(286): a, c, t, g, unknown or other
  misc_feature (286)..(286): n is a, c, g, or t
  modified_base (453)..(453): a, c, t, g, unknown or other
  misc_feature (453)..(453): n is a, c, g, or t
  modified_base (555)..(555): a, c, t, g, unknown or other
  misc_feature (555)..(555): n is a, c, g, or t
  modified_base (561)..(587): a, c, t, g, unknown or other
  misc_feature (561)..(587): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatactccgaggcacaccgaccccctaaactcattcatttatggaggtcagtaactccggccctggaggggtttctaatcgcttctcgtggtcctacctaggtctgggaaccaaaccgtcggtcccctacctacgaacctctccgttcgcgggtccaccgnggtacctagggaacggacggcgtcgtaggttaactttacgttacgagtcacgtctacgttagttcgactaaacgtcgtaagtgtaagttccttagtacggttcgttaacggacgggtagtaccgtagtctacgtccgtacgtacgtaaccgaccgaccgtaaaaccnccctaaacccgtccgttaacgtcctaacctccggttacccctttacccacccctctacgtaccaggttccaccgtggcgagcggtactcggacgtagcgaangtacgnnnnnnnnnnnnnnnnnnnnnnnnnnn

SEQ ID NO: 234235 - DNA, 826 bp, Homo sapiens
  misc_feature: GYAE6OF02HB7IS.39.86.H09.1.454.CMB.1.raw
  modified_base (113)..(113): a, c, t, g, unknown or other
  misc_feature (113)..(113): n is a, c, g, or t
  modified_base (257)..(257): a, c, t, g, unknown or other
  misc_feature (257)..(257): n is a, c, g, or t
tcagtcgcactagtcacgaccggtgctcgatttagtgctatagacttgggttgggggtctcaggaggcagcgctctcaggacatctccaccatggcctggctctgctgctccnccaccctcctcactcgagggcacgacgggtcctcgggccctagtcctcgccctagacctcgaggcctcgtcctccgtgtcgtgggttcctacgtaggactagtcgactccacctacttcctccgtgacctaccgtacggaaccngtacgtaggtacgggtacggggtttaggggttatacgttacgttacgtcgtcttccgtacggtaccgagtactaatacgtcgtacggaccaaccgacccgtacccctaactactacttacttaagtttacgtacggtaacgtacgtaacgttacggtccccggttaccgtacgggtttaccggtttactaacgtccgtttcgttccgttaccgttccggtaccttacccgtacggtccggtaaccggtacccgtaacccggtacccgttaccccgttcccggtaacgttacccctacggttccctaaccgggttccgtacccgttaccggacggtccgggtaacgggaccgggtaaccggtacggtacgtttaacgttaactttaccggtctaccggtactcgttacttacgtcgtttacaacggttactacggtacgtacgtttcgtacgtttaccggtacgtttaacggggtaccggttaaaccgggttacggtaacccttacggggaccttaccgggttaaccgttacggttacccgggaaccggtacccgaccccggtaaccccg

SEQ ID NO: 234236 - DNA, 701 bp, Homo sapiens
  misc_feature: GYAE6OF02G0EC6.39.86.H09.1.454.CMB.1.raw
  modified_base (174)..(174): a, c, t, g, unknown or other
  misc_feature (174)..(174): n is a, c, g, or t
  modified_base (181)..(181): a, c, t, g, unknown or other
  misc_feature (181)..(181): n is a, c, g, or t
  modified_base (250)..(250): a, c, t, g, unknown or other
  misc_feature (250)..(250): n is a, c, g, or t
  modified_base (427)..(427): a, c, t, g, unknown or other
  misc_feature (427)..(427): n is a, c, g, or t
  modified_base (557)..(557): a, c, t, g, unknown or other
  misc_feature (557)..(557): n is a, c, g, or t
tcagtcgcactagtcacgaccggtgctcgatttagtgctatagacttggggttggggggtctcaggaggcagcgctctcaggacatcctccaccatggcctgggctctgctgctcctccaccctcctcactcgagggcacgacgggtccgtcgggaccctagtctcgtcccgtnacctcgnggctcgccgtccgtgtcggtggtctagtaggacagtcgactcacactcctcctgctacgtacggaaccngcgtagtcggtacgggttgggtatcggatgtcgtcgtccgtacgtaccatactaatccgaccgaggtaccaaccgtaccccaacccctaacgtctaattcttaagttacggacggtagtactaaggtaccgtcccggtacgttacgggttacggtttactacgtccgtactttccgngttacgctaacggtacgtacgtgaacccgtaccgaccgtccctacgacgtaccctacgtcggtccgacggtccctaaggccggtacgtacgggacggtaccgtacggtacttattaccgttggttacccnggtaccgtagttcccgttacgtatacggtctaacgtgtacgggtacgtacgttcgttacgggttctaaccgggttggaacgtacgggtacgttaccgacgtttacgccgttgggaacccgtagacccggtaaccggtaaccccg

SEQ ID NO: 234237 - DNA, 689 bp, Homo sapiens
  misc_feature: GYAE6OF02G37DE.39.86.H09.1.454.CMB.1.raw
  modified_base (307)..(307): a, c, t, g, unknown or other
  misc_feature (307)..(307): n is a, c, g, or t
tcagtcgcactagtcacgaccggtgctcgatttagtgctatagacttggggggggggggtctcaggaggcagcgctctcaggacatctccaccatggcctggggctctgctgctcctcaccctcctcactcagggcacgagggtccgtcgggcccaggtctggccctgactcgaggctcgcctccgtgtcgtgggttctcgtaggactaggtcgtactccacctactcctcctcgccgaacgtcggaaccagctaggtaggtcgggtttgggggttatagacttgtcgtaccgtccgtacggacganactaagtctacgagaccaccaccgaccccaaatctatactgttacgaggtcgtactagtaactccgggttacctacgggttacgggttactacgtccgtcgtttcctagtcggtacctacgtacgtcggtacgtaccgaacgtcccgtcccgttaaccgtacgccttaccgtcgtccgggacggttccaaccggtagtacggaccgggtacgggtaacggcgtcgttaacgttactttccggtacgtagacccgtctcgttacttcgtacgtacctagttaactcgggtagtactacgttgtcggttacgtacggtagggtcaaacgggtcttccggtactccggtaacggtccgtacggtaccggaccaaccggttacccc

SEQ ID NO: 234238 - DNA, 393 bp, Homo sapiens
  misc_feature: GYAE6OF02FF0HY.39.86.H09.1.454.CMB.1.raw
  modified_base (186)..(186): a, c, t, g, unknown or other
  misc_feature (186)..(186): n is a, c, g, or t
  modified_base (269)..(269): a, c, t, g, unknown or other
  misc_feature (269)..(269): n is a, c, g, or t
  modified_base (275)..(277): a, c, t, g, unknown or other
  misc_feature (275)..(277): n is a, c, g, or t
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
  modified_base (307)..(307): a, c, t, g, unknown or other
  misc_feature (307)..(307): n is a, c, g, or t
  modified_base (309)..(309): a, c, t, g, unknown or other
  misc_feature (309)..(309): n is a, c, g, or t
  modified_base (315)..(316): a, c, t, g, unknown or other
  misc_feature (315)..(316): n is a, c, g, or t
  modified_base (318)..(393): a, c, t, g, unknown or other
  misc_feature (318)..(393): n is a, c, g, or t
tcagtcgcactagtcacgaccggtgctcgatttagtgctatagacttggggtttggggggtttggtggtctccactcccgccttgacgaggctgattattactgcagctcatttgcaatcagtgaggcttatgtcttcggaagtggaccaggtcatcgtcctaggcagccccaaggcccaaccccntgtcactcttcgttcccccgaccctcctcacttagtcgcgtactggacggtccggggctgggaccaaggggcacctagtacgncagatnnngacntancgtnagtactggacngctaacgntnaattcnntnnnnnnnnnnnnnnnnnnnnnnnnnnnnnnnnnnnnnnnnnnnnnnnnnnnnnnnnnnnnnnnnnnnnnnnnnnnn

SEQ ID NO: 234239 - DNA, 701 bp, Homo sapiens
  misc_feature: GYAE6OF02GHS2S.39.86.H09.1.454.CMB.1.raw
  modified_base (289)..(289): a, c, t, g, unknown or other
  misc_feature (289)..(289): n is a, c, g, or t
  modified_base (442)..(442): a, c, t, g, unknown or other
  misc_feature (442)..(442): n is a, c, g, or t
  modified_base (486)..(486): a, c, t, g, unknown or other
  misc_feature (486)..(486): n is a, c, g, or t
tcagtcgcactagtcacgaccggtgctcgatttagtgctatagacttggggtttgggggggggtctcaggaggcagcgctctcaggacatctccaccatggcctgggctctgctgctcctcaccctcctcactcgagggcacgtagggtcctcgggcccaggtcctcgccctgacctcgaggcctcgccctccggtgtcggtcgggtcctacgtaggactggtcactaccacctatcctcctgaccacgtacggaacctacgcgaggtcggttagggttcgggggttancgtactacgtcgtccgtcgtacgtaccagactacgtactcggacgtccaaccgaccccgaaccctacgtactactacgttaacgtttagacggtacgtacgtaacgttaccgtcccggtacgttacggttacggttactacgtccttcgttcncggtacgtactacgtacgtgtaccgaaccgtaccgtccgtaccnccgtactacctacgtccgtcggtccgccgtcggcgtacgtacgggaacggtcggtacggttactacgttaacgttacgtacggtccgtactagtccgtattacgtacaccgttagcggtaacgtgtacgttcttggtaccttacggggtcggtaacggtacggtacgttacgtccgttaccgtacgtaccggtcgacgaccggtacccgaacccg

SEQ ID NO: 234240 - DNA, 763 bp, Homo sapiens
  misc_feature: GYAE6OF02F27JD.39.86.H09.1.454.CMB.1.raw
  modified_base (195)..(195): a, c, t, g, unknown or other
  misc_feature (195)..(195): n is a, c, g, or t
  modified_base (566)..(566): a, c, t, g, unknown or other
  misc_feature (566)..(566): n is a, c, g, or t
  modified_base (585)..(585): a, c, t, g, unknown or other
  misc_feature (585)..(585): n is a, c, g, or t
  modified_base (592)..(592): a, c, t, g, unknown or other
  misc_feature (592)..(592): n is a, c, g, or t
  modified_base (609)..(609): a, c, t, g, unknown or other
  misc_feature (609)..(609): n is a, c, g, or t
tcagtcgcactagtcacgaccggtgctcgatttagtgctatagacttgggttgggggtctcaggaggcagcgctctcaggacatctccaccatggcctggtctctgctgctcctcaccctcctcactcgagggcacaggtcctggcccagtctgccctgactcaggctgcctccgtgtcgtgggtctctaggacngtcgatccaccattctcctgccacgtaggaaccacgcgtacggttggtaccgggttttagggggggttatacgtaacgttacgttcggtttcccgttaccgttaccggggttaacccaacggtaccctaaaagtttacgacccgacgggaacccaaacccaccccggtaaccccccctaaatttaccctacgttaccttaaaggtttttaacacgggttaacgttcgaaacggttaacctcccggtacccgttacggtacgggtttactaacgtccttaccggttcttcgtcgaccgttacgtacgtactccggaccaaaccggtcccggtaaccctccgtaccgacccttattcccggtccggtcgtacnccggtacggcgtaggacgnggtaggnttacgtatttcgttacncggcctagtcccgtagttcgttactaccgttagaccgttagacggttgtaaccctttgttaccggtacggttaaaggacggttaaccgggtaaggttacccgtagttacccggttcggaccccgtttaggcccaacccggtacccggtaacccg

SEQ ID NO: 234241 - DNA, 263 bp, Homo sapiens
  misc_feature: GYAE6OF02GOF2W.39.86.H09.1.454.CMB.1.raw
  modified_base (239)..(239): a, c, t, g, unknown or other
  misc_feature (239)..(239): n is a, c, g, or t
  modified_base (245)..(263): a, c, t, g, unknown or other
  misc_feature (245)..(263): n is a, c, g, or t
tcagtcgcactagtcacgaccggtgctcgatttagtgctatagacttgggtttggggggtttggtggtctccactcccgccttgacgaggctgattattactgcagctcatttgcaatcagtgaggcttatgtcttcggaagtggaccaaggtcatcgtcctaggtcagcccaaggccaacccactgtcactctgttcccgccctcctcactagtgcgactgagcgggctggcaaggcncatagnnnnnnnnnnnnnnnnnnn

SEQ ID NO: 234242 - DNA, 650 bp, Homo sapiens
  misc_feature: GYAE6OF02JHI62.39.86.H09.1.454.CMB.1.raw
  modified_base (227)..(227): a, c, t, g, unknown or other
  misc_feature (227)..(227): n is a, c, g, or t
  modified_base (309)..(309): a, c, t, g, unknown or other
  misc_feature (309)..(309): n is a, c, g, or t
tcagtcgcactagtcacgaccggtgctcgatttagtgctatagacttggggtttggggggggtctcaggaggcagcgctctcaggacatctccaccatggcctgggctctgctgctcctcaccctcctcactcagggcacagggtcctgggcccagtctgccctgactcaggctgcctcgtgtctggtctctaggacagtcgatcaccatctcctgcactggaaccngcagtgacggttggggtatgactatcgtactcgtggtaccagtccaatactcaggcacacgccccaaactcaatctacttancgagtactagtaatccgcctacgtacggggttactaagtcgtacttcttacgtggtacctacgtaacgtcgtcggaccaaacgtaccggcccttaccgtacgacctactcgttcgtcgggtaccctcgtaggtccgtaacggacggtaccggtacggtaccgtacgttacgtttaacgttacgtcgacgtacgtaccgtacgttacgttacgacgtaacttacgtacgttaacgtagtttaccttacgttacgttacgttaacgggttaacggtacggtaaccgtacgttaccgtacgttaccggttaccgttacggtactaccggtaacccgtaacccgg

SEQ ID NO: 234243 - DNA, 573 bp, Homo sapiens
  misc_feature: GYAE6OF02JGR2W.39.86.H09.1.454.CMB.1.raw
  modified_base (245)..(245): a, c, t, g, unknown or other
  misc_feature (245)..(245): n is a, c, g, or t
  modified_base (539)..(540): a, c, t, g, unknown or other
  misc_feature (539)..(540): n is a, c, g, or t
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
  modified_base (546)..(546): a, c, t, g, unknown or other
  misc_feature (546)..(546): n is a, c, g, or t
  modified_base (548)..(573): a, c, t, g, unknown or other
  misc_feature (548)..(573): n is a, c, g, or t
tcagtcgcactagtcacgaccggtgctcgatttagtgctatagacttgggtttgggggctgtgcctggatattgctggaaccagcagtgacgttgggggttatgactatgtctcctggtaccagcaatatccaggcacagccccccaaacttcatcatttatgaggtcagtaatcggcccttcgaggggtttctaatcgcttctctggctccaagtctggcaacgacgcctccctgaccatctcngggctccgagctgaggacgaggctgtatttactacttgcagtctactatttgactaatcgagtgacggtcttagttgtcgttacggaaggtcggaaaccgtaggtctagtccggttaccgtaggtaccaacggtaccccgaaacgggtaacccccaaaccccgtacgttactaccccgtacgttacccgtttcccgtttaccccaccccccttcgttaccctaacgttacgtacggtacccgtaccgtacggaacgggccgggtcgtcggaccgaacggtccggtacagtacgnncngnancnnnnnnnnnnnnnnnnnnnnnnnnnn

SEQ ID NO: 234244 - DNA, 746 bp, Homo sapiens
  misc_feature: GYAE6OF02GHJ26.39.86.H09.1.454.CMB.1.raw
tcagtcgcactagtcacgaccggtgctcgatttagtgctatagacttgggtttgggggggggtctcaggaggcagcgctctcaggacatctccaccatggcctgggctctgctgctcctcaccctcctcactcagggcacgagggtcctgggcccagtctgccctgactcgaggctcgcctccgtgtcgtgggtctcgtaggacagtcgatccaccactctcctgcctacgtacggaaccagcgtaggtacggtacggtttggggggttatcggtacttagttcgtccttccgtacggttaccacgtactaacttacgtaccgacggccaacccgaacccgaccccccaaacttccgtacttaccttatttaacggtacggtacggttaacgtaacggttaaccgtcccgggtacccgttagggttaaccggggtttacctaacgttccgttcctttcgttccgtcggtcccgttacgacgttaccggtacgacccgaaccgtcccgtaccccgttacccgtacgtacccgtaccgtttccgtacggtcccggtaccgtccggtaggtccgtggggaaaccgtcgggacgttcgttaggtaactttacttcgagttccgaacgtcgttacttgttacacttaagtctaggcgtggtactttcgtcggttacggtaggtaacggtcgtaaccggtagtccgttacgttcccgttacggtacgtcccgaccggtacccggtaaccccg

SEQ ID NO: 234245 - DNA, 721 bp, Homo sapiens
  misc_feature: GYAE6OF02GGTTI.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcagggcacgagggtcctgggcccagtctgccctgactcaggctgcctccgtgtcgtgggtctcgtaggacagtcgatcaccatctcctgcacgtaggaaccagcagtggtacggttgggggttatgtactagtcgtccttccgtagggttaacccaggtactaaactacgtacccggaacggtccaacccgaaccccgtaaccccccctaaaaacgtcctaacttaacgtaacttttaacgtcgggtaacggttactaaaggttaaccgtcccgggtaccccgttacgggttaacggggtttacctaaacgtccgtacttcgtcgtacggtcctacgtagtcgtacggaccaaccgccgtccctccgtacgaacctacttccgtcgcggtcctccgacggtctacggacggtacggacggtctagttacttaacttcgagtcgaacgttctacttagttaccacgtaacgttcgtaaggttacgtcgttgttaccgttcggttaccggttacgggaacggttacggggtaacttaacggtcgtaccggttaccgttacccggtaacggaccgtaccgggaaccccgtaacccgg

SEQ ID NO: 234246 - DNA, 658 bp, Homo sapiens
  misc_feature: GYAE6OF02JZTD0.39.86.H09.1.454.CMB.1.raw
  modified_base (591)..(591): a, c, t, g, unknown or other
  misc_feature (591)..(591): n is a, c, g, or t
tcagtcgcactagtcacgaccggtgctcgatttagtgctatagacttgggttgggggtctcaggaggcagcgctctcaggacatctccaccatggccgtgggctctgctgctctcaccctcctcactcagggcacacgggtcctgggcccagtctgccctgactcaggctagcctccgtgtctgggtctcgtaggtcagtcgaatcacctatcctcctgcctacgtacggaacctgacaaggtggttaccggttgggggttatggtactagtcggttacctcgtacggtaccagtactaattactccgaaggtccaccgaaccgaccccctaaactcattcctaagtttacgtagacggtacagtacgtccgtaccgtcgtacggggtttacacgtcggtacttccgtaggtaccgctaccgtacgttcgcgaacgtaaccgtaccgtccctaccgtacgtacctacgtccgtacggtaccggctaccgtggtacgacggaacggaccgtacgtccgttagttaactaccgttgtaccgacttacgtcgttacgtacgttcgaccttaagttccgagtcgtatcgttagtntaccggtaagtcggtacggacttaggtactacggttcccaggtaccctacgtcggaaccgtaacccg

SEQ ID NO: 234247 - DNA, 875 bp, Homo sapiens
  misc_feature: GYAE6OF02GQA53.39.86.H09.1.454.CMB.1.raw
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (275)..(275): a, c, t, g, unknown or other
  misc_feature (275)..(275): n is a, c, g, or t
tcagtcgcactagtcacgaccggtgctcgatttagtgctatagacttgggtttgggggggggtctcaggaggcagcgctctcaggacatctaccaccatggcctgggctctgctgctcctacaccctcctcactcagggcacgagggtcctgggcccagtctgaccctgactcgaggctgccctcgtgtcgtgggtcctcgtaggacacgtcgtactccaacctctctcctcgccacgtacggaacngngtaggtggttacggggttgggttacngtaacttagtcgttccgtaccgtacgtaaccaagtacctaaatccgtaccgacggtacccaacccgtaccccgtaacccccctaactctaacgttaccgttaaagttttcgggaacggtaacggtactaacgggttaacccgtccccggttacccggttacgggtttaacggtttaacctaacgttcccggtttctttccgccgggtttacgtccgtaaaccgtacggttacgtaccgggaacccttaaccgggtcccgtacccctttaccgtaacccgtaccgttaacggtttccccgtacggggtacccgtcccgttaaccgggtaaccgggttggaaccggggaaacccgggtcggtaaccggtttacgttaaacggttttaaccttaacggttacgccggttaaccgtccgttaaccttacgtttacgttaaccgtaagttaacccgttgggtaacggtcgggttaacgttttcctttacgggttacggtttaccgggtaaacggttacgggtaaaccgttaacgtaacggtttaccgtacccgtttaacgggtcccggtaaaccgtccggtaacccggtaaccccggtaaccccg

SEQ ID NO: 234248 - DNA, 754 bp, Homo sapiens
  misc_feature: GYAE6OF02GVAHD.39.86.H09.1.454.CMB.1.raw
tcagtcgcactagtcacgaccggtgctcgatttagtgctatagacttgggttgggggtctcaggaggcagcgctctcaggacatctccaccatggcctgggctctgctgctcctcaccctcctcactcgagggcacgagggtcctcgggcccagtctcgccctgactcaggctcgcctccgtgtcgtgggtctcgtaggacagtcgatcacctatcctcctgcacgtacggaaccagcgaggtggtacgggtttgggggttatggtacttatcgttcctccgtcggtaccgagactaacgtactccgacggaccaaccggaccccgtaacccccctaaacgtacctaccttacttaacgttttacgtacgggtaacgttacgtaacggttaacgtccccggtaccccgttagggttacgggttttacctacggtccgttctttcctaccgtcgaccgttaccgtaacgttccgtacgacccgaccgtcccgggtccctcccggtacacccgtacttccgtcggtccggccgtaccgtcggtaccggtacggaacgggcggacggtcgttagttaacttacttccgtaggtccgtacgtccgttacgttagtttccgaactaacgtcggtacgggtagttaccgtacgtttacgttcggttacgggtaccggtaaggggtaaccgggtaaccgtacggttaccgtacgtttaccgggtaccgttacgggtacccacccgggtaacccgtacccgg

SEQ ID NO: 234249 - DNA, 845 bp, Homo sapiens
  misc_feature: GYAE6OF02H5I8J.39.86.H09.1.454.CMB.1.raw
  modified_base (142)..(142): a, c, t, g, unknown or other
  misc_feature (142)..(142): n is a, c, g, or t
  modified_base (242)..(242): a, c, t, g, unknown or other
  misc_feature (242)..(242): n is a, c, g, or t
tcagtcgcactagtcacgaccggtgctcgatttagtgctatagacttgggtttgggggggggtctcaggaggcagcgctctcaggacatctccaccatggcctgggctcgtgctgcctccgtccaccctcctactactacgngggcacgacgggtccgtcgggacccagtctcgccgtgactcgaggctcgcctcgtgtcgtcggtctcgtaggactaggtcactacacctatccgtacgtnaccgtaacgtacgggaacccagtaccgtaaggttcggttacgggggttttaggggtattaacggaactttagttccggttcccgttaccgggtttaaccggaaaccgttggaaacctaacgtttaacccgccgggtaaaacgtaacccgaaccccccgaaaccggttaacccccccttaaaatacccgtaaagttttacctttaaagtttaccggttaagggaccgggtaaacccttaagggttaacccgttcccccgggtaccgtttaaccggggtttaaggttaccctttaacgttccggtttacttttaccgggaaacggttttccccgcggtttaaaaaccgttccggggttaacgacccgttaaaaccccgccccggtaacgtttacccccgttacctacggaaccttccgtccgtacggtccggtactccggaggtaccgtcgaggacgtgtacttagttattacgtacgagtactagttctacgtactagtactacgtagtacgtacggtcgtactggttacggtagttacggacggttaacgtacgtaacgtcgttaaccgtccggtaacttacggacacccgtagaacccccgg

SEQ ID NO: 234250 - DNA, 864 bp, Homo sapiens
  misc_feature: GYAE6OF02G4X4P.39.86.H09.1.454.CMB.1.raw
tcagtcgcactagtcacgaccggtgctcgatttagtgctatagacttggggtttgggggtctcaggaggcagcgctctcaggacatctccaccatggcctgggctctgctgctcctcaccctcctcactcagggcacagggtcctgggcccagtctgcctgactcaggctgccgtccgtgtccgtgggtctcgtaggacagtcgctacaccagttctcctgacacgacggaaaccagacgaggtcggtacgggttgggggttatagtactagtcggtctccgttacggacctagactaacttacgtaccgaaggtaccaacgtaccgaacccccaaacgtcaacgttactaagttttacgacgggtaacgttacgtaagttaccggtacccgggtaccgttcgggttaaacgggtttacctaacggttccgtaccgtttcctaccggttcggtaacccgttaccctaaaggttcccgtaacggggtaacccgtaaaccggtaccccgggttaccctttaccccggtaacggtaacccgtacccggtttccgttaacccgggtccgggttaacccggtaccgtaaccggggtctaacgggggtaacggtaacggggtacggtacggtttaaacgtacgtttaaacgtttacccggtacggaccgtaacgggttaccttaacggttaactttacgaacgttaaacgtcggttaagttacgggttaacttacggttaacgttttacgggttacggttaaaccgggtttaacgggtacccgggggttaaacaacggggtttaacctacccgggttaacgtttaccgggtaccgttaaccgggaccccggtttaaaccccggacccggg

SEQ ID NO: 234251 - DNA, 732 bp, Homo sapiens
  misc_feature: GYAE6OF02GDK9N.39.86.H09.1.454.CMB.1.raw
  modified_base (157)..(157): a, c, t, g, unknown or other
  misc_feature (157)..(157): n is a, c, g, or t
  modified_base (174)..(174): a, c, t, g, unknown or other
  misc_feature (174)..(174): n is a, c, g, or t
  modified_base (365)..(365): a, c, t, g, unknown or other
  misc_feature (365)..(365): n is a, c, g, or t
  modified_base (502)..(502): a, c, t, g, unknown or other
  misc_feature (502)..(502): n is a, c, g, or t
  modified_base (587)..(587): a, c, t, g, unknown or other
  misc_feature (587)..(587): n is a, c, g, or t
tcagtcgcactagtcacgaccggtgctcgatttagtgctatagacttgggtttgggggggggtctcaggaggcagcgctctcaggacatctcccaccatggcctgggctctgctgctcctcaccctctcactcgaggcaacgtgggtcctgggcccngtctcgccctgactcgnggctcgcctccgtgtcgtgggtactcgtaggacctggttcgactcaaccctattcctcctagccacgtcggaaacccgtcctaaggtcggtacggggtttgggtactcggacttagtcttccgtccgtacggtaccaggctaacttacgaccgaaggtcaaccgacccgtaacccccaaattccaactttnaattttacggacggttagtacctaaggtaacgttcccggacccttacggttacggggtttcctaagtccgtttccttcctccggtaacgtcctaacggtcttcgacgggacctaacccgcccgggtcctttacccgngtaaccctacttccggtacggtcggtacccgtccgtagcccgtaagggacgtcggtaacgtggttaatcgtttaatccggtaccncgtacgtccgtgtaagttcccgtaagccgttaagcgttacggacgttccgtttacgtccggtttaacggcggttaaggggacctaaccggttaagtccgacggttccttcccggggtataaccggcccggtaacgtaaccccccg

SEQ ID NO: 234252 - DNA, 763 bp, Homo sapiens
  misc_feature: GYAE6OF02IU444.39.86.H09.1.454.CMB.1.raw
  modified_base (292)..(292): a, c, t, g, unknown or other
  misc_feature (292)..(292): n is a, c, g, or t
  modified_base (320)..(320): a, c, t, g, unknown or other
  misc_feature (320)..(320): n is a, c, g, or t
tcagtcgcactagtcacgaccggtgctcgatttagtgctatagacttggggtttgggggctgggggtctcaggaggcagcgctctcaggacatctccaccatggcctggctctgctgctcctcaccctcctcactcgaggcacgcgggtcctcgggacccaggtctcgccctagacctcgacggtctcgccgttccggtgtcgtcgggttcctcgtacggacaggtacgactccgaacctgtcctctcgctaacgtcggaaccagcgaggttacggtcggttagggggttancgtactagttcgtctccgtcggtaaccngtacatactcgaggacctacgaccgtaccccaatctactacgtatttagacgtacggtactacgtaaccgtcgtaccgtaggttacgggttactaacggttccgttcctttacgtacgttcgtacctaacgttcgtacgtacgggtaccaccgtaccggtcccttaccgtacgtactacgtcccgtcgggtcgtacccgtacggacggtactacgggacggagtacctacggtttacgtaacttcgtaaccgttcgacgtaccgtacgtttacgtacgtttacgaccttaacgtacggtaggtacccgtttaggttacgtttaacggtttaccggttaccggggttagggtaaacccgggttaccgggtaaacccgttaacggtttccttacccgggtttaaccccgggtacgttaacccgggtaccggttaaaccccccggg

SEQ ID NO: 234253 - DNA, 794 bp, Homo sapiens
  misc_feature: GYAE6OF02G8XQG.39.86.H09.1.454.CMB.1.raw
  modified_base (142)..(142): a, c, t, g, unknown or other
  misc_feature (142)..(142): n is a, c, g, or t
tcagtcgcactagtcacgaccggtgctcgatttagtgctatagacttgggttgggggtctcgaggaggcagcgctctcaggacatctccaccatggcctgggctctgctgcctcctcaccctcctcacctcgagggcaacgngggtcctcgggccagtctcgccctgactcgagctcgcctcgtgtctgggtctacgtaggactacggtcgaactcctaccacttccgtcgtacgcctaacggtcggaaacctaggtaccgagggttcggtaacggggtttgggggttatacgacgtagttcgtccttcgtcggtaaccgacgataatacgtacgaggaccaaccgaccgtaaccccaaacgtactaatttaacgttaagcggtacgttaacgaacggtaacgttccggtccggttaagttacgggtttaactacgttccgtactttcgtcgtaccggttctaccgtaaggtcgtacggaccaccggtaccctccgtaccttacgacttacgtccgtacggtccgaccgtacgtacgggccgttaacggacggacgtaccggacgtttacgtagtttaaccttacgggtacggaaccgtccgtaacgtttcgttccggtaacgacccggtttaagtaacgggttaccggttaacgttaaaccggtagtttccgtttaaggtccggttaacccggggtaagggttaaaccccgggtataacggtaacccggttaacttcccgggtaaccgttaccgggaaccgtacccggggtaacccttaaccgggtaaccccc

SEQ ID NO: 234254 - DNA, 807 bp, Homo sapiens
  misc_feature: GYAE6OF02GNRE4.39.86.H09.1.454.CMB.1.raw
  modified_base (248)..(248): a, c, t, g, unknown or other
  misc_feature (248)..(248): n is a, c, g, or t
tcagtcgcactagtcacgaccggtgctcgatttagtgctatagacttgggggggggggtctcaggaggcagcgctctcaggacatctccaccatggcctgggctctgctgctcctcaccctcctcactcagggcacgagggtcctgggcccagtcctcgccctgactcgaggtctcggccctcgtgtcgtgggtctcgtaggactaggtacatccaaccagtcctcctgacctacgtacggaaacccnggccaggttacggtacgggttggggttaactggtacttagttcgtacctccgtcggtaccagacctaaatctacccgaggaccaaccgtacccgaaccccctaaacgtcctattacttatttacggtggtaggtaacgtaacggtaccgtcccgggtaccccgttaggttaacggggtttaccttacgtccggtttccgttaccctcggttacggtaccccttaacgtaacggttccgtacgggaacccacccggtaccggtcccctacccgtggtaacccttacgtccgtccggttaccgggtcccgtaccggtacgggtacgtaacgggacggtacgggaacggttacgttagttaacgtttacttaaccgtcgtacgtacctcttaaccgttagtccgtacgttaacgttctaacggtacgtagtttaccgtttaggttccgttaccggttaacggggttcggtaaccgggtacggtaaccggttacgttacggttacccggttaccggttaccggtaacccgttaacccggaccccgtaaccccgtaaacccccg

SEQ ID NO: 234255 - DNA, 647 bp, Homo sapiens
  misc_feature: GYAE6OF02FSIUH.39.86.H09.1.454.CMB.1.raw
  modified_base (232)..(232): a, c, t, g, unknown or other
  misc_feature (232)..(232): n is a, c, g, or t
  modified_base (323)..(323): a, c, t, g, unknown or other
  misc_feature (323)..(323): n is a, c, g, or t
  modified_base (546)..(546): a, c, t, g, unknown or other
  misc_feature (546)..(546): n is a, c, g, or t
tcagtcgcactagtcacgaccggtgctcgatttagtgctatagacttgggttgggggtctcaggaggcagcgctctaaggacatctccaccatggcctgggctctgctgctcctcaccctcctcactcagggcacagggtcctgggcccagtctgccctgactcaggctgcctccgtgtctgggtactcgtaggacagtcgagtccaccgattctcctgcctactggaaccngcagtgtacggttgggggttatggtactagtgtctccgtggtaaccagacctatactccgaggcacaccgaccccaaatcatctagtttancgaggtactaagtactccggcccttaggtacgggtttctaacgtcgttacttcgtcgtacggtcctaccgtaagttcctcggaacctaacgaccggtcccttccgacgtaacctactcgtcgttacggctaccgtacggtaccgtaggacggtagaacggttcgtagttaacttactccggttagaccgtagtactcggtaattcggactaagtccagggtanacgttattagtacgttacgttacggtaacgggtacggtaaccgtaacggtttcgaccgttaccggtacgtaccggtacctacggaccccgacggtaacccc

SEQ ID NO: 234256 - DNA, 769 bp, Homo sapiens
  misc_feature: GYAE6OF02GYZHD.39.86.H09.1.454.CMB.1.raw
  modified_base (224)..(224): a, c, t, g, unknown or other
  misc_feature (224)..(224): n is a, c, g, or t
tcagtcgcactagtcacgaccggtgctcgatttagtgctatagacttgggttgggggtctcaggaggcagcgctctcaggacatctccaccatggcctgggctctgctgctcctcacccctcctcactcagggcacagggtcctgggcccagtctgccctgactcaggctcgcctccgtgtctgggttcctcgtacggacaggtcgactccacctatccttccncgcaacgtacggaaccaggctagtcggtacggttggggttactagacttatgttcctccgtacggtaacagactaatctaccgagccaaccgaccgaaccccctaaatccacttacgtaatttcgtacgaacggtactaaggtaccgtccggtaccttacgggtaacggggttttaccaagttccgtcctttaccgtcggtttacgaccgttaacctaacgttccgaggtaccgaaacccgtacccgggttacccctaccccgtaacgacccgtacccgtttcgtaacccggtcggtaccccttacgggtacgggacgttaggacccgggtaacggtaccggtacgttacgtacgtttaaacgttccgacgtacgtaccgttacgttaccgttatttccgataaaccgttggttaaaccgtagggttaacgttacgtttacgtttacgggttccgttaacggggttaacggttacgggtaaacgtaacggtttccgaaccgtttaccggtcggtaacccgtaccggaccgtaccccggaaacccg

SEQ ID NO: 234257 - DNA, 269 bp, Homo sapiens
  misc_feature: GYAE6OF02HHT18.39.86.H09.1.454.CMB.1.raw
  modified_base (243)..(243): a, c, t, g, unknown or other
  misc_feature (243)..(243): n is a, c, g, or t
  modified_base (249)..(269): a, c, t, g, unknown or other
  misc_feature (249)..(269): n is a, c, g, or t
tcagtcgcactagtcacgaccggtgctcgatttagtgctatagacttgggtttgggggggtttggtggtctccactcccgccttgacgaggctgattattactgcagctcatttgcaatcagtgaggcttatgtcttcgggaagtgggaccaaggtcatcgtcctaggtcagcccaaggccaaccccactgtcactctcgttcccgccctcctcactagtgcgactgagcgggctggcaggcncatagnnnnnnnnnnnnnnnnnnnnn

SEQ ID NO: 234258 - DNA, 509 bp, Homo sapiens
  misc_feature: GYAE6OF01BLXRT.2.43.D10.1.454.CMB.1.raw
  modified_base (353)..(353): a, c, t, g, unknown or other
  misc_feature (353)..(353): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaatggtatcagcaaaaaccaggggcagcccctcagctcctgatctctgctgcatccagattgcagagtggcgtcccatcgcggttcagtggcagtggatcgtggggacagtatttccnccctcaccatcagcagtctgacaaactgaggtattttgctaactttacttctgtcaacagacgctacacctaccccgctacctaccttttcgcccgtaggggacccaaagggtggactcgtacaaaaggtactgtggctcgacaccatcgtgttcc

SEQ ID NO: 234259 - DNA, 502 bp, Homo sapiens
  misc_feature: GYAE6OF01DMXYR.2.43.D10.1.454.CMB.1.raw
  modified_base (473)..(473): a, c, t, g, unknown or other
  misc_feature (473)..(473): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagacaaaaaccgaggggcagcccctcagctcctgatctctgctgcatccagattgcagagtggcgtcccatcgcggttcagtggcagtggatcgtgggacagatttcctccctcaccatcagcagtctgacaaactgaggtattttgactaactttacttctgtacaacagagactaccacctaccccgctactactttcgacccgtagggaccaaggtgatactaanaaaagactgtgctgacaacactctgttcc

SEQ ID NO: 234260 - DNA, 475 bp, Homo sapiens
  misc_feature: GYAE6OF01D4P2Z.2.43.D10.1.454.CMB.1.raw
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
  modified_base (349)..(349): a, c, t, g, unknown or other
  misc_feature (349)..(349): n is a, c, g, or t
  modified_base (407)..(407): a, c, t, g, unknown or other
  misc_feature (407)..(407): n is a, c, g, or t
  modified_base (459)..(459): a, c, t, g, unknown or other
  misc_feature (459)..(459): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaatggtatcagcaaaaaccngggcagcccctnagctcctgatctctgctgcatccagattgcagagtggcgtcccatcgcggttcagtggcagtggatctgggacaggatttcnccctcaccatcagcagtctgcaaactgaggattttgcaacttacttctgtcaacaganctacactacccgcacactttgcccagggaccaaggtgatctacaaagactgnggctgacacatctgtc

SEQ ID NO: 234261 - DNA, 502 bp, Homo sapiens
  misc_feature: GYAE6OF01CFTR1.2.43.D10.1.454.CMB.1.raw
  modified_base (210)..(210): a, c, t, g, unknown or other
  misc_feature (210)..(210): n is a, c, g, or t
  modified_base (258)..(258): a, c, t, g, unknown or other
  misc_feature (258)..(258): n is a, c, g, or t
  modified_base (271)..(271): a, c, t, g, unknown or other
  misc_feature (271)..(271): n is a, c, g, or t
  modified_base (354)..(354): a, c, t, g, unknown or other
  misc_feature (354)..(354): n is a, c, g, or t
  modified_base (481)..(481): a, c, t, g, unknown or other
  misc_feature (481)..(481): n is a, c, g, or t
  modified_base (490)..(490): a, c, t, g, unknown or other
  misc_feature (490)..(490): n is a, c, g, or t
  modified_base (494)..(494): a, c, t, g, unknown or other
  misc_feature (494)..(494): n is a, c, g, or t
  modified_base (498)..(499): a, c, t, g, unknown or other
  misc_feature (498)..(499): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggnaagtcaggccgttaacaccttatttaaattggtatcagacaaaaaccnggggcagcccctnagctcctgatctctgctgcatccagattgcagagtggcgtccatcgcggttcagtggcagtggatcgtgggacagtatttccnccctcaccatcagcagtctgacaacctgaagtattttgactaacttactactgtacaacagtacgttacacgtacccccgtggtaccgttcggaccagggaccaaggtagaaatacaaacgtactgnggctgcacntctntctnntcc

SEQ ID NO: 234262 - DNA, 522 bp, Homo sapiens
  misc_feature: GYAE6OF01CT2LB.2.43.D10.1.454.CMB.1.raw
  modified_base (258)..(258): a, c, t, g, unknown or other
  misc_feature (258)..(258): n is a, c, g, or t
  modified_base (271)..(271): a, c, t, g, unknown or other
  misc_feature (271)..(271): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagacaaaaaccgnggggcagcccctnagctcctgatctctgctgcatccagtattgcagagtggcgtcccatcgcggttcagtggcagtggatcgtggggactagtatttcctccctcaccatcagcagtctgacaaactgaggtatttgactaacttacttctcgtacaacagacgtactaccacctaccccgactactacttttcgcccgtaaggggacctaagggtcgactaccgtaacaaaaggtactggtgctacgacaccactcgtgttcc

SEQ ID NO: 234263 - DNA, 532 bp, Homo sapiens
  misc_feature: GYAE6OF01AIX1E.2.43.D10.1.454.CMB.1.raw
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (350)..(350): a, c, t, g, unknown or other
  misc_feature (350)..(350): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagcaaaaaccnggggcagcccctnagctcctgatctctgctgcatccagattgcagagtggctccatcgcgttcagtggcagtgatcgtgggacagtactttccnccctcaccatcagcagtctgactaactgagtattttcgactaactttcttctgtacaactagacgacctaaccaccctaccccgctacttacctttcgacccgtaggggacctaagggtcggactaccgtaacgaaaacggtaccgtaggtacggactacgaccaacctattcctggttacc

SEQ ID NO: 234264 - DNA, 528 bp, Homo sapiens
  misc_feature: GYAE6OF01CYS56.2.43.D10.1.454.CMB.1.raw
  modified_base (274)..(274): a, c, t, g, unknown or other
  misc_feature (274)..(274): n is a, c, g, or t
  modified_base (435)..(435): a, c, t, g, unknown or other
  misc_feature (435)..(435): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctaatttaaattggtatcagacaaaaaccgaggggacacgcccctnacgctcctgatctctgctgcatccagattgcagagtcggcgtcccatccgcgttcagtcggctagtggatcgtgggactagtactttctccctcacctatcagcagtctgacaaactgaggttatttcgacttaactttacgttctacgtacaacagaacnctaaccacctaccccgctactactttcgcccgaacgggaccgaggtacgactactaacgaaaagtactggtagctcgacactactcgtgttcc

SEQ ID NO: 234265 - DNA, 607 bp, Homo sapiens
  misc_feature: GYAE6OF01CM6D2.2.43.D10.1.454.CMB.1.raw
  modified_base (254)..(254): a, c, t, g, unknown or other
  misc_feature (254)..(254): n is a, c, g, or t
  modified_base (267)..(267): a, c, t, g, unknown or other
  misc_feature (267)..(267): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaattggtatcagcaaaaccnggggcagcccctnagctcctgatctctgctgcatccagtattgcagacgtggccgtcccagtccggtcggttcaggtcggcaggtggatcgtaggggactagtactttcctccctcacctactcagctagtctacgactaaacgtgaggttatttacgactaactttacttcttacgtacaacgagtacgtacctacctacccgtaccccgctaacccttaccgttttccggaaccccggtaacgggggtaacccgtaaacggggtcgggtaaccttacgtaaccgtaaaaacggtaccgttacggtacgggtacctaccggtacctaaccgtacttccgttacgtttacccg

SEQ ID NO: 234266 - DNA, 490 bp, Homo sapiens
  misc_feature: GYAE6OF01D3HRQ.2.43.D10.1.454.CMB.1.raw
  modified_base (270)..(270): a, c, t, g, unknown or other
  misc_feature (270)..(270): n is a, c, g, or t
  modified_base (462)..(462): a, c, t, g, unknown or other
  misc_feature (462)..(462): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagacaaaaaccaggggcagcccctnagctcctgatctctgctgcatccagattgcagagtggcgtcccatcgcggttcagtggcagtggatctgggacagatttctccctcaccatcagcagtctgcaaactgaggattttgctaacttacttctgtcaacagaacgctaacactaccccgctacacttttcgcccaggggaccaaggtggatctanaaaagaactgtggctgacaccatctgtc

SEQ ID NO: 234267 - DNA, 599 bp, Homo sapiens
  misc_feature: GYAE6OF01DDJRW.2.43.D10.1.454.CMB.1.raw
  modified_base (273)..(273): a, c, t, g, unknown or other
  misc_feature (273)..(273): n is a, c, g, or t
tcagacgctcgacacacgaccggtgctcgatttagactagcagtaaggggagtcgtcaggcaggacacacgcatggacatgagggtccccgctcagctccgtggggctcctgctactgtggctccgaggtgccagatgtgacatcgacatcgacccagtctccatcctccctgtctgcatctgtgggagaccgagtcaccatcacttgccggcaagtcaggccgttaacacctatttaaattggtatcagacaaaaccgagggcacgcccctnagcctcctgactctctgctgcatccagattgcagagtcgcgtcccatcgcgttcagtgcagtgatcgtgggactagactttcctaccctacaccattaccagtctacgtctacggactaaaccgtagtaaggttattttacggacttaaacgtttacttacttacgtactaaacgagaacgtactaaccaaccctacccgacctaaccttaccgttttaccgacccgtaaacggggtacccaaagggttacggaacgttacgtaacgtaaaaacggtacgttacggtacggtacgttacgacctaacccacttccgttggttaccc

SEQ ID NO: 234268 - DNA, 634 bp, Homo sapiens
  misc_feature: GYAE6OF01A5LVF.2.43.D10.1.454.CMB.1.raw
  modified_base (253)..(253): a, c, t, g, unknown or other
  misc_feature (253)..(253): n is a, c, g, or t
  modified_base (339)..(339): a, c, t, g, unknown or other
  misc_feature (339)..(339): n is a, c, g, or t
tcagacgctcgacacacgaccggtgctcgatttagactagcagtaagggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccttaacacctatttaaatggtatcagcaaaaaccnggggcagcccctcagctcctgatctctgctgcatccagattgcagagtgcgtcccatcgcggttcagtgcagtggatcgtgggacngtatttcctccctgaccatcaaggcctaggtcctagaccaaacgttggaacggtatttttcggaccttaaacctttaacttccttaggtttaccaaacctaggtaacgtacccttaaccgtaacccgtaaccccccgtctaacccgttacccgtttttcggacccccggtaagggggtaaaccctaaacggggttacggaaccttaccgttaaacgaaaaaaccgggtaccgtttacgggtaacggtacccgttacgacccgtaaacccgtaacgttcccgttaacggtttcccc

SEQ ID NO: 234269 - DNA, 513 bp, Homo sapiens
  misc_feature: GYAE6OF01DGA8V.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagacaaaaccaggggcagccctcagctctgatctctgctgcatccagattgcagagtggccgtccatcgcgttcagtggcagtggatcgtgggacagtatttcctccctcaccatccagcagtctgcaaactgaggtatttgactaacttacttctgtacaacagacgctaacacctaccccgctactacttttcgacccgaacggggaccaaggtcgactactaacaaaacgtactagtggacctacgactacctactcttgttacc

SEQ ID NO: 234270 - DNA, 558 bp, Homo sapiens
  misc_feature: GYAE6OF01CZBX4.2.43.D10.1.454.CMB.1.raw
  modified_base (268)..(268): a, c, t, g, unknown or other
  misc_feature (268)..(268): n is a, c, g, or t
  modified_base (352)..(352): a, c, t, g, unknown or other
  misc_feature (352)..(352): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagacaaaaccaggggcagccctnagctcctgatctctgctgcatccagattgcagagtggcgtccatcgcggttcagtggctagtggatcgtgggacagtactttcnccctcaccatcagcagtctgacaaatgaggtattttgactaacttacttctagtacaactagactactaacctacctaccccgctaaccttacgtttcgacccgtaaggggtaaccctaaagggtcggaacttacgtaaccgaaaaaggtaccgttacgggtacgtaccgtaccggacctaacccgtattccgttacggtttaccc

SEQ ID NO: 234271 - DNA, 492 bp, Homo sapiens
  misc_feature: GYAE6OF01A6ZY6.2.43.D10.1.454.CMB.1.raw
  modified_base (269)..(269): a, c, t, g, unknown or other
  misc_feature (269)..(269): n is a, c, g, or t
  modified_base (351)..(351): a, c, t, g, unknown or other
  misc_feature (351)..(351): n is a, c, g, or t
  modified_base (429)..(429): a, c, t, g, unknown or other
  misc_feature (429)..(429): n is a, c, g, or t
  modified_base (465)..(465): a, c, t, g, unknown or other
  misc_feature (465)..(465): n is a, c, g, or t
  modified_base (484)..(484): a, c, t, g, unknown or other
  misc_feature (484)..(484): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagcaaaaaccaggggcagcccctnagctcctgatctctgctgcatccagattgcagagtggcgtccatcgcggttcagtggcagtggatcgtgggacagtatttcnccctcaccatcagcagtctgacaaactgaggtattttgactaactttacttctgtcaacagagactacactaccccgntactactttcgcccaggggaccaaggtgactcgtanaaagactgtgctgacaccntctgttcc

SEQ ID NO: 234272 - DNA, 550 bp, Homo sapiens
  misc_feature: GYAE6OF01D3AE3.2.43.D10.1.454.CMB.1.raw
  modified_base (358)..(358): a, c, t, g, unknown or other
  misc_feature (358)..(358): n is a, c, g, or t
  modified_base (538)..(538): a, c, t, g, unknown or other
  misc_feature (538)..(538): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagacaaaaaaccaggggcagcccctcagctcctgatctctgctgcatccagattgcagagtggcgtcccagtccgcggttcaggtggcagtggatcgtgggacagtactttcnccctcaccatcagcagtctgacaaactgaggtattttgactaactttacttctgtacaactagaacgtctaaccaacctacccccgataccctacttttcgacccgtaagggggaaccctaaagggttcggaacttacctaacaaaaaggtacttaggtaggaccgtcggaccaaccctnttccgtgttacc

SEQ ID NO: 234273 - DNA, 500 bp, Homo sapiens
  misc_feature: GYAE6OF01D5YCG.2.43.D10.1.454.CMB.1.raw
  modified_base (270)..(270): a, c, t, g, unknown or other
  misc_feature (270)..(270): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
  modified_base (387)..(387): a, c, t, g, unknown or other
  misc_feature (387)..(387): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaatggtatcagacaaaaaccaggggcacgcccctnagctcctgatctctgctgcatccagattgcagagtgcgtccatcgcggttcagtggcagtggatcgtgggacagtatttcncccctanacctatcagcagtctgacaaactgaggtntttgctaacttacttctgtacaacagaagcctacacctacccgcacctactttcgcccgaggggtaaccaaggtgactctacgaaagactagtcggactgacaccatctgtcc

SEQ ID NO: 234274 - DNA, 615 bp, Homo sapiens
  misc_feature: GYAE6OF01B5TIU.2.43.D10.1.454.CMB.1.raw
  modified_base (183)..(183): a, c, t, g, unknown or other
  misc_feature (183)..(183): n is a, c, g, or t
  modified_base (223)..(223): a, c, t, g, unknown or other
  misc_feature (223)..(223): n is a, c, g, or t
  modified_base (250)..(250): a, c, t, g, unknown or other
  misc_feature (250)..(250): n is a, c, g, or t
  modified_base (261)..(261): a, c, t, g, unknown or other
  misc_feature (261)..(261): n is a, c, g, or t
  modified_base (363)..(363): a, c, t, g, unknown or other
  misc_feature (363)..(363): n is a, c, g, or t
tcagacgctcgacacacgaccggtgctcgatttagactagcagtaaggggagtctcaggcaggacacagcatggacatgaggtccccgctcagctcctggggctcctgctactgtggctccgaggtgccagatgtgacatcgacatgacccagtctccatcctcctgtctgcatctgtggganaccgagtcaccatcacttgccggcaagtcaggccgttaanacctatttaatggtatcagacaaaacngggcagccctnagctctgatctctgctgcactccagattgacaggagtcggcgttcccagtccgcggtttcaggtggctaggtggactcgtaggggacagtactttccacctnaccagtccaggtccaggtctagactaaacgtgaggttatttcgacttaacgttacttcgtacgtacaacgtacgacgttacctaaccgtacccgttaaccccgcttaaccgttaccgttttaccggaccccggtaaggggtaaccccttaaaggggttacggtaacgttaaccgttaaccggaaaaaggttcccgttacgggtacggtacccgtacgaacccgttaaccacggtttccgttacggtttaacc

SEQ ID NO: 234275 - DNA, 515 bp, Homo sapiens
  misc_feature: GYAE6OF01B75MR.2.43.D10.1.454.CMB.1.raw
  modified_base (257)..(257): a, c, t, g, unknown or other
  misc_feature (257)..(257): n is a, c, g, or t
  modified_base (402)..(402): a, c, t, g, unknown or other
  misc_feature (402)..(402): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacaccttatttaaatggtatcagacaaaaaccnggggcacgcccctcagctcctgatctctgctgcatccagattgcaggagttggccgtccccatccggtcggttcagtggcaggttggatcgtaggggactagtactttcctccctcacctatcagcagtctgactaacgtgagtntttagctaacttactctgtacaagagagactacacctaccccgacacctacgtttcgacccgaggggaccaagggtcgactctacaaagtctagtgactgcacactcgtgttc

SEQ ID NO: 234276 - DNA, 542 bp, Homo sapiens
  misc_feature: GYAE6OF01D6DMT.2.43.D10.1.454.CMB.1.raw
  modified_base (259)..(259): a, c, t, g, unknown or other
  misc_feature (259)..(259): n is a, c, g, or t
  modified_base (271)..(271): a, c, t, g, unknown or other
  misc_feature (271)..(271): n is a, c, g, or t
  modified_base (298)..(298): a, c, t, g, unknown or other
  misc_feature (298)..(298): n is a, c, g, or t
  modified_base (362)..(362): a, c, t, g, unknown or other
  misc_feature (362)..(362): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacaccttatttaaattggtatcagacaaaaaccgngggcacgccctnagctctgactctctgctgcatccagtnttgcagacgtggctccagtcgtcgttcagtcggctaggtggactcggtggactagtactttccncctacactatacagtactagtctacgactaacgtgtagtatttcgactaacttctctagtacaacgagacgactacgacctacccgctacctacgtttcgacccgtaggaccgtacggtacgtactacgtaacgtaaaggtctacggtcgtacgtacgacctacctagtccgtgttaccg

SEQ ID NO: 234277 - DNA, 525 bp, Homo sapiens
  misc_feature: GYAE6OF01B2ASE.2.43.D10.1.454.CMB.1.raw
  modified_base (256)..(256): a, c, t, g, unknown or other
  misc_feature (256)..(256): n is a, c, g, or t
  modified_base (267)..(267): a, c, t, g, unknown or other
  misc_feature (267)..(267): n is a, c, g, or t
  modified_base (361)..(361): a, c, t, g, unknown or other
  misc_feature (361)..(361): n is a, c, g, or t
  modified_base (488)..(488): a, c, t, g, unknown or other
  misc_feature (488)..(488): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagacaaaaacngggcagccctnagctcctgatctctgctgcatccagtattgcagagtggccgtcccagtccggtcggttcaggtggcaggtggatcgtgggactagtactttccnccctcacctatcagcagtctgacaacgtgagtatttgactaactttcttctgtacaacagacgtacctaccacctaccccgctacttacctttcgacccgtacgggacctaaggtcgaactcgtaanaaacgtacgtgtcgactcgaccaactctcgtgttacc

SEQ ID NO: 234278 - DNA, 519 bp, Homo sapiens
  misc_feature: GYAE6OF01ECFLL.2.43.D10.1.454.CMB.1.raw
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagcaaaaaccnggggcagcccctnagctcctgatctctgctgcatccagattgcagagtgcgtccatcgcggttcagtggcagtggatcgtgggacaggtactttcctccctcaccatcagcagtctcgactaaacgtgtaggtattttgacctaactttacttctgtacaacagacgactacacctaccccgactacctacgtttcgacccgtagggaccaagggtcgacgtctaacgaaagtactaggtgcgtcgacacctactcgtgttcc

SEQ ID NO: 234279 - DNA, 510 bp, Homo sapiens
  misc_feature: GYAE6OF01AJKYY.2.43.D10.1.454.CMB.1.raw
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (500)..(500): a, c, t, g, unknown or other
  misc_feature (500)..(500): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagcaaaaaccnggggcagcccctnagctcctgatctctgctgcatccagattgcagagtggcgtcccatcgcgttcagtggcagtggatcgtggggacagtactttcctccctcacctatccagcagtctgactaactgagtattttgactaactttacttctgtacaacagagctacacctaccccgctactaccttttcgacccgtagggaccaagggtcgacgtcgtacaaaagacgtgtcggctgacaccnctcgtgttcc

SEQ ID NO: 234280 - DNA, 499 bp, Homo sapiens
  misc_feature: GYAE6OF01ASO3Z.2.43.D10.1.454.CMB.1.raw
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
  modified_base (351)..(351): a, c, t, g, unknown or other
  misc_feature (351)..(351): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaatggtatcagcaaaaaccnggggcagcccctnagctcctgatctctgctgcatccagattgcagagtggcgtcccatcgcggttcagtggcagtggatcgtgggacagtatttcnccctcaccatcagcagtctgacaaacgtgaggtattttcgactaactttacttctgtacaacgagagctacacctaccccgcactactttcgacccgagggacctaggtggactctacaaaagactgtcggctgacaccatcgtgtcc

SEQ ID NO: 234281 - DNA, 539 bp, Homo sapiens
  misc_feature: GYAE6OF01DOZCF.2.43.D10.1.454.CMB.1.raw
  modified_base (209)..(209): a, c, t, g, unknown or other
  misc_feature (209)..(209): n is a, c, g, or t
  modified_base (264)..(264): a, c, t, g, unknown or other
  misc_feature (264)..(264): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccggnaagtcaggccgttaacacctattaattggatcagacaaaacgagggcacgccctnagctcctgatctctgctgcatccagattgcagagtcgcgtccagtcgcggttcaggtggcaggtgatcgtagggacagtactttcctccctacaccagtcagcagtctagacaacgtgagtatttgacctaactttacttctagtacaacagtactactaccacctaccccgactaaccttacgttttcgaccccgtaaggggacctaagggtacggacttaccgtaacgaaaacgtacgtagtacggtacctcggaccactactcgttgttacc

SEQ ID NO: 234282 - DNA, 566 bp, Homo sapiens
  misc_feature: GYAE6OF01CTJ2O.2.43.D10.1.454.CMB.1.raw
  modified_base (259)..(259): a, c, t, g, unknown or other
  misc_feature (259)..(259): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacaccttaatttaattggtatcagacaaaaaccgnggggcacgccctcagctcctgatctctgctgcatccagtattgacagagtcggccgtcccagtcggtcggttcaggtggcaggtggatcgtagggactagtactttcctccctacacctatcacgctagtctagactaacgtgagttatttcgactaacttacttctacgtacaacgagacgtactacctaccgtacccgactaccttaccgtttcgacccggtaacgggtaccaagggttcgaacgtacgtaacgtaaaagtaccgttaggtacgtacgtacgacctaccgtacttcgtcgttacc

SEQ ID NO: 234283 - DNA, 571 bp, Homo sapiens
  misc_feature: GYAE6OF01B5M1Q.2.43.D10.1.454.CMB.1.raw
  modified_base (357)..(357): a, c, t, g, unknown or other
  misc_feature (357)..(357): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagacaaaaaccgaggggcacgcccctcagctcctgatctctgctgcatccagattgcagagtggcgtcccatcgcgttcaggtggcagtggatcgtgggacagtactttccnccctcaccatcagcagtctagactaaacgtgaggttattttgacttaactttacttctagtacaacagacgtacctaaccaccctaccccgactaaccttaccgttttaccgacccggtaacggggaacccgtaaagggttacgtaacgttaccgtaacgaaaacggtaacgttggtacggaccttcggacccaacctacttcgtcgtttaccc

SEQ ID NO: 234284 - DNA, 595 bp, Homo sapiens
  misc_feature: GYAE6OF01D4Q4K.2.43.D10.1.454.CMB.1.raw
  modified_base (262)..(262): a, c, t, g, unknown or other
  misc_feature (262)..(262): n is a, c, g, or t
  modified_base (276)..(276): a, c, t, g, unknown or other
  misc_feature (276)..(276): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatccctccctgtctgcatctggtgggagaccgagtcaccatcacttggccgggcaagtcaggccgttaacaccttatttaaattggtatcagacaaaaaccgnggggcacgcccctnagctcctgatctctgctgcatccagtattcgcaggtaggtcggtccgtccctagtccggtacggttcgaggtcggctaggtgacgtcgtaggggactagttactttcctccctacacctatcgacgactagtctagactaacgttggtagttatttcgaccttaactttacttctacgttacaaagacgacgtacctaaccgaccctaacccgtctacttaccgttaccggacccgtaaggggtaacctagggtacgtaacttacgaacgtaaaacggtacgtggtacggtacgtacgacctacctacttcgtgttacc

SEQ ID NO: 234285 - DNA, 536 bp, Homo sapiens
  misc_feature: GYAE6OF01BY3U8.2.43.D10.1.454.CMB.1.raw
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
  modified_base (349)..(349): a, c, t, g, unknown or other
  misc_feature (349)..(349): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaatggtatcagacaaaaccngggcagcccctnagctcctgatctctgctgcatccagattgcagagtggctccatcgcgttcagtggcagtgatcgtgggactagtactttccnccctcaccatcagcagtctgacaacgtgagtatttgactaacttacttctgtacaacgagacgtactaccaccctaccccgactaccttacgtttacgacccgtaacggggacctaagggtacgtacgtacctaacgaaaacggtacgtggtacggtacgtacgaccaacctacgttcgtcgttacc

SEQ ID NO: 234286 - DNA, 699 bp, Homo sapiens
  misc_feature: GYAE6OF01DMHYY.2.43.D10.1.454.CMB.1.raw
  modified_base (211)..(211): a, c, t, g, unknown or other
  misc_feature (211)..(211): n is a, c, g, or t
  modified_base (266)..(266): a, c, t, g, unknown or other
  misc_feature (266)..(266): n is a, c, g, or t
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatccctccctgtctgcatctggtgggagaccgagtcaccatcacttgccggnaagtcaggccttaacactatttaattggtatcagacaaaacgagggcacgccctnagctctgatctctgctgcatccagtntgcagngtcggccgtccagtccggtcggtttacgaggttcggacgtaggtacggtacgttcggtaggggaacctacggttaccttttccccgtaccccgtactaaccctacgttaccgaacgtaccgtaacgttaccgtacgtaaccgtaaacggttaggtaacggtttaagttttacgtaacctttaaaccgttttacctttaccgttacggttaacctaaacgtaacggtaacgtaacctacccgtaacccgtaccccgtaccttaaccgttaccgttttacccggacccggtaaccggggtaacccgtaaacgggttacggtaacgttaaccgtaaacggtaaaacggtacgttacggtacgtaccgtacgtacccgtaaccttaccgttcgttcgtttacccg

SEQ ID NO: 234287 - DNA, 628 bp, Homo sapiens
  misc_feature: GYAE6OF01C9XEH.2.43.D10.1.454.CMB.1.raw
  modified_base (211)..(211): a, c, t, g, unknown or other
  misc_feature (211)..(211): n is a, c, g, or t
  modified_base (274)..(274): a, c, t, g, unknown or other
  misc_feature (274)..(274): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacgttgccgggnaagtcaggaccgttaaacacttaatttaaagttggtatcagacaaaacgagggcacgccctanacgctcctgactctctgctgctatctagtattgacaggacgtcggccgtcccagtccgtacggttcgaggttggcgtaggtggtacgtcggtagggactaggttactttaccctcccgtactaacctactaccgtagacctaggttcctacggaacctaaacgttggtaacggttattttcggacttaaacgtttacttctacgttaacaacgtaggtaccacttaaccctacccgtaccccgctaaccgttaccgttccggacccggttaagggaccgtaaacgggtgtaaccgttaccgaaacgtaaaggaccgttgtacggctaccggactaaccgtcttcgtgttacccg

SEQ ID NO: 234288 - DNA, 529 bp, Homo sapiens
  misc_feature: GYAE6OF01BTRE3.2.43.D10.1.454.CMB.1.raw
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (389)..(389): a, c, t, g, unknown or other
  misc_feature (389)..(389): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagcaaaaaccnggggcagcccctnagctcctgatctctgctgcatccagattgcagagtggcgtccatccgcggttcagtggcaggtggatcgtaggggactaggtactttctccctcaccatcagcagtctgcaactgaggtntttgactaactttacttctgtacaacagagcctaactaccgtaccccgctacctaccttttcgacccgtaggggaccctaagggtcggtacgtcgtacaaaagtacgttaggtcggacttcgaccacctatcctgttacc

SEQ ID NO: 234289 - DNA, 580 bp, Homo sapiens
  misc_feature: GYAE6OF01AXKHP.2.43.D10.1.454.CMB.1.raw
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaatggtatcagacaaaacgnggggcagcccctnagctcctgatctctgctgcatccagtattgcagagtggacgtcccatcgcggttcaggtcggcaggtggatcgtgggactagtactttcctccctacaccatcagcagtactgactaaacgtgtacggttattttacgactaactttacttctagtacaacgagtacgtactaaccacccgtaccccgtactaccttaccgttttaccgacccggtaacgggacccgtaaagggtacgtacgtaccgtaacgaaaacgtaccgtacggtacggtaccttacggacctaacccgtacttaccgttggttaccc

SEQ ID NO: 234290 - DNA, 548 bp, Homo sapiens
  misc_feature: GYAE6OF01EI55O.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagacaaaaaccgaggggcacgcccctcagctcctgatctctgctgcatccagtattgcagagtcggcgtccatcgcggttcagtgcagtggatcgtgggacagtactttcctccctcacctactcagctagtctgacaaactggtaggtatttcgacttaactttacttctgtacaactagactcctaccacccgtacccgtacctactaccgtttcgacccgtacggggaccgtaacgggtgaacgtacctaacgaaaacgtaccgtaggtcggacgtcgactacctagttccgtgttaccc

SEQ ID NO: 234291 - DNA, 498 bp, Homo sapiens
  misc_feature: GYAE6OF01BQZ2Y.2.43.D10.1.454.CMB.1.raw
  modified_base (253)..(253): a, c, t, g, unknown or other
  misc_feature (253)..(253): n is a, c, g, or t
  modified_base (265)..(265): a, c, t, g, unknown or other
  misc_feature (265)..(265): n is a, c, g, or t
  modified_base (424)..(424): a, c, t, g, unknown or other
  misc_feature (424)..(424): n is a, c, g, or t
  modified_base (464)..(464): a, c, t, g, unknown or other
  misc_feature (464)..(464): n is a, c, g, or t
  modified_base (487)..(487): a, c, t, g, unknown or other
  misc_feature (487)..(487): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaatggtatcagcaaaacngggcagcccctnagctcctgatctctgctgcatccagattgcagagtggctcccatcgcgttcagtggcagtgatcgtgggacagtatttcctccctcaccatcagcagtctgacaactgtaggtatttgactaactttactctcgtacaacagactctacacctaccccnctacctactttcgacccgagggacctagggtgacgtctanaaacgtctagtgcgtcgacaccntccgtgttacc

SEQ ID NO: 234292 - DNA, 735 bp, Homo sapiens
  misc_feature: GYAE6OF01AKJVR.2.43.D10.1.454.CMB.1.raw
  modified_base (211)..(211): a, c, t, g, unknown or other
  misc_feature (211)..(211): n is a, c, g, or t
  modified_base (260)..(260): a, c, t, g, unknown or other
  misc_feature (260)..(260): n is a, c, g, or t
  modified_base (336)..(336): a, c, t, g, unknown or other
  misc_feature (336)..(336): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctggtgggagaccgagtcaccatcacttgccgggnaagtcaggccgttaacaccttatttaaattggtatcagacaaaaaccgnggggcacgcccctcacgctcctgatctctgctgcatccagtattgacaggagtcggccgtccctagtcggcggttnaggtcggctaggtggacgtcgtaggggacctaggtactttccctcccgttaccacctattaccgagtccgttagtccgtacgacgtaaaacgttggtaacggtttacgttttacggtaccttaaaccgttttccgtttaccgttacggtaaccgtaaaccgacggtaaaccgtaccccttaaaccccgtaacccccgttaaccccccgtaaccttaaccccgtttaacccgttttacccgggaaacccccgggtaacgggggtaacccgttaaaggggtacccggtaaacgttacccgtaaaaccggtaaaaaccggttacccggttacggggttaacccggtaccgttacgggaacccccttaacccgttaacgtttcccggtttacgtttaaccccg

SEQ ID NO: 234293 - DNA, 594 bp, Homo sapiens
  misc_feature: GYAE6OF01ECIQH.2.43.D10.1.454.CMB.1.raw
  modified_base (264)..(264): a, c, t, g, unknown or other
  misc_feature (264)..(264): n is a, c, g, or t
  modified_base (278)..(278): a, c, t, g, unknown or other
  misc_feature (278)..(278): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatccctccctgtctgcatctggtgggagaccgagtccaccatcacttgccgggcaagtcaggccgttaaacaccttaatttaaattggtatcagacaaaaaccgnggggcacgcccctnagctcctgatctctgctgcatccagattgcagaggtggccgtcccagtccgcggttcaggtggcaggtggatcgaggggactagtactttccgccctacaccgatcacgctacgtctagacaaacgtggaaggttattttagaccttaactttacttcgtagttaccaacgagtacaccttaacctaacccgtaccccgtactaaccgttaccgttttccggacccgtaacggggtaaccaagggttacggacgttaccgtaacgaaaaggtaccgttggtacggtacgtcgaaccacctactccgttgttacccg

SEQ ID NO: 234294 - DNA, 613 bp, Homo sapiens
  misc_feature: GYAE6OF01A4I3X.2.43.D10.1.454.CMB.1.raw
  modified_base (267)..(267): a, c, t, g, unknown or other
  misc_feature (267)..(267): n is a, c, g, or t
  modified_base (292)..(292): a, c, t, g, unknown or other
  misc_feature (292)..(292): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagcaaaacgagggcacgccctnagctctgatctctgctgcatccagnttgcagagtcgcgtcccatcggcggttcaggtggcgagtggatcgtagggactagtacttttccgccccttacgaaccacgttcgacgtacgtacgttccgtacgaccgtaaacgttgtaacggtttacttttacggtacttaaaccttttacttcgtacgttacctaaaccgtaggtaacctacccttaaccacccgtaacccccgtactaccgttaccgttttacgccccggtaacgggtaaccgtaaacggtgtaacgtacgtaacgaaaacgtacgtaggtacggtacgtacgactacctacttcgttacgttaccc

SEQ ID NO: 234295 - DNA, 635 bp, Homo sapiens
  misc_feature: GYAE6OF01EGI3E.2.43.D10.1.454.CMB.1.raw
  modified_base (273)..(273): a, c, t, g, unknown or other
  misc_feature (273)..(273): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtccaccatcacttgccgggcaagtcaggccgttaacaccttatttaaatggtatcagacaaaaaccgaggggcacgcccctnagctcctgactctctgctcgcatccagtattcgcagaggtcggccgtcccagtccgtcggttcaggtggctaggtggatcgtgggacagtactttccgtccctcaccatcacgctacgttctacgaactaaacgtggtaacggtttacttttacggaaccttaacctttacctttaccgttacgttaacctaacgtaagtaacgtaccttaacccgaacccgttacccccgtacctaaccgttacccgttttacggaccccgtaacggggtaaacccgtaagggtacggtaaccgtacgtaaccgtaaaacggtacgtacggtacggacgtacgtacccaaccgtacttcgttcgttacccg

SEQ ID NO: 234296 - DNA, 554 bp, Homo sapiens
  misc_feature: GYAE6OF01AS177.2.43.D10.1.454.CMB.1.raw
  modified_base (258)..(258): a, c, t, g, unknown or other
  misc_feature (258)..(258): n is a, c, g, or t
  modified_base (272)..(272): a, c, t, g, unknown or other
  misc_feature (272)..(272): n is a, c, g, or t
  modified_base (435)..(435): a, c, t, g, unknown or other
  misc_feature (435)..(435): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacaccttatttaaattggtatcagacaaaaaccnggggcacgcccctnagctcctgatctctgctgcatccagattcgacagagtcggccgtcccatccggcgttcaggtgctagtcggatcgtgggactagtactttcctccctacacctatcagctagtctagacaacgtgagtactttcgactaacttacttctcgtacaacgagacncctaacacccgtacccgctaacttaccgtttacgacccgtagggacccgtaagggtacgtactacgtaacaaaacgtcgttaggtcggtcgtacgaccacctcgttccgtacgttaccc

SEQ ID NO: 234297 - DNA, 507 bp, Homo sapiens
  misc_feature: GYAE6OF01D7S5R.2.43.D10.1.454.CMB.1.raw
  modified_base (267)..(267): a, c, t, g, unknown or other
  misc_feature (267)..(267): n is a, c, g, or t
  modified_base (274)..(274): a, c, t, g, unknown or other
  misc_feature (274)..(274): n is a, c, g, or t
  modified_base (340)..(340): a, c, t, g, unknown or other
  misc_feature (340)..(340): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatccctccctgtctgcatctgtgggagaccgagtcaccatcacttgccggcaagtcaggccgttaacacctatttaaattggtatcagacaaaacgagggcagccctnagctccngatctctgctgcatccagattgcagagtggctcccatcgcgttcagtggcaggtgatcgtgggacngtacttctcctcaccatcagcagtctgacaaactgagtatttagctaactttacttctgtacaacagacgactaccacctaccccgactactacgtttcgacccgagggacctaaggtacgacgtactaacgaaagtacgtgtagctacgacactatcgtcgttacc

SEQ ID NO: 234298 - DNA, 588 bp, Homo sapiens
  misc_feature: GYAE6OF01DGWU0.2.43.D10.1.454.CMB.1.raw
  modified_base (212)..(212): a, c, t, g, unknown or other
  misc_feature (212)..(212): n is a, c, g, or t
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtccaccatcacttggccgggnaagtcaggccttaacacctatttaatggtatcagacaaaaccgnggggcacgcccctnagcctcctgactctctgctgcatccagtattgacagagtcggccgtcccagtccggcggtttacaggtcggctaggtggactcgtagggactagtactttcctccctacaccatcagctagtctagactaactgagttatttcgacctaacttacttctcgtacaacgagacgtacctaacctacccgtacccgacctaccttaccgttttccggacccggtaacggggtaaccgtaacgggttacggtaactaccgtaaacgtaaaacggtaaccgtaggtacggaccgtacgacccacctacttccgttcgttacc

SEQ ID NO: 234299 - DNA, 644 bp, Homo sapiens
  misc_feature: GYAE6OF01CKVM2.2.43.D10.1.454.CMB.1.raw
  modified_base (185)..(185): a, c, t, g, unknown or other
  misc_feature (185)..(185): n is a, c, g, or t
  modified_base (209)..(209): a, c, t, g, unknown or other
  misc_feature (209)..(209): n is a, c, g, or t
  modified_base (248)..(248): a, c, t, g, unknown or other
  misc_feature (248)..(248): n is a, c, g, or t
  modified_base (260)..(260): a, c, t, g, unknown or other
  misc_feature (260)..(260): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtggganaccgagtcaccatcacttgccggnagtcaggccttaacactattaatgtatcagacaaaacgngggcacgccctnagctcctgatctctcgctcgcactccagtacttgactaggtagtcggccgtcccagtccggtacgttcgaggtcggcgtaggtggacgtcggtagggactaggtaccttttccgtccctacgacctacgtaccacgtaccgtagtccgtacgtaaccgtaacgtaggtaacggttacttttacggtaccttaaacgtttcgttacctacgtaccaaacgtacgtaaccgtaacctaacctaccccgtacccgtaccttaccgttacgtttaccggacccggtaacgggtacccgtaaacgggtacgttaacgtaaccgttaacgaaaacggtaccgttacggtacggtaccgtacgaccctaactacgttccgttcgttacccg

SEQ ID NO: 234300 - DNA, 627 bp, Homo sapiens
  misc_feature: GYAE6OF01AYTBE.2.43.D10.1.454.CMB.1.raw
  modified_base (261)..(261): a, c, t, g, unknown or other
  misc_feature (261)..(261): n is a, c, g, or t
  modified_base (274)..(274): a, c, t, g, unknown or other
  misc_feature (274)..(274): n is a, c, g, or t
  modified_base (367)..(367): a, c, t, g, unknown or other
  misc_feature (367)..(367): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttggccgggcaagtcaggtccgttaacaccttaatttaaatggtatcagacaaaaaccgnggggcacgccctnagctcctgactctctgctgcatccagtattgcagagtcggcgtcccagtccgcggttcaggtggcaggtggatcgtgggactagtactttccnccctcacctatcacgctagtctacgactaacgtggtaaggttattttacggaccttaactttaccttcgtacgtaccaaacgtaggaccgtacctaacccgtaacccgtaacccccgacttaacccgtttaccgttttaccggaaccccggtaacgggggtaaccctaaaggggttccggtaacgttaccgtaaacgaaaacggttaccgttcggtacggaccgttaccgacctaaccctcgttaccgttcgtttacccg

SEQ ID NO: 234301 - DNA, 691 bp, Homo sapiens
  misc_feature: GYAE6OF01EJ3L2.2.43.D10.1.454.CMB.1.raw
  modified_base (209)..(209): a, c, t, g, unknown or other
  misc_feature (209)..(209): n is a, c, g, or t
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccggnaagtcaggccttaacaccttatttaaattggatcagacaaaaaccgnggggcacgccctnacgctcctgatctctgctgcacgtccagtattgacagaggtcggccgtacccagttccggtacggttcaggtcggactaggtcggatcgtaggggaactaggttactttcccgtacccttacaaccctagtaccaacgtccgtaacgtccttaacggaacctaaaacgttcggtaaaggtttacgtttttacggaaacctttaaaccttttacttttaccgtacgttaaccaaacgtaacgtaaccgtaacccttaaaccctaaccccgttaacccccgtacctaacccgtttaacccgttttaccgggaaccccggtaaggggtaaccccgtaaagggtacgtaaccgttaccgtaaacgtaaaacggtacgtacggtacggtaccgttacgaccctaacctacttccgttccgtttaccc

SEQ ID NO: 234302 - DNA, 643 bp, Homo sapiens
  misc_feature: GYAE6OF01AD7AQ.2.43.D10.1.454.CMB.1.raw
  modified_base (260)..(260): a, c, t, g, unknown or other
  misc_feature (260)..(260): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttggccgggcaagtcaggccgttaacaccttatttaaattggtatcagacaaaaaccgnggggcacgcccctcagctcctgatctctgctgcatccagtattgcgagagtcggccgtcccagtccggtcggttcgaggtggcctaggtcggtactcggtagggtactagttactttcccgtacccctaccgaacctactccacgtcctacgtcctagaacctaaacgtggtaaggttacttttacgtaacttaacctttaccgttacttacgtacaacgtagtaacgtaccttaacccgacccttaccccgacttaacccttaccgttttaccggacccggtaacggggtacccgtaaagggtacggtaacgttaaccgtaacgtaaaacggtcgttagggtacggccttacgacctacccgtacttccgttccgttacccg

SEQ ID NO: 234303 - DNA, 629 bp, Homo sapiens
  misc_feature: GYAE6OF01CQWQF.2.43.D10.1.454.CMB.1.raw
  modified_base (185)..(185): a, c, t, g, unknown or other
  misc_feature (185)..(185): n is a, c, g, or t
  modified_base (261)..(261): a, c, t, g, unknown or other
  misc_feature (261)..(261): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtggganaccgagtccaccatcacttgccgggcaagtcaggccgttaacaccttaatttaaattggtatcagacaaaaaccgngggacacgccctcacgctcctgactctctgctgctactccagtattgacaggtagtcggccgtacccagttccggcggtttcaggtcggcgaggtggtactcggtgggactaggtacttttccgtacccctacacctatacgacgtacgtacgtctacgacctaaacgtaggtaggttacgttttacgacctttaaactttactttaccgttacgtactaaacgtacgtaacgtacctaaccgtaacccttaccccgtactaaccgttaccgtttacgacccggtaacgggaccgtaagggtaggtaaccttacgtaacgaaacggtacgtacggtcggactacggacctacgtactcgttcgttacc

SEQ ID NO: 234304 - DNA, 707 bp, Homo sapiens
  misc_feature: GYAE6OF01EXLCH.2.43.D10.1.454.CMB.1.raw
  modified_base (257)..(257): a, c, t, g, unknown or other
  misc_feature (257)..(257): n is a, c, g, or t
  modified_base (269)..(269): a, c, t, g, unknown or other
  misc_feature (269)..(269): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtccaccatcacttgccggcaagtcaggccgttaacaccttatttaaatggtatcagacaaaaccgngggcagccctanacgctcctgactctctcgctcgcatccagtattcgcgagtagtcggccgtccgtacgtccggtacggttcagggtcgcgtaggtcggtactcggtagggtacctagttactttcccgtacctacacctacgtcaacgtcctagttacctacggtaacctaaacggttcggtaacggttaacgtttttaacggacctttaaaccgttttaccgttaccgttaccgttaaccgtaaagtaacgtaaccggtaacccttaaacccgtaaccccgttaacccccgtacttaaacccgttaccgttttacccgggacccggtaaacgggggtaaccctaaacgggttacggtaaccgtaaccggtaaacgtaaaacggttaaccggttcggttaaccgccgttaacggacccttacccgtacgtttccgtacggtttaccccg

SEQ ID NO: 234305 - DNA, 640 bp, Homo sapiens
  misc_feature: GYAE6OF01BKXDI.2.43.D10.1.454.CMB.1.raw
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctggtgggagaccgagtccaccatccacgttggccgggacaagtcacggtccttaacaccttaatttaaatggtatcagacaaaaacgngggcacgccctnagctcctgactctctgctgctatccagtattgcagacgtggccgtccagtcgtacggttcaggtcggacaggtggatcgtagggactagtacgtttccacccgtcacctatacacgtctacgtctgaacctaaacgtggtaaggttattttacggacttaactttaccgttacgttagtaaccaaacgtacgaacgtaccctaacctacccgttaccccgacctaaccgttaccgttttaccggaaccccggtaacggggtaacctaacggggttacgtaaccgttaccgtaaacgtaaaacggtaccgttacgggtacgtacccgttacgaacccgtaacctacgttccgttcggtttaccc

SEQ ID NO: 234306 - DNA, 805 bp, Homo sapiens
  misc_feature: GYAE6OF01DY4ZW.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatcgacccagtctccatcctccctgtctgcatctggtgggagaccgagtccaccatccacgttcggccgggacaacggtcgaacggtacccgtttaaacacctttaattttaaaacgttggtaactacaacgaaccgaaaaaaccggacggggaccaaccggcccccttacgacgtccttccgtagtacttccgtcgtcgtccgttacgacctacgtacccgtaagtacgttacggacgtaagggtacggttcgggtacccgttacccgtacggttccggttaccggtttacgtaagggtcgggtacggtaagggtcgggtaacgtttcggtaacgggtaactacggtttacctttcccctacccgtaccaaccctagttacccgaacgtccgtacgttacgtaacggaaacctaacggttggtaacggtttacttttacggtaaccttaaccgttttacgttccgttaacgtaacaaaccggtacgtaccgtaacccttaaccccgtacccgttaacccccgtacttaacccgtttaccgtttacccgggacccggtaacgggtaaccgtaagggttaccgtaacgttaaccgtaaacggtaaaacgttcggtacggtacgtccgtacgaccctaacccttgttccgtccgtttacccg

SEQ ID NO: 234307 - DNA, 762 bp, Homo sapiens
  misc_feature: GYAE6OF01C1LXB.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatccctccctgtctgcatctggtgggacgaccgagtccaccatcctacgttggcccgggacaaaggtccgacgggtacccgtttaaacacctttaaattttaaaagttgggtaacttacgaacgaaccgaaaaaaccggagggggaccaaccggtccccctacgacgtaccttccgtagtacttcctcgtcgctcgactactaccgtagtacgttcgacgaggtacggtcggtaccgtacccgtagttccggtcggttacgaggttcggacgtaggtaggtacgttcggtacggggactacggttactttccgtacccttacgaacctacgtaccgacgtactacggtactacgtaaaccgtaacggttaggtaacggttacttttacggaacctttaaacgtttaccgtttacgtacgtaaccgaaacgtacgtaaccgtaccttaacccgtaccccgtaaccccgtacttaaccgtttacccgtttaccgggaacccggtaaacgggtaacccgtaagggtacgtaaccgtaacgtaaacgtaaaacggtacggttcggtacggacgttacgacctaaccgttacttccgttcgttacccg

SEQ ID NO: 234308 - DNA, 547 bp, Homo sapiens
  misc_feature: GYAE6OF01D6CVT.2.43.D10.1.454.CMB.1.raw
  modified_base (249)..(249): a, c, t, g, unknown or other
  misc_feature (249)..(249): n is a, c, g, or t
  modified_base (260)..(260): a, c, t, g, unknown or other
  misc_feature (260)..(260): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggcctaacacctattaaatgatcagcaaaaacngggcagccctnagctcctgatctctgctgcatccagatgcagagtggcgtccatcgcgtcagtgcagtggatcgtgggacagtatttcctcccgtacaccatcacgcagtctgacctaaacgtgaggtatttcgactaacgtttacttctgttacaacagagtacctacacctaccccgctaactaccgtttcgaccccgtaggggaaccctaagggtacggtacttaccgtaaacgtaaaacggtaccgtaggtacggaccttacggaccctaaccgtacttccgtcggtttacccc

SEQ ID NO: 234309 - DNA, 795 bp, Homo sapiens
  misc_feature: GYAE6OF01D64AJ.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatcgacccagtctccatccctccctgtctgctatcgtggtgggacgaccgagtccaccatctacgttcggccgggacaacgtcgaacggtaccgttaaactacctttaattttaaagttggtaactaccaacggaaaccgaaaaaaccggcggggaccaccggtcccctacgacgtccttccgtgtacttccgtcgtcggtctcgacctacgtacccgagtacgttcggacgtaacggtacggtccgggtacccgttacccgtacggttcccggtaccggtttaccgaacggggttcgggtacgtaaggggttggtaaccgttacgggtacggggtaaaccttacggtttacctttccccgttaccccgtacctaaccgtacgttccggaacgtaccgtacgttaccgtaacgtaaccgtaaagttcgggtaacgtttacgttttacggaacctttaacgttttaccgttcgtaacgtaaccaacgtacgtaccgtacctaacccgtaccctaccccgtacttaccgtttaccgttaccggaacccggtaagggtaaccgtagggtacgtaaccgtaaccgtaaacgtaaaacggttcgtacgggtaccgtaccgtaacgtaccctaaccgttcttcgtccgtttaaccc

SEQ ID NO: 234310 - DNA, 612 bp, Homo sapiens
  misc_feature: GYAE6OF01EDNEO.2.43.D10.1.454.CMB.1.raw
  modified_base (185)..(185): a, c, t, g, unknown or other
  misc_feature (185)..(185): n is a, c, g, or t
  modified_base (268)..(268): a, c, t, g, unknown or other
  misc_feature (268)..(268): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtggganaccgagtcaccatcacttgccgggcaagtcaggtccttaacaccttatttaaatggtatcagacaaaacgagggcacgccctnacgctcctgacttctctgctgcatccagtattgcaggtaggtcggccgtcccagtcggtcggttcgaggtcggctaggtggactcgtagggactagttactttcctccctacaacctactcacgcctagtctagaactaaacgtggtaagttattttacgacttaacctttacttacgttacgtaactaacgagactacctaaccaccctacccgtactaccgttacgtttaccggacccggtaacggggtaacctaagggtacgtaacgttaccgtaaagtaaaacggtcgttacgggtacggtaccgttacgacctaacccttacgttccgttacgttaccc

SEQ ID NO: 234311 - DNA, 614 bp, Homo sapiens
  misc_feature: GYAE6OF01AQH28.2.43.D10.1.454.CMB.1.raw
  modified_base (258)..(258): a, c, t, g, unknown or other
  misc_feature (258)..(258): n is a, c, g, or t
  modified_base (277)..(277): a, c, t, g, unknown or other
  misc_feature (277)..(277): n is a, c, g, or t
  modified_base (383)..(383): a, c, t, g, unknown or other
  misc_feature (383)..(383): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacaccttatttaaatggtatcagacaaaaaccgngggcacgccctcagctccngactctctgctgcatccagtatgacagagtcggccgtcccagtccggtcggttacgaggtcgggcgtaaggtcgggactcggttacggggactaggtactttcccncccgttacaacctatacagacgtagtctacgtactaaacgtggtaaggttacttttcggacttaaacctttaccgttacgtactaaccgtaaacgacgtaacgtaacccttaaccgaacccctaccccgacttaacctaccgttttacgacccggtacgggacctagggtacgtactacgtaataaaacggactggtaccggtcgtacggacctacacttcgtcgttaccc

SEQ ID NO: 234312 - DNA, 645 bp, Homo sapiens
  misc_feature: GYAE6OF01EHKPC.2.43.D10.1.454.CMB.1.raw
  modified_base (266)..(266): a, c, t, g, unknown or other
  misc_feature (266)..(266): n is a, c, g, or t
  modified_base (278)..(278): a, c, t, g, unknown or other
  misc_feature (278)..(278): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatccctccctgtctgcatcgtgtgggacgaccgagtccaccatcacttcggccggcaagtcacggtccttaacaccttaatttaaatggtactcagacaaaaaccgngggcacgccctnacgctcctgatctctgctcgctactccagtacttgacgagtacgtcggccgtcccgtagtccggtcggttacgaggtcgggacaggtggacgttcggtagggtactagttcctttcctcccctacacctacgtcacgtctacgtacctagaaccgtaacgttggtaacgttatttcgaaccttaactttacgttaccgtacgttaaccaagtaacgacgttaccctaaccctacccgtaccccgtacttaacccgttaccgtttacccggaaccggtacgggtaaccgtaagggtacgtaaccgtacgaaacgtaaacggtcgtcggtacggtactacggaccctaaccgttacttcgtccgttacc

SEQ ID NO: 234313 - DNA, 952 bp, Homo sapiens
  misc_feature: GYAE6OF01DLL0M.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatcgacccagtcctccatccctccctgtctgcatctggtgggacgaccgagtccaaccatcacgttcggcccgggactaaggtccgacgggtacccgtttaaacaacctttaattttaaaagttggtaactaccgaaggaacccgaaaaaaaccggagggggaccaacggacccccccttacgaacggtccttacccgtagtaacgtttcccttcgtttcggccgttacggacctaaacgttcccctaaaggttacgtttacggaaccgtaaagggtaacgggttccgggtaccccggttacccccgttaaggttcccggggtttacccgggttttacgaaacggggtttccggggaccggttaacggggttacgggaaccgtttccggttagggggtaaacctaacgggtttaacctttttccccgttacccccgtaccctaacccgtaaccgtaccgtaaccggtaccgtaacgtttcccggttaacggtaacccgttaaaacggttacgggttaacggtttaacgtttttaccggtaaaccgtttaaacccgtttttaaccgtttaccgtttaaccggttaaaccgtaaaccggtaacggttaacccggtaacccttaaaccccgtaaacccccgtttaacccccgtaacccttaacccgtttaacccggtttttacccggaaccccgggttaaaccggggtaacccgtaaacggggttacgtaacgttaaccgtaaacgaaaacggttaccgttacgggtcggaaccgttacgaccttaaccgacgtttccgtcggtttaccc

SEQ ID NO: 234314 - DNA, 490 bp, Homo sapiens
  misc_feature: GYAE6OF01AZ5TE.2.43.D10.1.454.CMB.1.raw
  modified_base (226)..(226): a, c, t, g, unknown or other
  misc_feature (226)..(226): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
  modified_base (408)..(408): a, c, t, g, unknown or other
  misc_feature (408)..(408): n is a, c, g, or t
  modified_base (426)..(426): a, c, t, g, unknown or other
  misc_feature (426)..(426): n is a, c, g, or t
  modified_base (470)..(470): a, c, t, g, unknown or other
  misc_feature (470)..(470): n is a, c, g, or t
  modified_base (483)..(483): a, c, t, g, unknown or other
  misc_feature (483)..(483): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaanacctatttaaatggtatcagcaaaaaccaggggcagcccctcagctcctgatctctgctgcatccagatgcagagtggcgtcccatcgcggttcagtggcagtcggatctgggacagatttcncctnaccatcagcagtctgcaaactgaacggattttgacaactttacgttctgtcaaangagctacactaaccccgnacactttgcccaggggaccaaaggtggaatctacaaaaggctgnggctgacaccatntggtacc

SEQ ID NO: 234315 - DNA, 564 bp, Homo sapiens
  misc_feature: GYAE6OF01A1FM6.2.43.D10.1.454.CMB.1.raw
  modified_base (258)..(258): a, c, t, g, unknown or other
  misc_feature (258)..(258): n is a, c, g, or t
  modified_base (296)..(296): a, c, t, g, unknown or other
  misc_feature (296)..(296): n is a, c, g, or t
  modified_base (330)..(330): a, c, t, g, unknown or other
  misc_feature (330)..(330): n is a, c, g, or t
  modified_base (344)..(344): a, c, t, g, unknown or other
  misc_feature (344)..(344): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagacaaaaaccgngggacacgccctcagctcctgatctctgctgcatccanattgcagagtggcgtccatcggcgttcagtggcngtggatcgtggganacggtacttccgtccctacaccgatcgacgctaacgtctagaccaaactgaaggttattttcggacttaactttacttaccttagtaccaagtacgacgtctaaccacccttaccccgataacctacgtttcgacccgtagggtaaccaaagggttcgacttaccgtaacgaaaacgtacgttaggtcgacgtcggacaacccgtattcccgtgttaccc

SEQ ID NO: 234316 - DNA, 806 bp, Homo sapiens
  misc_feature: GYAE6OF01C4E2B.2.43.D10.1.454.CMB.1.raw
  modified_base (223)..(223): a, c, t, g, unknown or other
  misc_feature (223)..(223): n is a, c, g, or t
tcagacgctcgacacacgaccggtgctcgatttagactagcagtaaggggagtctcaggcaggacacagcatggacatgagggtccccgctcagctccgtggggctcctgctactgtggctccgaggtgccagatgtgacatcgacatcgacccagtctccatccctccctgtctgctatcgtggtgggacgaccgagtccaccatctacgttcggccggganaacgtcgacgggtacccttaaacctaaccttaattttaaagttggtaactacgaacgaaccgaaaaaccggcggggaccacgtcccctagacgtcctcctagtacttctcgtcgctcgacctactaccgagtatcgactaggtacggtcggtaccgtaccgtagtccggtacggttacgacggtcggagtacgggtaggtactcggtacggtacttacgttacctttcctaccctacgtaacctacgtaccgtaagtaccgtacggttacctaacggtaaaccgtaaacggttaggttaacggtttacgttttacgaaccgtttaacgtttaccgtttcgttaacgtaaccgaaacgtacgttaaccgttaacccttaacccgtaccccgttaaccccggtacttaacccggttttaacccggttaccgggaaaccccgggtaaacggggtaaccgttaacggggtaccgtaaccggttaacccgtaaaaacggttaaaacggttaccggttaccgggtaccgggttaaaccgtcccgtaaaccccgttaccgttaaccggttccggtttaccgtttaacccg

SEQ ID NO: 234317 - DNA, 893 bp, Homo sapiens
  misc_feature: GYAE6OF01COA3B.2.43.D10.1.454.CMB.1.raw
  modified_base (89)..(89): a, c, t, g, unknown or other
  misc_feature (89)..(89): n is a, c, g, or t
  modified_base (217)..(217): a, c, t, g, unknown or other
  misc_feature (217)..(217): n is a, c, g, or t
tcagacgctcgacacacgaccggtgctcgatttagactagcagtaagggagtctcaggcaggacacagcatggacatgagggtccccgntcagctcctggggctcctgctactgtggctccgaggtgccagatgtgacatcgacatgacccagtctccatccctcctgtctgcatctgtgggacgaccgagtccacctatcctacgttggcccgganaagtccacgggtcccgtttaaacaccgtttaattttaaacgttcgggtaatcgtaacgaccgtaaaaaaccgacgggggtaccaccgtaccccctacgaacgccgttacccgtaggtaacttccgttaccgtcgcctttcgacctacgtacccgtagtacttcgaccgtaggtacgtcggtaccgtacctaacggttccgtaccggttacgtacggttcggaccgtaggttccggacgtacgtcgggaacctaggtacgttttacccgtcccgtccgtaacccgtacgttaccgacgttacgacgttcctaccggtaaccgttaaacgtacgggttaacgttacgtttttacggtaacccgttaaaccgttttaccgttaccgttaacgttaacccgtaaaccgtaacggtaacccgttaccgttaaaccccgtaaccccgttaaccccggttaccgttaaacccgttacccggtttttaccgggaacccccggttaaaccggggtaacccggttaaaccggggttaccgggttaaaccgtttacccggttaaaacccggtaaaaaccggttaaacccgggtttacggttaacccgggttaaacccggtttacccggtaaaccccgtttaacccggtaacccgtttaacccggtttcgggtttttaaacccccccg

SEQ ID NO: 234318 - DNA, 830 bp, Homo sapiens
  misc_feature: GYAE6OF01DKAFE.2.43.D10.1.454.CMB.1.raw
  modified_base (229)..(229): a, c, t, g, unknown or other
  misc_feature (229)..(229): n is a, c, g, or t
tcagacgctcgacacacgaccggtgctcgatttagactagcagtaaggggagtctcaggcaggacacagcatggacatggagggtccccgctcagctccgtggggcctcctgctactgtggctccgaggtgccagatgtgacatcgacatcgacccagtcctccactccctccctgtctgctatcgtggtgggacgaccgagtccactactcgtacgttcggccggtanacggtaccgacggtaccgttaaacctaaccgtttaatttaaagttcggtactaccgaaacgaaacccgaaaaaccgggcgggaccaacccgtcccccgtagacgtcctaccggtataccttccgtcgtcgtacctcgtacctacctaccgtaagtacgttacggaccgtaaggtccgggttcccggtacccgttacccggtaggttcccggggttacggttaccggaagggttcccggacggttaagggtccggtaacggttccggtaaggggtaacctttaaccggtttcctttcccccgtacgtacccgaactacgtacgacgttacgtacgtacgtaactaaccgtaagttacgtaagttacttacgtaacttaccttacgtacgtacgtaacaacgtaccgtactaacccgttaacccctaaccccgtacctaccgtttaaccgtttacccggttacccgggaaacccgggtaaccggtaccggtaacggttaacggtaaccgtaaaccgggttaaaccgaaacgggttcccggttaggtccgggtaacccttacggacccccgttaaagtccccggttttaatccccgtttacccg

SEQ ID NO: 234319 - DNA, 626 bp, Homo sapiens
  misc_feature: GYAE6OF01BJH4K.2.43.D10.1.454.CMB.1.raw
  modified_base (280)..(280): a, c, t, g, unknown or other
  misc_feature (280)..(280): n is a, c, g, or t
  modified_base (363)..(363): a, c, t, g, unknown or other
  misc_feature (363)..(363): n is a, c, g, or t
  modified_base (396)..(396): a, c, t, g, unknown or other
  misc_feature (396)..(396): n is a, c, g, or t
  modified_base (405)..(405): a, c, t, g, unknown or other
  misc_feature (405)..(405): n is a, c, g, or t
tcagacgctcgacacacgaccggtgctcgatttagactagcagtaaggggaggtcgtcaggcaggacacagcatggacatgagggtccccgctcagctcctggggctcctgctactgtggctccgaggtgccagatgtgacatcgacatgacccagtctccatcctccctgtctgcatcgtgtcgggagaccgagtcacctatcacgttggccgggcaaaggtcagggaccgtttaaacaccttaatttaaacgttggtattccgagaaccaaaaaccgngggacacggcccctagacgctcctggattctctgcttagctactccagtacttggctaagcgtacgcgtccagtccggcgttnagtgacaggtggatcgtagggacagtatttccncctcgacanccagctagtctgactaagtcgaaggtatttcggactaacttacttctacgtacgaacgttaacgcgtaaccgtaacctaaccgttaccccgacgtaaccttaccgttttaccgacccggtaacgggttaccgaaacgggttacgaacgttaccctaacgtaaacggacgttacgttacggccgttacggaccttaccggtacttcccggtaagtttccccg

SEQ ID NO: 234320 - DNA, 618 bp, Homo sapiens
  misc_feature: GYAE6OF01A6R5R.2.43.D10.1.454.CMB.1.raw
  modified_base (272)..(272): a, c, t, g, unknown or other
  misc_feature (272)..(272): n is a, c, g, or t
  modified_base (289)..(289): a, c, t, g, unknown or other
  misc_feature (289)..(289): n is a, c, g, or t
  modified_base (395)..(395): a, c, t, g, unknown or other
  misc_feature (395)..(395): n is a, c, g, or t
  modified_base (455)..(455): a, c, t, g, unknown or other
  misc_feature (455)..(455): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctggtgggacgaccgagtcacctatcacttggccgggacaagtcaggaccgtttaaacaccttaatttaaattggtaatacaagaacaaaaaccgnggggccaacgcccctanacgcctcctgactctctgctgctatccagtacttgacagaggtcggccgtcccagtccggcggttcaaggtggacaggtggactcgtgggaactaggtactttccnccctacaccaatcagtctagtctagactaacgtgagttattttcgacttaactttacttntacgtacaaactgaactacctaaccgaacccttaccccgactaaccttaccgttacgacccggaagggtaacctaacgggtacggtaactaccgtaaagtaaaaacggtcgttacggttacggaccgttacggaacctaaccgacgtttccttacggttaccc

SEQ ID NO: 234321 - DNA, 778 bp, Homo sapiens
  misc_feature: GYAE6OF01C9HUI.2.43.D10.1.454.CMB.1.raw
  modified_base (222)..(222): a, c, t, g, unknown or other
  misc_feature (222)..(222): n is a, c, g, or t
  modified_base (279)..(279): a, c, t, g, unknown or other
  misc_feature (279)..(279): n is a, c, g, or t
  modified_base (295)..(295): a, c, t, g, unknown or other
  misc_feature (295)..(295): n is a, c, g, or t
  modified_base (312)..(312): a, c, t, g, unknown or other
  misc_feature (312)..(312): n is a, c, g, or t
  modified_base (333)..(333): a, c, t, g, unknown or other
  misc_feature (333)..(333): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtcgcagatgtgacatcgacatcgacccagtctccactccctccctgtctgctatcgtggtgggacgaccgagtccaccatccacgttcggccgganaagtcgacggtaccttaactaccttaatttaatggtaactacgagaacaaaaccggngggaccaccgccctanacgctactgtactctcngtctcgctactcgtagtctgngaagtcgtcgtaccgtccgtacgtccggtacgtacgtaggtcgacgtagggtagtacgtacggtagggtaacctacggttacctttccccttacctacccgtaactacgtccgtacgtacgtaccgttacggtaacgtaaacctaacgggttaacggtacgtttaccggtttaaccgtaacctttaaacccgtttaccgttactttaaccggtaacctaaccggtaacgtaccgtaaccccttaaccccgtaaccccgttaccccgaaccttttaaccccgtttacccggttaccgaaccccggggttaaaacgggtaaccgtaaaccggggtacgtaaacccggttaaccgtaaacgggtaaaaacggttcccggttggggtaaccgttaccccgtaccgtacgttaaaccccgttcgtttaaccggttcccgttttaaccccg

SEQ ID NO: 234322 - DNA, 639 bp, Homo sapiens
  misc_feature: GYAE6OF01DX7ZN.2.43.D10.1.454.CMB.1.raw
  modified_base (259)..(259): a, c, t, g, unknown or other
  misc_feature (259)..(259): n is a, c, g, or t
  modified_base (271)..(271): a, c, t, g, unknown or other
  misc_feature (271)..(271): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacaccttatttaaattggtatcagacaaaaaccgngggcacgccctnagctctgactctctgctgctactccagtattgacgtaggtagtcggccgtcccagttccggtcggttcaggtcggcgtaggtggaatcgtagggactaggtactttccctccctacaccctagtccgacggccggtcctggaccgtacgtacccgtaaggaacgttacgtttcgtacgtaccttaaaccgtttacttagtttcgtacgtaaggttacgtttacgttagttaccgttttcccgtttcccgcgttaccgttaccgggtttcggaacccggtaggggtaaccctaagggtacgtaacgtaacgttaaccgaaaaccggtacgttgggtacggtcttacggacctaaccgtgttcgttaccg

SEQ ID NO: 234323 - DNA, 738 bp, Homo sapiens
  misc_feature: GYAE6OF01DKGI7.2.43.D10.1.454.CMB.1.raw
tcagacgctcgacacacgaccggtgctcgatttagactagcagtaaggggagtctcaggcaggacacagcatggacatggagggtccccgctcagctccgtggggctcctgctactggtggctccgaggtgccagatgtgacatcgacatcgacccagtctccatccctcctgtctgctatcgtggtgggacgaccgagtcaccatcctacgttcggccgggacaaggtccgacggtaccttaacctacgttaatttaaagtggtactacaacgaacaaaacggcggacaccgccctacgacgtcctccgtagactccgtctcgctgacactaccgagtcgtcgacgtaaggtcggtcggtaccgtccgtagttccggtacggttacgaacgggttcggtacggtaacggtcggtacgtacggtacgggtacctacggttactttcccgtaccctactaccgttagaccggtagaccttaagggtcctaacggtaaactaaacgggttggtaaccgtttacgtttaccgtaaccgtttaaaccgttttccttacgtacggtaactaaaccggtacgtactaaccccgttaacctaccccgtaacccgtacccgttaacttacccggttaccggaacccgggaacgggtaaccgtacgggtaacggtaaccctacggaacttaaaacgggtcttacgggctaaccgtcctaactaccgttaacgttcgtcgtttacccg

SEQ ID NO: 234324 - DNA, 616 bp, Homo sapiens
  misc_feature: GYAE6OF01DC7YP.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatccctccctgtctgcatctgtgggagaccgagtcaccatcacttggccgggacaagtcaggtccgttaacacttaatttaattggtatacagaacaaaaccgagggacacgccctcacgctcctgactctctgctgcatccagtattgacaggtagtcggccgtcccagtccggtcggtttacgaggtcggcgtaggtcggtacgtcgtaggggactagttactttccctcccgtacacctacgtccgacgtctagtcctagaacctaaacgtgtaaggttactttgtaacccttaactttacttccgttacgtacaacgagaactacctaaccctaccctacccgactaccgttaccgtttccggaccggaacgggtaaccagggtacgactaaccgtaacgtaaaacggtacgttgggtacgtcctacgaccaccttagttccgttcgttaccc

SEQ ID NO: 234325 - DNA, 661 bp, Homo sapiens
  misc_feature: GYAE6OF01D9PHX.2.43.D10.1.454.CMB.1.raw
  modified_base (185)..(185): a, c, t, g, unknown or other
  misc_feature (185)..(185): n is a, c, g, or t
  modified_base (259)..(259): a, c, t, g, unknown or other
  misc_feature (259)..(259): n is a, c, g, or t
  modified_base (273)..(273): a, c, t, g, unknown or other
  misc_feature (273)..(273): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtggganaccgagtccaccatcacttgccgggcaagtcaggccttaacaccttatttaaattggtatcagacaaaaaccgnggggcacgcccctnagcctcctgatctctgctgcactccagtattgcagagtcggccgtcccagtccggcggttcaggtggcaggtggatcggtgggactagtactttcccgtccctacaaccctatccgaagtcctacggtccgtacgaccgtaaacgttgggtaacggttactttttcggaaccttaacgttttaccttacgtacggtaacaaacgtagtaaccgtacccttaacccgaacccttaccccgactaacccgtttaccgttttaccgggacccccggaaagggggtaacccgtaaggggttaccggtaacgttaacccgtaaacgtaaaacggtaccgttacgggtacggtaccctaggaccctaaccttagttcccgttcggtttaacccc

SEQ ID NO: 234326 - DNA, 807 bp, Homo sapiens
  misc_feature: GYAE6OF01DOEZY.2.43.D10.1.454.CMB.1.raw
  modified_base (233)..(233): a, c, t, g, unknown or other
  misc_feature (233)..(233): n is a, c, g, or t
  modified_base (292)..(292): a, c, t, g, unknown or other
  misc_feature (292)..(292): n is a, c, g, or t
tcagacgctcgacacacgaccggtgctcgatttagactagcagtaaggggagtctcaggcaggacacagcatggacatgagggtccccgctcagctccgtggggctcctgctactggtggctccggaggtgccagatgtgacatcgacatcgacccagtcctccatccctccctgtctgcattcgtgggtcgggacgaccgacgtccaacctatcctacgttcggaccggganaacgtcgacggtaccttaaactacgttaattttaaagtgtatacaagaacgaaaacggnggtaccacgccctacacgtcttcgtcgtactctctcgtcgctacctacgtccgaagtcgttacgacgtacgggtacggtccggtacccgtcctacggttccgggtacggttacgacgggtggtaacggtgggttacgggtacggttacggtaacgggtaaccgttacggtttaacccttttccccgtacccgttaaccaacccgttacggtaccacgttaccgttaacggttacctaccggttaaaacgtaacggtacgggttaaacggttttactttaccggaaccttttaaaccgtttaccgtttactaccgttaacgaaaccgtaggtaaccccttaaccttaacccgttaacccccgttaacccgtaccgttaaacccgtttaccggtttaccgggaaaccggttaacccggggtaacttaacgggtaccgtaacgttaacccgaaaaggtaaccgttaccggtcggttaacgcccgtaaggtaccctacgttcgttcgttacccgttacg

SEQ ID NO: 234327 - DNA, 673 bp, Homo sapiens
  misc_feature: GYAE6OF01CUMBM.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatccctccctgtctgcatctgtggggagaccgagtccaccatcacttggcccgggcaagtcacggtacccgttaaacaccttaattttaaagttggtaatcgaacgaacaaaaaaccgaggggacacggcccctcagcctcctgactctctcgctgcctactccctagtattgacgaggtaggtcggaccgtaccacgtccggtcggttacgaggtcggcgtaggtaggtactcggtaggggactaggttactttccgtcccctacacctacttaccgacgcgtagtctacgactaaacgttaggtaaggtttatttaccgtacttaaacgtttaccgttacctacgttaaccaacgtacgtaacgtaccttaacccgtaacccctaccccgtacctaaccgtttaccgtttccggaacccggtaacgggaacccgtaagggtacgtaacgtaacgtaaacgaaacggtaacgtcggtacgaccgtacggtaccacttacgtccgttgttaccc

SEQ ID NO: 234328 - DNA, 647 bp, Homo sapiens
  misc_feature: GYAE6OF01B5AB7.2.43.D10.1.454.CMB.1.raw
  modified_base (218)..(218): a, c, t, g, unknown or other
  misc_feature (218)..(218): n is a, c, g, or t
  modified_base (280)..(280): a, c, t, g, unknown or other
  misc_feature (280)..(280): n is a, c, g, or t
  modified_base (294)..(294): a, c, t, g, unknown or other
  misc_feature (294)..(294): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatccctcctgtctgcatcgtggtgggacgaccgagtcaccatcacgttcggcccggganaagtcgacggtaccgttaaacaccttaattttaaacttggtattaccgagaaccaaaacggngggacacgtccccnacgctcctagtatcctcgtgacgtgctactccgagtattcggacgtaggtacggtcgcgttcccaggttccggtcgttcgaggtggactaggtacggattcggaggactacggttctttacccgtaccctacaactcgttcacggtctaacgtcggttacaacgtaacgtggtaagtttcgtttagaaccttaacgtttcgttactacgtaacaagtacggtaactacctacccgtacctaccccgtactaccgtttaccgtcggtaacccggaacgggtacgtacggtacgtacctaacgtaaggaaaccgttgacggtcgacgtcgacctaacgtcttacggtcgttaccc

SEQ ID NO: 234329 - DNA, 821 bp, Homo sapiens
  misc_feature: GYAE6OF01A9FRP.2.43.D10.1.454.CMB.1.raw
  modified_base (290)..(290): a, c, t, g, unknown or other
  misc_feature (290)..(290): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatcgacccagtcctccatccctcctgtctgcagtcgtggtgggacaccgtagtaccaccatcgtacttcggccgggacaagtcgacggtaccgttaacacctttaagtttaaacgttggtatacgaacgtaacgtaaaaaccggngggaccgaccgcccctacacgtcctaccgtgtacttcctcgtcgtctcgcctactcgtagtacgttcgacgtaacggtcgggtcggtacctaccgtacgtaccggggtcggttacgtacgggttacggacgtacggttacggacgttaccggtacggtaacgttacggttacccgttttccccgtacccttaccgaaccttaacgtccgtaacggtacgttaaccggttactaccggtaaaccgtaaccggttagggtaaccggttaaccgtttttacggaaaccctttaaccgttttaccgttacgttaaccgtaaccgaaagtacggtaaccttaccctaacccgtaccccgtaacccgttaacgtttacccgttaacccggttaccggaacccccgggtaaacggggtaaaccttacggggttaaccggtacgttaaacccggtaaagttaaacccgggtaccggttagtaacccggttacgaacccggttaccctaccgttttactacccggtttcggttaaccccg

SEQ ID NO: 234330 - DNA, 764 bp, Homo sapiens
  misc_feature: GYAE6OF01B9927.2.43.D10.1.454.CMB.1.raw
  modified_base (91)..(91): a, c, t, g, unknown or other
  misc_feature (91)..(91): n is a, c, g, or t
  modified_base (132)..(132): a, c, t, g, unknown or other
  misc_feature (132)..(132): n is a, c, g, or t
  modified_base (142)..(142): a, c, t, g, unknown or other
  misc_feature (142)..(142): n is a, c, g, or t
  modified_base (202)..(202): a, c, t, g, unknown or other
  misc_feature (202)..(202): n is a, c, g, or t
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
  modified_base (319)..(319): a, c, t, g, unknown or other
  misc_feature (319)..(319): n is a, c, g, or t
tcagacgctcgacacacgaccggtgctcgatttagactagcagtaagggagtctcaggcaggacacagcatggacatggacgggtccccgntcagctccgtggggctcctgctacgtgtggctccggaggtnccagatggtnacatcgacagtcgacccagtcctccatcccgtcctgtctgctatcgtggagggacaccgntccacatcagtcggaccggganaagtcgaggtaccttaaaacnctttaaatttaaatcggtaatacgaacggaaccgaaaaacgggcgggaccacggtcccctgacgtcctccgtanactctcgtcgacgtcacacgtactagtattcggacgtagtcgggtcgtcccgtacctggtaccggtcggttacgaggttcggacgtaggtacggtacgtacggtaacggggtactacgtttaccctttaccgaccgttaccaaccggtactacgggtacctacggttaacttaccgaacgttaaaccgtaacggtagggttacggttaaccttacggtaacctttaacctttcgttaccgtacgtaacgaaaccgtacgtacctaacccttaaaccccgtaccccttaacccggtactttaaccgtttaaccgggttccccgggaaaccggggaacggttaacggtaccgggttaacgtaaaccgtttaacgaaacgggtaaaaccgttcgggtagggtcccacggttaaccacccgttaacctcgggttcctccggtttaaccc

SEQ ID NO: 234331 - DNA, 822 bp, Homo sapiens
  misc_feature: GYAE6OF01C1BXT.2.43.D10.1.454.CMB.1.raw
  modified_base (89)..(89): a, c, t, g, unknown or other
  misc_feature (89)..(89): n is a, c, g, or t
tcagacgctcgacacacgaccggtgctcgatttagactagcagtaaggggagtctcaggcaggacacagcatggacatgagggtccccnctcagctcctggggctcctgctactgtggctccgaggtgccagatgtgacatcgacatcgacccagtctccatccctccctgtctgctatcgtggtgggacgaccgagtccacctatcacgttcggccgggacaacggtcaacgggtaccctttaaacaacctttaaatttaaaagttggtaactacgaaacgaaccgaaaaaaccggacggggaccaaccggtcccctacgaacggtccttaccgtacggtacttccgtacgtcgtacttcgacctactacctaaggtacttcggacgtaggtacggtacggtacccgtacccgtaaggtccggtaccggttacgacgggttcggacgtaggtacggtaacgtcggtagggtaacgtacggttaacctttcccgtacccctacgtaacctacgtaccgacggtactacgttacgtacgtaaccgtaaacggtacggttaacggttatttaccggaacctttaaaccggttttacctacgttaacgtaacctaaacgtaaccggtataacccctaaccgttaaccccgtacccccgtataacccgtttaccggttaccggtaaacccccgggtaaggggtaacccgtaacggggttaccgtaaacggtttaaacccgaaaaggttaaaacccggttacggttcgggtaacgttacccgtacggtaaccctaaacccgttcgtttaccgtacgtttaaccccgg

SEQ ID NO: 234332 - DNA, 823 bp, Homo sapiens
  misc_feature: GYAE6OF01DSYJ7.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatcgacccagtcctccatccctccctgtctgcatcgtggtgggacgaccgtagtccacctatccgtaccgttcggacccgggtactaacgttccgaacgggttaccccgttaaactaacccgttaattttaaaacgttgggtacttaccgaacggtaaaccgaaaaaacccggcgggggtacccaaccggtcccccttacgaaccggtcccgttcccgtacggtacttcctcgtcgcgttacggacctacgtacccgtagttaacgttcggacgtaaggtacggtccggtaccgtacccgtacggtccggtacggttacgtacggtacggacgtaggtcggtacgttacggttacgggaaccttaggttaccgtttccctaccccgttacgtaaccctaagtacccgtaccggtaacttacggttaccgtacggtaaacctaaaacggttcggttaacggttttactttacgtaaaccgtttaaccttttaccggtacgttacgtacctaaaccggtagtaacctaaccgtaacccctacccgtacccgtaacttaccgttacccgtttaccggacccggtaacggggtaacgtacgggtacgtaaccgtaccgtaaacgaacggttacgaggttaccgaccgttacgaacccgtaacgttcttccgttcttaacccg

SEQ ID NO: 234333 - DNA, 825 bp, Homo sapiens
  misc_feature: GYAE6OF01D5VJG.2.43.D10.1.454.CMB.1.raw
  modified_base (204)..(204): a, c, t, g, unknown or other
  misc_feature (204)..(204): n is a, c, g, or t
  modified_base (763)..(763): a, c, t, g, unknown or other
  misc_feature (763)..(763): n is a, c, g, or t
  modified_base (803)..(803): a, c, t, g, unknown or other
  misc_feature (803)..(803): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatcgacccagtcctccactccctccctgtcctgctattcgtggtcggggacgaaaccgngtaccacctataccgtacgttcggccccgggataaacggtccgaacggtaccgtttaaacctaccgtttaaagttttaaacggtggtaactacgaacgaaaccgaaaaaacgggcggggaccaaccgtacccctagaacgtccgttaccgtagtacttcctacgtcgccttcgacctactaccgaagtcgtcgacgtaaggtacggtcgcccgtaacccgtcgtcggtaccggtagtaacggcggtacgtagggtacgtacgttcggtaacgggacttacgttacttttaccccgccctacgtaaccgtacgttaccgacggttaccgtaacgttcgtaaacgtaaaccgtaaacggttcggttaaccggtttacgttttaccgaaactttacccgtttttacgaccgttaacggttaaacccaacgtacggtaaaccttaaccccgtaccctaacccccgggtaccttaccctaacggttttacccgaccggacccggggtaaaggtaccggtacggaaacgttacccgttaaccgtaaaagtaacccggttaaccgngggttaacccgttaccgaccgggtaaccctaaccggtttnttccccgggttactttaccccg

SEQ ID NO: 234334 - DNA, 777 bp, Homo sapiens
  misc_feature: GYAE6OF01CJSTE.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatcgacccagtctccatccctccctgtctgcatcgtggtagggacgaccgagtccaccatcctacgttcggcccgggataaacggtccgaacgggtacccgtttaaaactacctttaaaagttttaaaagttcggtaattacccgaaggaaacccgaaaaaaacccggagggggaccctaaccggtaccccccttacgacgtccccttcccgtagtacttcccttccgtcggcttcgactaaccgtaccgaagtactttcgaccgtaaggtacgggtccggtcccgttacccgaggttacccgggtacggtttaccgaagggtccggacgtagggtacggtaacgtcggtaacggggtactaaggttacctttcccgtaccccgtacaaccgtacttaccgacgtacgtaacgttccgtaagtaaccaaacgttggtaacgtttcttttacgacctttaaccgtttcttactaggaacccttaaggacgtaaccaacctaccctaacccgttaccccgtactaacctttaccggttccggaaacccggtagggtaacccgtagggtacgtaaccttaacgaaagaaacgtcgtaggtacgtacgtacggacctaccttgttccctgttaccc

SEQ ID NO: 234335 - DNA, 613 bp, Homo sapiens
  misc_feature: GYAE6OF01C0N47.2.43.D10.1.454.CMB.1.raw
  modified_base (279)..(279): a, c, t, g, unknown or other
  misc_feature (279)..(279): n is a, c, g, or t
  modified_base (296)..(296): a, c, t, g, unknown or other
  misc_feature (296)..(296): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatcgacccagtctccatccctcctgtctgcatctggtgggacgaccgagtccaccatcacgttggcccgggacaaggtcgacggtaccgtttaaacaccttaatttaaattggtaatacagaacaaaaaaccgnggggacacggcccctanacgctcctgactctctcgctgcactccagtattgacagacgtcggccgtccagtccggtcggttcgaggttcggacgtaggtggtactcggtacgggactagttactttccctacccgtacaccgtactcacgactagtctacgaacgtaaagtggagtttactttgaccttaaacttcttacgtacgtaactaacgagaactaccttaaccgacccgtacccgactaccttaccgttcggacccggtaacgggtacctagggtcgactacgtaacgaaacggtcgtcggtcacgtcacctactacttgtcgttacc

SEQ ID NO: 234336 - DNA, 720 bp, Homo sapiens
  misc_feature: GYAE6OF01DAVRR.2.43.D10.1.454.CMB.1.raw
  modified_base (362)..(362): a, c, t, g, unknown or other
  misc_feature (362)..(362): n is a, c, g, or t
  modified_base (368)..(368): a, c, t, g, unknown or other
  misc_feature (368)..(368): n is a, c, g, or t
  modified_base (383)..(383): a, c, t, g, unknown or other
  misc_feature (383)..(383): n is a, c, g, or t
  modified_base (501)..(501): a, c, t, g, unknown or other
  misc_feature (501)..(501): n is a, c, g, or t
tcagacgctcgacacacgaccggtgctcgatttagactagcagtaaggggagtctcaggcaggacacagcatggacatggagggtccccgctcagctcctggggctcctgcctactggtggcctccggaggtcgccagagtgtacgactacgtaccgaacacgtccgaacccgtcgtccctacctaccttcccttcccgttgttctcgactacgttcggtgggtacggggaacgtaccggtacgtaccaacctacgtaccgtaccgtccgggccgacgtacgtacgaccggttaccttaacctactttaagttagtcgtacacgacgaaccaacgggcggccaccgtccatacgtctccgtntcttcnctcacgtcacgtacncggtagtcggactagcggttcgggccgtacccgtcgtacggtcggttacgtggtcggtcacggtgggactacggtacggtactacgtctttaccctaccctccgaacctagtaccgtntacgactacgttcgtacgtaaacgttaggtacgttaactttacgtacttaccgtttacttacgtacgtactaaccagtaccgtacccaactacccgtaccctacgtacccttacggttaccgaccgggtacgggtaaccgtacggttacggaactacggtacgtaaaggtcgtcgtacgtacgtacgtacctaccgtaagttccgtacgttccttaccg

SEQ ID NO: 234337 - DNA, 811 bp, Homo sapiens
  misc_feature: GYAE6OF01BGADB.2.43.D10.1.454.CMB.1.raw
tcagacgctcgacacacgaccggtgctcgatttagactagcagtaaggggagtctcaggcaggacacagcatggacatgacgggtccccgctcagctccgtggggctcctgctactgtggctaccgaggtcgccagatgtgacagtcgacatcgaccctagtcctcctactccctcctgtctcgctatcgtggtacggacgaccgtcgtccacctatcctacgtcggaccggtacaacgtcgacggtaccttaactaccgttaagtttaacgtgtactacgaacgaaccgaaaacgcgggtaccaccgtaccctactacgtacctccgtagtacgttaccgtctcgtccgtacgactaccgtcgtaacgtagtccgacgtacggtacggtaccgccgtaccgtacgtccggtacgtacgtacggtcggaccgttggtacggtacgttcggacggtaacgtacgttaccttcccgtacccgtacgtaccgtacgaccgtaccgtacgtacggttccgtaacgtaaccggtaacgtacgggtaacgtttcttaaccggtacttaacccgttcgtttacccgtacgtaacgtaaccgacgttaaccgtacgtaaccccgtacccgttacccgacttaacccggttacccggtttaccgaacccggggtaacggttaacccgggtaggttaaaccccgtacccgttaaaccgggttaaaccttaaacccgggttaccgttacggggttaacccgtacccgttaaccgggtacccttaaacccgttacgtttccccgggtttaaaccttaccccgg

SEQ ID NO: 234338 - DNA, 614 bp, Homo sapiens
  misc_feature: GYAE6OF01BAAOG.2.43.D10.1.454.CMB.1.raw
  modified_base (214)..(214): a, c, t, g, unknown or other
  misc_feature (214)..(214): n is a, c, g, or t
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
tcagacgctcgacacacgaccggtgctcgatttagactagcagtaaggggaggtctcaggcaggacacagcatggacatgagggtccccgctcagctcctggggctcctgctactgtggctccgaggtgccagatgtgacatcgacatgacccagtctccatccctccctgtctgcatctggtggagaccgagtccacatcacgttgccggganaacgtcacggtaccgttaacaccttaattttaagttcggtatacgaagtaccaaaaaccgnggggaccaaggcccctnacgctccgtgactctctgctgacactcgagtacttgacaggagtcggtccgtcccagtccggtcgttccaggtcggcgtaggtcggactcgtagggactagttactttcccgccctactaccgatacgacgcgtacgtctacgacgtaagtaggtagttagtttcgacttaaaccgtttacttacgttagtacaacgtagtacgtcctaccgtacccgtacccgactaccgtacgtttcgacccggtagggtaacctagggtacgacgtacgtaacgaaacggtacgtacgtcgcgtacgactaccacttcgtcgttacccg

SEQ ID NO: 234339 - DNA, 555 bp, Homo sapiens
  misc_feature: GYAE6OF01D7IY4.2.43.D10.1.454.CMB.1.raw
  modified_base (266)..(266): a, c, t, g, unknown or other
  misc_feature (266)..(266): n is a, c, g, or t
  modified_base (280)..(280): a, c, t, g, unknown or other
  misc_feature (280)..(280): n is a, c, g, or t
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtccaccatcacttcggccgggcaagtcaggtacccgttaacaccttaatttaaattggtatcagacaaaaaccgnggggacagcccctnagcctctgatctctgctgcactccagtattgcagagtcggccgtccagtcgtcggttcgaggtcgctaggtggactcgtagggactaggttactttccgtccctacacctataccagctagtctagactaacgtggagttatttcgactaactttcttcgtntacanagtacactaaccacctacccgactacctacgtttcgacccggtacgggacctagggtcgactacgtaagaaacgtcgtagtcgacgtcgaccacctctcgtgttaccc

SEQ ID NO: 234340 - DNA, 709 bp, Homo sapiens
  misc_feature: GYAE6OF01BNUKF.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcctgatgacccagtctccatccctccctgtctgctatctgtaggagacagacgtcaccatcacgttgccgggacaagtcagagctagttagacagtacttaatttaaagttggtatcagacaagaaaccgacggaaacgacccctaaatcctagtactactattcgtactactacgtagttgacgtaaacggtcgggtacctagtacgtagtcgagtgactaggtgatcgtaggactagtactttacacttccactacctatacgacgactacgtacgtacgtaccctaaaccgttagtaaacgtttatttacgaaccttaaaccgtttaacctacgttaacgtaacctaaacgtaacgttaaccggttaaccaacccggttaaccccccggtagggttaacccgggttaccggaaacccggtaaacggggtaaccggtaaacgggtaacggtaaaacgtaaacccggtaaaaccggtagttccgggttacggtaacgtaccggtaacccgtaacttaccggttaccgttacggtttaacccttcgttacccgttacccgttaccccg

SEQ ID NO: 234341 - DNA, 521 bp, Homo sapiens
  misc_feature: GYAE6OF01B0TV1.2.43.D10.1.454.CMB.1.raw
  modified_base (211)..(211): a, c, t, g, unknown or other
  misc_feature (211)..(211): n is a, c, g, or t
  modified_base (245)..(245): a, c, t, g, unknown or other
  misc_feature (245)..(245): n is a, c, g, or t
  modified_base (270)..(270): a, c, t, g, unknown or other
  misc_feature (270)..(270): n is a, c, g, or t
  modified_base (360)..(360): a, c, t, g, unknown or other
  misc_feature (360)..(360): n is a, c, g, or t
  modified_base (511)..(511): a, c, t, g, unknown or other
  misc_feature (511)..(511): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatccctccctgtctgcatctgtgggagaccgagtcaccatcacttgccgggnaagtcaggccgttaacacctatttaaatggtatnagacaaaaaccaggggcagcccctnacgctcctgatctctgctgcatccagattgcagagtggctcccatcgcgtcagtcggcagtggatcgtgggacagtactttcctcccgtnacctatccagctagtctagactaactgagtactttgctaacttacttctgtacaacagactctaactaccctacccgctaacctactttcgacccgtaacgggaccaagggtagactacgaacaaaaggtactgtagcgtacgacctaccntcgtgttccc

SEQ ID NO: 234342 - DNA, 632 bp, Homo sapiens
  misc_feature: GYAE6OF01AD1H1.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatccctccctgtctgcatctggtgggagaccgagtcaccatcacgttcggccgggacaagtcaggtacccgtttaacacctttaattttaaacgttggtaactcaacggacaaaaaaccgagggggcaacgcccctcacgtctccgtgactctcgttgcctgcacttccagtattgcgagtaggtcggcgtcccagttcgcggtttcaggtcggcgagtggtatcgtacggggacagttactttcctcccgtacaacctacgttcacgtctacgtcgtacgaactaaacgtgtaacggttatttacgtaccttaaactttcttctacgtactaacgacgaacgtactaaccaccttacccgctaacgttacctttaccggacccggtaacgggtaccctaaagggtagtaacgttcggaaactaaaacggtacgttagggcgtacgtcgactaacctgtccgttagtttaccc

SEQ ID NO: 234343 - DNA, 700 bp, Homo sapiens
  misc_feature: GYAE6OF01AKXS6.2.43.D10.1.454.CMB.1.raw
  modified_base (173)..(173): a, c, t, g, unknown or other
  misc_feature (173)..(173): n is a, c, g, or t
  modified_base (306)..(306): a, c, t, g, unknown or other
  misc_feature (306)..(306): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatcgacccagtctccatccctcctgtcngctatcgtggtgggacgaccgtagtccaccatactacgttcggccggacaacgtccgacggtaccttaactacctttaagtttaacgttggtactacgaacgaacctaaaaacggcgggacacccgtaccctnacgtcctaccgtagacttccgtactcgctcgactactaccgagtacgttcgacgtaagggtcggttccggtaccgtaccctacggtccgggtacggttacgacggttcggaccgtagggtgtacgtggtacggtactcgttaccgttccctacctaccgtacgtacgtacgacgtacgtacgttacgtaactaacgtaacgttcggttaacgttacgttttacgacccttaacgtttcttaccgtacgtaaccaagtacgtacacccttaaccgaccctaccgtacttccgttaacgttaccggaaccggaaggttaccgtacgtagtacgttaaccgtaacgtaacggtacgttcggacttacgtacaccttaactcttcgtaccgttacccg

SEQ ID NO: 234344 - DNA, 684 bp, Homo sapiens
  misc_feature: GYAE6OF01A6L1R.2.43.D10.1.454.CMB.1.raw
  modified_base (210)..(210): a, c, t, g, unknown or other
  misc_feature (210)..(210): n is a, c, g, or t
  modified_base (259)..(259): a, c, t, g, unknown or other
  misc_feature (259)..(259): n is a, c, g, or t
  modified_base (271)..(271): a, c, t, g, unknown or other
  misc_feature (271)..(271): n is a, c, g, or t
  modified_base (366)..(366): a, c, t, g, unknown or other
  misc_feature (366)..(366): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctggtgggagaccgagtccacatcacttgccggnaagtcaggccttaacaccttaatttaaattggtatcagacaaaaaccgngggcagcccctnacgctctgactctactgctagctatccagtattcgcgtagagtcggaccgtccagttcggtcggttcaaggtggcgagtggactcgtgggaaccnggttactttcctcccgttacaacctataccgacgtacgtacgttacgtcgaaccgtaacgtcggtaacggttagttttacgtaacgtaaccttttacgttacgttacgtactaaacgtacggaactaacccttaccgaaccccgttaacccccggtaccttaaccgtttaccggttttacccggaacccggtaacgggggttaacccgtaaacgggttaccggtaaacgtttaccgtaaaccggtaaaacggtaacccgttcggggttaccggaccgttacgtacccgtaaccctacgtttacccgttcgtttacccc

SEQ ID NO: 234345 - DNA, 799 bp, Homo sapiens
  misc_feature: GYAE6OF01C9T0I.2.43.D10.1.454.CMB.1.raw
tcagacgctcgacacacgaccggtgctcgatttagactagcagtaaggggagtctcaggcaggacacagcatggacatgagggtccccgctcagctccgtggggctcctgctactgtggctccgaggtgccagatgtgacatcgacatcgacccagtcctccattccctccctgtctgctatcgtggtgggacgaccggacgtaccaccactcgtacgttcggcccggggacaacggtcgaaccggggtaccgtttaaacctaaccgtttaaagtttttaaaagttacgggttaactaccgtaaacggaaaccgaaaaaacccgggagggggaccaaccggtcccctacgacgtccttcccgtagtacttccgtctcgtcttacgacctaacttacccgtaagttagttacggaccgtaagggtacggtcccggaccgttacccgtaaggttcccgggtacggtttacgaacgggttcggaacggttacgggtacgggtaacgtccgggttaacggggaacgtttaaccgttaaccgtttcccttacccgacgtaacctacgtacgacgtacgtacgtttacgacgtaactaacggtaggttaaggttactttcggaaacctttaacgttcctttacgacgtaaccaagaacgtactaccgttaacccacccgtaccccgtacttaaccgttaccgttaccggacccggttaaacgggaacggtacggttacgaacgttaaccgtaaaccggaaacggtgtaccgggtatacgaccaccagtacttacggtcgtttacc

SEQ ID NO: 234346 - DNA, 714 bp, Homo sapiens
  misc_feature: GYAE6OF01APXHX.2.43.D10.1.454.CMB.1.raw
  modified_base (609)..(609): a, c, t, g, unknown or other
  misc_feature (609)..(609): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatcgaccccagtcctccatccctcctgtctgcatcgtggtgggacgaccgagtccaccatcacttcggccgggctaaaggtccacgggtacccttaaaccacgttaattttaaagttgggtaactaccaacggaaccgaaaaaaccggacgggggtaccaaccggtaccccccttcgaacgccttacccgtaggtaaccttcctccgtgtaccgtccgactacctaccgaagtacttcggaccgtaaggtagggttcggcccggtttacccaggttcccggtacggttaccgaggtcgggccgtaaggtcggtactcggtacggggtacctagtactttcccgtccctacacccgtataccgacgtcgtacggttactcgtaacaacggttgtaacggttacttttcgaacctttacttaccttgtaacgttcaaactggaaccgtactaaccgccctaacccncttaccgtacgtttccggaccgtaacgggtacgtacggtactacgtaccgtaagtaactccggtaggtcgacgtacggaaccctactcttaccgtgttaaccccg

SEQ ID NO: 234347 - DNA, 698 bp, Homo sapiens
  misc_feature: GYAE6OF01AKPM8.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatcgacccagtctccatcctccctgtctgctatctggtgggagaccgagtccaccatcacttggccggacagtcaggaccgttaacaccttaatttaatggtatcagacaaaaccgagggcacgccctacacgcctcctgatctcgtgctcgcatccagtattcgacgacgtaggtcggtccgtcccgagttcccggtcggtttacgaagggtcgggacgtacggtagggtactcggtacggggaccgtacgttactttcccgtacccttaccaacccgtactaccgacgtcctacgttcgtacgtaacgtaaccgttaggtaacgttacgttttaccgaccttaaccgtttaccttacgtacgtaaccaacgtacgtaacgtacccttaacccgtacccgttaacccccgtacctaaccgttacccgttttaccggacccggtaaccggggtaaccgtaacgggtaccgtaacgttacccgtaaaccgaaaacggtacccgtacggttacgaccgttaccgaccctaacgttaccttccgttaccgttaccg

SEQ ID NO: 234348 - DNA, 700 bp, Homo sapiens
  misc_feature: GYAE6OF01A1VR4.2.43.D10.1.454.CMB.1.raw
  modified_base (293)..(293): a, c, t, g, unknown or other
  misc_feature (293)..(293): n is a, c, g, or t
  modified_base (313)..(313): a, c, t, g, unknown or other
  misc_feature (313)..(313): n is a, c, g, or t
tcagacgctcgacacacgaccggtgctcgatttagactagcagtaaggggagtctcaggcaggacacagcatggacatgagggtccccgctcagctcctggggctcctgctactgtgctccgaggtgccagatgtgacatcgacatcgacccagtctccatcctccctgtctgctatctggtgggacgaccgagtcaacctatccacgttcggccgggactaaacgtcgacggtaccgtttaaacaccgttaaatttaaacgttggtaacttccaacgtaaccaaaaaaccgnggggtaccaacgccccctanacgtcctccctagtactctctgcgtcgctactccgagtatgcgtagcgtcgtccgtaccctagtccgtcggttacgacgggtcggacgtaacggtggtaacgtcggttacggggtaacctacgttacgttttccccgtacccttacgaaccctagttaaccgacggtacctacggttcgtacgtaacttaacggtacggtaacggtacgttttacggaaccttaaccgtttacgtaccgtagtaccaacgagtacctacctaacccgtaccgtaccccgtctaccgttacgtttaccgccggtaacggtacccggaggtacggtactacggtaacaaacgttcgacgtacggacttacggactaaccggtcttcggttcgttaaccg

SEQ ID NO: 234349 - DNA, 616 bp, Homo sapiens
  misc_feature: GYAE6OF01AON0L.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatccctccctgtctgcatctgtgggagaccgagtccaccatccacttggccgggcaagtcacggtaccgttaacaccttaatttaaattggtatcagacaaaaaccgaggggcacgcccctcagcctcctgactctctgctgcatccagtattcgacgagtaggtcggccgtcccgagtccggtcggttcgaggtggcgtaggtggtatcggtagggactagttactttcctccctacacctatccgagtctagtctagactaacgtgtagttactttacgacttaacctttacttcgtacgtaccgtaacgacgtaacgtacctaccaccctaaccccgtctaaccgttaccgtttacggaccccggaagggtacccggtaagggtacgtacgttaaccgtaagtaaacggtacgttcggtacgtactacgacctaccgtacttcgttcgttaccc

SEQ ID NO: 234350 - DNA, 795 bp, Homo sapiens
  misc_feature: GYAE6OF01DSGWH.2.43.D10.1.454.CMB.1.raw
  modified_base (220)..(220): a, c, t, g, unknown or other
  misc_feature (220)..(220): n is a, c, g, or t
tcagacgctcgacacacgaccggtgctcgatttagactagcagtaaggggagtctcaggcaggacacagcatggacatgagggtccccgctcagctccgtggggctcctgctactgtggctccgaggtgccagatgtgacatcgacatcgacccagtcctccatccctcctgtactgcatctggtgggacaccgagtccaccatccacgttcggccgganaagtccgacggtaccgttaaactaccgttaaattttaaacgtggtaactacaacgtaaccgaaaaaaccggagggggacctaacggtaccccctacgtaacggtacctacccgtagtaacttcctaccgtagcctacgactactaccagtagttcgacaggtacgtcggtaccgttacccagtaccggtacggttaccgtaaggttcggaaccgtaggtacggtacgtaccggttaagggacctaaggttacctttccgtaacccccttcccgaaaccctattacccgaacggtcccgtaaggttccgttaacgaaccgttaaacgtagggttaacggtttaacgttttaggtaaaccctttaaacttttacgtttacgtaacgttaaccgaaacgtaacgtaaccggtaaccctaaccctaaccccgtaaaccccgtaccgttaacgttaacccgtttaccggaaccccggtaaaggggaacccgttaaacgggtacgtaacgtaaccgtaaagtaaaacggtaccgttacggtacggtaccgacgtacctaacgtacgtaccgttcttaaccg

SEQ ID NO: 234351 - DNA, 722 bp, Homo sapiens
  misc_feature: GYAE6OF01CC37Y.2.43.D10.1.454.CMB.1.raw
  modified_base (92)..(92): a, c, t, g, unknown or other
  misc_feature (92)..(92): n is a, c, g, or t
  modified_base (132)..(132): a, c, t, g, unknown or other
  misc_feature (132)..(132): n is a, c, g, or t
  modified_base (333)..(333): a, c, t, g, unknown or other
  misc_feature (333)..(333): n is a, c, g, or t
  modified_base (570)..(570): a, c, t, g, unknown or other
  misc_feature (570)..(570): n is a, c, g, or t
  modified_base (707)..(707): a, c, t, g, unknown or other
  misc_feature (707)..(707): n is a, c, g, or t
tcagacgctcgacacacgaccggtgctcgatttagactagcagtaaggggagtctcaggcaggacacagcatggacatggacgggtccccgntcagctccgtggggcctcctgctacgtgtgctcgaggtcnccagatgtgactatcgactacgtcgaccctagtcctcctactccctccctgtctgtctagttcgtggtacgggacgaaccgtacgtaccacctagtccgtacgttcgggccggactaacgttccgaaccggttaccgtttaaactactttaagtttaaacgttggactacgagaaccgaaaacggcggtacaccgtccctnacgtctcgtgtactcttacgcgtctcgtccacgttacgagttctcggacgtacggtcggtaccgtccctaccgttacggtccggttacgttcggaaggttggtaccggtagtacggtatacgggtcggtacttaaccggtttccttcccgtacctaccgtaccgtactacgacgtaccgttaactccgtaacgaacgtaacgttacgtacgtttataccgttacgtacttttccgtntaacggtactaacgacgtacctaacttaccctcccgtacctaccggttacccttacgggacccgtaacggtaaccggtaacgttacgggtactacgtaaacgtaacggtaacgtggtacgtagccgtaccgtaactntacgttgttcttacc

SEQ ID NO: 234352 - DNA, 833 bp, Homo sapiens
  misc_feature: GYAE6OF01E0M6J.2.43.D10.1.454.CMB.1.raw
  modified_base (90)..(90): a, c, t, g, unknown or other
  misc_feature (90)..(90): n is a, c, g, or t
  modified_base (315)..(315): a, c, t, g, unknown or other
  misc_feature (315)..(315): n is a, c, g, or t
tcagacgctcgacacacgaccggtgctcgatttagactagcagtaaggggagtctcaggcaggacacagcatggacatgagggtccccgntcagctcctggggctcctgctactgtggctccgaggtgccagatgtgacatcgacatacgacccagtctccatccctccctgtctgctatcgtggtgggacgaccgagtaccacctatcacgttcggccggacaacgtcacggtaccttactaccttatttaagtgtatcagaaccgaaaacgcgggacaccgaccctgacgtcctccgtagtacttcgtaccgnggtcctaggtacctacgtaccgtaagtacgttacgacgtaagggtcggttacccggtaccctacccgtacggttcccggttacggttacggtacggtcggtacggtagggttacggtacggtaccggtaacgggtaaccgttacgttttaccgtttacccctacccgtaaccggtaccttaacgtaccggtacgtaccgttacgttaccgtaaacggtaaaccgtaacggttagggtttaaacgttcccgttttaagaaaaccccttttaacgtttccgtttaaccgtaacgtaaccgtaaacgggtaaccgtcccttaaacccgttaaacccccgttaaccccgtacccccgtttaacggtttacccgttttaaccccggttaaccgggacccggggttaaacgggttaaccgttaaacgggtaactaacccggtaaacgtaaaccggtaaacggttcgtggttaacccggaccttaaccgacgttaaccccttggtttcccgttacgttaccccgg

SEQ ID NO: 234353 - DNA, 824 bp, Homo sapiens
  misc_feature: GYAE6OF01CH36T.2.43.D10.1.454.CMB.1.raw
  modified_base (130)..(130): a, c, t, g, unknown or other
  misc_feature (130)..(130): n is a, c, g, or t
  modified_base (160)..(160): a, c, t, g, unknown or other
  misc_feature (160)..(160): n is a, c, g, or t
  modified_base (174)..(174): a, c, t, g, unknown or other
  misc_feature (174)..(174): n is a, c, g, or t
  modified_base (305)..(305): a, c, t, g, unknown or other
  misc_feature (305)..(305): n is a, c, g, or t
  modified_base (340)..(340): a, c, t, g, unknown or other
  misc_feature (340)..(340): n is a, c, g, or t
tcagacgctcgacacacgaccggtgctcgatttagactagcagtaagggggagtctcaggcaggacacagcatggacatgacgggtccccgctcagctccgtggggctcctgctactgtgctccgaggtncagatgtgacatcgacatcgacccagtccncctactccctcctntctgctagtcgtggagggacaccgatccaacctataccgtacgttcggaccgggataagtccgacggtaccgttaaactaccgtttaagtttaaagttcggtaataccgaacgaaaccgtaaaaacccggnggggacctacccgtcccctacgacgtacctccgtntacttcgtcgtctctcgctacgcgtagtcgtcgacgaggtacggtcgtacccgtaccgtacgtccgggttcgtacggaggtcggtacgtggtacggtacgtacggtagggtaccgttacgttaccctttccccgtaccctaaccgtactacgtaccacggttacgacgtttactacccggtaaacctagttacgggtaacggttttacttacggtaaccttttaaacggttcctttaagtaacggtaaccctaacgtacttacccgttaccgttaacccctaaaccccgttcccgtaactttaccccggtttaacggttccccgggtaaacgggtaacccgggtaaacggttaccgggtaaccggtttaccttaaaaccccgggtaaaaaccgggtttaaacccttcgggtaccgggttaacccggtacccgttaccgggaacccctttaaccggccccgtttttccgtaccgttttaaccccg

SEQ ID NO: 234354 - DNA, 922 bp, Homo sapiens
  misc_feature: GYAE6OF01CU7UD.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatcgacccagtctccatccctcctgtctgctatcgtggtgggacaccgagtccacctatccacgttcggccgggtactaacggtccaacgggtaccctttaaactaccgtttaaattttaaacgttgggtaacttactaacggtaaacctaaaaaaacccggtacggggggaccctaaaccggtacccccccgtttaacgaacggttaccccgttaccccgttacgggtaaaccttacccgttttcccgttacggtaacccgtttccgggtaaccttaaaccgttaccccgtaaaggtttaaacgttttccgggaacgtaacggggtaacggttccggggtaacccccgtttacccgtaacgggtttcccggtaccgggttttaaccgtaacgggttcggggtaccgttaacgggttcggttaacggttaccggttacggggtaaccgtacggtttactttaccccgttacccgtaccaccgtaacgtcgacgtacgtacgtacgtagtaacgtaactaggtaggttactttacggaaccttaacgttcctttacgttacgtacctaaacgtacgtaaccgtaccttaaacccgtaacccgttacccgttaaccttaacccgtttaccggttttaccggaaccccgggttaacgggtaaccggtaaacgggttacggtaaaccgttaaccggttaaaccgaaacggttaaccggtacgggtttaccgaacgttacccgaacccgttaccgtaacgtttcccggtttacttaacccgg

SEQ ID NO: 234355 - DNA, 713 bp, Homo sapiens
  misc_feature: GYAE6OF01BWC8Q.2.43.D10.1.454.CMB.1.raw
  modified_base (270)..(270): a, c, t, g, unknown or other
  misc_feature (270)..(270): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctcctgtctgctatctggtgggagaccgagtcaccatcacgttcggccgggcaagtcgacggtaccgttaaccaccttaatttaaagttggtatcagacaaaaaccgnggggaccacgccctacacgcctcctgacttctctgctcgctactccgatacgttcgacaggtggtacggccgtccacgtccgggtcggttacgacggtcggaccgtagggtcggtacgttaccggtaggggtaaccgtaggttacttttccctaccccgttacctaaccctagtaccgaacgtacgtacggttacctacggtaacctaaacgttaggtaacgttacgttttacgtaaccttaaaccgttttacttaccgttacgtaaccaacgtacgtaaccgtacccttaacccgtaacccgtaacccccgtataacccctttacggtttacccgacccgggtaacgggaaccctaagggtacttaacgtaaccgtaaacgaaaacggttcgtacggtacggtaccgtacggaccctaaccctacgttccgtttacgttccc

SEQ ID NO: 234356 - DNA, 801 bp, Homo sapiens
  misc_feature: GYAE6OF01CF9KF.2.43.D10.1.454.CMB.1.raw
  modified_base (129)..(129): a, c, t, g, unknown or other
  misc_feature (129)..(129): n is a, c, g, or t
  modified_base (616)..(616): a, c, t, g, unknown or other
  misc_feature (616)..(616): n is a, c, g, or t
tcagacgctcgacacacgaccggtgctcgatttagactagcagtaaggggagtctcaggcaggacacagcatggacatgagggtccccgctcagctccgtggggctcctgctactgtggctccgaggtncagatgtgacatcgacatcgaccctagtcctcctactccctccgtgtctgactactcgtggtgggacgtaaccgtagtaccacctactccgtacggttcggacccgggaactaacggtaccgaaccgggttaacccgtttaaaccgttaaccttttaaaagttttaaaggttacggtaactaccggaaaaccggaaaacccgaaaaaccggggcggggacccaacccggtccccctaaggtcccgtacctttcacgtaccttcgtcgtcgaccgtcgaactaccgtacgaagtttcgtacgaacgtgggtcggtacccgtccgttaccgtacgggttaccggtacggttacgaaggggtcgtaacggtcgggtaacggcttacggggtacgtacgttacgttacctttcccgacccacgtatacgaacgtcgtacgtacgtcgtacgaacgtacggttacgtagttacctagttaccttaaacgttntttaccgacgtaaccgtagaccgtaacctaaccgttacccgaaccccgttacgtaacccgttacggttacccggaccggtaaaccgggtacgtaccgttaaaggtacgtaaccgttaaccggtaaacggtcgtacggtaccgtcggttacaaccgttaccgtagttacccttaggtcccgttacc

SEQ ID NO: 234357 - DNA, 658 bp, Homo sapiens
  misc_feature: GYAE6OF01BGGKD.2.43.D10.1.454.CMB.1.raw
  modified_base (288)..(288): a, c, t, g, unknown or other
  misc_feature (288)..(288): n is a, c, g, or t
  modified_base (302)..(302): a, c, t, g, unknown or other
  misc_feature (302)..(302): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatcgacccagtctccatccctcctgtctgctatctggtgggacgaccgagtcacctatcctacgttcggccgggtacaagtccgacggtaccgttaaacacctttaagtttaaagttcggtatacgaagaaccaaaaaccggnggggacacgccctnacgtcctccgtgtacttctcgtacgctacgctactccgaagtctcgacgacgtacggtcggacctaccgtagtccggtcggttacgaggtcggtactaggtacggtacttacggtacgggtactacgttaccgttaccctcccgtacaactactacgtacgtactacgtactacgaaccgtaacgtagtacgttagttacgtaaccttacttacgttctacgtactaacgactacgtacctacctacccgtaccgtactacttacgttaccgaccggaacggtacgtaaaacggtcgaacgtacgtaacgaacggtacgacggtacgacgtacgtactactacttcgtcgttaccg

SEQ ID NO: 234358 - DNA, 676 bp, Homo sapiens
  misc_feature: GYAE6OF01AZF7B.2.43.D10.1.454.CMB.1.raw
  modified_base (268)..(268): a, c, t, g, unknown or other
  misc_feature (268)..(268): n is a, c, g, or t
  modified_base (322)..(322): a, c, t, g, unknown or other
  misc_feature (322)..(322): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatccctccctgtctgcatctggtgggagaccgagtcaccatcacttcggccgggcaagtcacggaccgttaaacaccttaatttaaattggtatcagaacaaaaaccgngggacacgcccctgacgtcctcctgactctcgtgctcgctactccagtattcgnaggacggtcggtccgtcccgagtccggtcggttcgaggtcgggactagggtggtacgtcggtaggggacctagttaccttttcccacccctacacctacgtccgaacgtctacgtctacgtaaccgtaaacgtggttaacgttcgttttacgaaccgttaactttaccgttacgttcgtaacaaacgtacgcgtaaccctaacctaccccgttaaccccgtccttaaccgttaccgtttacccggacccgggtaacgggtacccgtaagggttaccgtaacgtacccgtaaagtaaaaccggtcggtacggtacgccgttacgacccgtaacttccgttacgttcgttaacccc

SEQ ID NO: 234359 - DNA, 885 bp, Homo sapiens
  misc_feature: GYAE6OF01B4R5N.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatcgacccagtctccatccctcctgtctgcatcgtggtgggacaccgagtccacctatcctacgttcggcccgggactaaacggttcaacggggtacccgtttaaaacctacccgtttaaagttttaaaacgtttcgggtaacttaccgaaacggtaaaccgaaaaaaaacccggtagggggggtacccaaccggtaccccccgttacgaacggttacccttaccccgttaggtaacgttccttaccgttacggtccgttaccggacctaaccttaccccgtaaggttaaacgttttcgggacctaagggtaaccgggttccggaccccgtttaccccgaaggttccggggttaccggtttaccgaagggtttccgggaccgtagggtaccggtacgttcggtagggtactacgttacgtttaccctaccccgtacaacccgttataccggaacgtaccgtaacgttccgtaacggtaacctaaacgttcgggtaacgggtttacttttaccggaaccttaaacgttttacccttacggtacgttaaccaaacggtaccgaacgttacccctaaaccgtacccgttaaccccggtaacttacccgttaaccgtttccggaacccgggtaacgggtaaccgtaagggtacgtaaccgttaacgttaaaccggtaaaacgtaccggttcggtaccggtacgttaccggaaccctaaaccgttcttaccggttactttacccg

SEQ ID NO: 234360 - DNA, 770 bp, Homo sapiens
  misc_feature: GYAE6OF01AUUR1.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatcgaccagtctacctactccctccctgtctgctatcgtggtacgggacgaccgacgtaccacctataccgtacgttcggccgggataacgtcgacgggtaccctttaactaaccgtttaatttaaacgttaggtactacaacgaaaccgaaaaaccggaggggaccaccgtccctacacgtcctaccgtagtaccttctcgtacgtacgtcgtccacgtacgtagttagttcgaacgtaggtacggtacggtaccctaccgtacgtcgggtacgttacgtacggttacggacgtagtcggtacggtccggtaacggtaacgttacgttaccgttttacccctaccgtaaccgtaacctagtaccgtagaccgtacggttctaacccgtaacgtaaacgttggtaacgtttactttacgaaactttacccgtttacgttacgtacggtaactaacgtaaccggttacaccctttaacccgacccgttaaaccccgtacttaaacccggtttacgttacccggacccggggtaaacgggttaaccgaaacgggttacctaacctacgtaaaacgtaccgtaagttcgacttccgtaaacctcgtaaaccctgttccgttaatcccg

SEQ ID NO: 234361 - DNA, 832 bp, Homo sapiens
  misc_feature: GYAE6OF01C89J8.2.43.D10.1.454.CMB.1.raw
  modified_base (90)..(90): a, c, t, g, unknown or other
  misc_feature (90)..(90): n is a, c, g, or t
  modified_base (299)..(299): a, c, t, g, unknown or other
  misc_feature (299)..(299): n is a, c, g, or t
tcagacgctcgacacacgaccggtgctcgatttagactagcagtaaggggagtctcaggcaggacacagcatggacatgagggtccccgntcagctcctggggctcctgctactgtggctccgaggtgccagatgtgacatcgacatcgacccagtctccatcctcctgtctgctatctggtgggacaccgagtccacctatctacgttcggccgggactaaggtccgacgggtacccttaaacctaccgtttaattttaaagttcggtaactaccgaacgaaaccgtaaaaaaccggnggggtacccaccggtacccccttagaacggtccttccgtaggacttccgttaccgtcgtaccgtcgtaccaacgtccgaagtcgttcgacgtacggtacgggtccgtacccgttacccgacggttccggtcggtttacgaagggttcggaccgtaagggttcggaccggtacggtacggggaccttaaggtacccttttcccgtacccctacgtacctacgtaccgacggtaccgttaacgtaccgtaacgtaacgtaacggttaggtacggtttacttttacggaaccctttaaacctttcgtttaacgttacggtaaaccaaacgtacggtaaccttacccgttaaaccccttacccggttaacccccgcgtttaaacccggttttacccggtttccgggaacccggggtaaaaccggggttaccctaaacgggggttccgtaaaaccgtttaaccggaaaacggttaaaaccgtcggttacgggtacgtacctcgtaaacccgtacgttaacgttccgttacggttaccc

SEQ ID NO: 234362 - DNA, 812 bp, Homo sapiens
  misc_feature: GYAE6OF01AP152.2.43.D10.1.454.CMB.1.raw
  modified_base (400)..(400): a, c, t, g, unknown or other
  misc_feature (400)..(400): n is a, c, g, or t
tcagacgctcgacacacgaccggtgctcgatttagactagcagtaaggggagtctcaggcaggacacagcatggacatggagggtccccgctcagctccgtggggctcctgctactgtggctccgaggtgccagatgtgacatcgacatcgacccagtcctccactccctccctgtctgctactcgtggtcgggagaccgagtccaccgtatctacgttcggcccgggacaaacggtcggaaccggtacccgttaaactaaccctttaaagttttaaacgttggtaacgttaccaaacgtaacgaaaaaaccggacgggggacaacgtccccctacgacgtccttaccgtcgtactaccgttcgtacgtcgtacggacctaacgtccctaaaggggtttnttacgggaacctaagggtaacgggtcggtaacccccggttccgacggttccccggggtcggtttaacggacggttacgggtacggtaagggttacgggaccgttaccgggtacggggaactaacggtttacctttacccgtcccccgttaacactacgtaacctacggaccgtagttaccgtacgtaaccttaacggtaggtaaacggtttacgtttccgtaacgtttaaacccgttacgttaccgtaacgtaccgtaaacgtacggtaacgtaaccctaacccgtaccccgtaacccgtacctaaccgttacggttaccccgggaaccggttacggaccgggtaagtaacgtacctacgtaacgtaaaggtacctcggtagaccgtacgacctaactccgttgtcgttacc

SEQ ID NO: 234363 - DNA, 865 bp, Homo sapiens
  misc_feature: GYAE6OF01B74CP.2.43.D10.1.454.CMB.1.raw
tcagacgctcgacacacgaccggtgctcgatttagactagcagtaaggggagtctcaggcaggacacagcatggacatgaggtccccgctcagctcctggggctcctgctactgtggctccgaggtgccagatgtgacatcgacatgacccagtctccatccctcctgtctgctatcgtgtggacaccgagtccacatcacgttcggccgggacaagtcgacggtaccgttaaacaccttaaagtttaattcgggtactactaagaacaaaaaaccgtcggggacaacgccccttagaacgccttccgtagtactcttcgtgcgtacgctactccgaagtattgacgaggtagtcggcctaccgtagttccggtcgttcgaggtcggactaggtgtacgtcgtacggggactacgttacttttccctacccttaccgtaaccctatacccgtaaagtccgtaacgttacgtaaccgtaaaccgtaaacggttacgttaacgggtttaccttttaacggtaaccccgtttaaaccttttaccgtttaccggttaacgtttaaacccgaaaccgttaaaggtaccccgttaaccgttaaacccccgtaaccccccgttaaccccggtaaaccctttaaccccgttttacccggggtttttaaccccccggaacccccgggggtaaacggggttaaaacccgggttaacgggttaacccgggtttaaaccctaaaccgggtttaaaaacccgtaaaaaacccggggtttaaccgttaaccgggggttaaccccgttccggttaaaacccggtaccccgttaaaacccgttttcgttaaaccccggttttaccggttttaaaccccccg

SEQ ID NO: 234364 - DNA, 755 bp, Homo sapiens
  misc_feature: GYAE6OF01DFXKJ.2.43.D10.1.454.CMB.1.raw
  modified_base (118)..(118): a, c, t, g, unknown or other
  misc_feature (118)..(118): n is a, c, g, or t
  modified_base (130)..(130): a, c, t, g, unknown or other
  misc_feature (130)..(130): n is a, c, g, or t
  modified_base (135)..(135): a, c, t, g, unknown or other
  misc_feature (135)..(135): n is a, c, g, or t
  modified_base (366)..(366): a, c, t, g, unknown or other
  misc_feature (366)..(366): n is a, c, g, or t
  modified_base (679)..(679): a, c, t, g, unknown or other
  misc_feature (679)..(679): n is a, c, g, or t
  modified_base (745)..(745): a, c, t, g, unknown or other
  misc_feature (745)..(745): n is a, c, g, or t
tcagacgctcgacacacgaccggtgctcgatttagactagcagtaaggggagtctcaggcaggacacagcatggacatgagggtcccccgctcagctccgtggggctcctgctactgngctccgaggtcnccagntgtgacactcgacatcgaccctatcctcctactcccttcctgtctcgacctattccgtggtagggaaccggaccgtacgtaccaacgtcgtaccgtaaccggttccgggaccggaactaacggtacccgaaccgggtttaaccccttaaaccttaaacgtttaaattttaacggtttgtaactaactaacggaaacccgaaaaacggaccggggacctaccgtccccgtanaccgtccctaccgtatactccttcgtacggtctcgaccttacgccgtaagttccgttagaacgttggaacggtcgaaccgtccgtacggttccggtcgtacggtcggtcggtacgtaggtcgtacggtccggtaggtaccgtacttaccttcccgtacctaccacgtcgtacgctacgtacgttacgtaacaacgttaacgtacgttagttacctacgtactttaccgtacttacgttacgaactacgacgaacctacggtaaccccacttaacccgtctaaccgtttcccgtaacggacggtaaccccgggntaacgggttataccgtaaacgtaacgggaaacttcgtacggtccgtacaccttacacttccggttnttcgttaccc

SEQ ID NO: 234365 - DNA, 704 bp, Homo sapiens
  misc_feature: GYAE6OF01EAEZU.2.43.D10.1.454.CMB.1.raw
  modified_base (90)..(90): a, c, t, g, unknown or other
  misc_feature (90)..(90): n is a, c, g, or t
tcagacgctcgacacacgaccggtgctcgatttagactagcagtaaggggagtctcaggcaggacacagcatggacatgagggtccccgntcagctcctggggctcctgctactgtggctccgaggtgccagatgtgacatcgacatgacccagtctccatcctccctgtctgcattctggtgggataccgagtccaccatctacttcggcccgggacaagtcgacggtacccgtttaacaccgtttaattttaaatcgggttactacaaggtaaccaaaaaccggagggggtacccaaccggtccccctacgacggtcccttaccgtacggtaccttcgtcgtgccgttcgactacgtacccgtaggtacttcgacgtaaggtcggtcggtccgtacccacgtcggtacgttcgaggtcggactaggtacggtagttccggaggaactcggttactttcccgtccccttaccaccgtacgtaccgacgtccgagttcgtacgaacctaacggtacggtacgtttattttccggaccgttaacctttcgttcgtataccgaactagaccgtctaacctcccgtacccgtactaccgttacgttccggacccggtaacggtaccgtagggtcgtacgtacgtaaaccggaagttaaccgtcgtaacggccgttaccgaccttaacggtccttcgggtacttcccg

SEQ ID NO: 234366 - DNA, 777 bp, Homo sapiens
  misc_feature: GYAE6OF01DRE1M.2.43.D10.1.454.CMB.1.raw
  modified_base (91)..(91): a, c, t, g, unknown or other
  misc_feature (91)..(91): n is a, c, g, or t
  modified_base (129)..(129): a, c, t, g, unknown or other
  misc_feature (129)..(129): n is a, c, g, or t
  modified_base (649)..(649): a, c, t, g, unknown or other
  misc_feature (649)..(649): n is a, c, g, or t
tcagacgctcgacacacgaccggtgctcgatttagactagcagtaaggggagtctcaggcaggacacagcatggacatggagggtccccgntcagctcctggggctcctgctactgtggctccgaggtnccagatgtgacatcgacatcgacccagtcctccatccctcctgtctgactatcgtggtacgggacgaccgtacgtacctaacctagtcctaacgttcggacccgggtactaacggtccgtaacggtaaccccgtttaaacctaaccgtttaaatttttaaacggttggtaacttaccaaacggtaaaaccgaaaaaccggacggggtacccaacccggtcccctacgacgtccttaccgtagtaccttctccgtagcgtaccaccgtacttaccgagtacgttcggactagggtacggtccggtaccccttaccgtaggttccccgggttacggttacggtacgggtacggtacgtttagggacggttaccgtacggtacgggtaaacccttaccgtttaacccgtttccctacccctaccgtaaccgtatacccgtacggtacgttacttacgagtaaccgttaagtcggtttaagttccgtttaccaaaccttacttttgacctagtaaccgtaaacncgtaccttaacccggacctacccccgttactaccgttacgtttaaccgtcggaaccgggtacggtaagtacgtataccgtaacggaataccggtgcgaccgtcacgtctaaccttggtcttccgttac

SEQ ID NO: 234367 - DNA, 793 bp, Homo sapiens
  misc_feature: GYAE6OF01DUV04.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatcgaccagtctccactcctcctgtctgctatcgtggtgggacgaccgagtaccacctatcctacgttcggccggacaacggtcacggtaccttaactacttaatttaagtgtaatacgacgaaccaaaaccggacgggccaccgtccctacgacgtcctccgtagtacttctcgtcgtccgtcgacctaacgtacctaagtcgttacgaacggtaaggtcgggtaccggtacccgttacccggtaacgttccggttacgggtttaccggacgggtttacgggaacccggtaaggggtttacggttaaccggttaccggggtacggtaaccgttaacgttttacccgttttaccccgttaaccctaccgtaaccctacgttacgacggtaaccgtaccgtacggttaaccgtaacgtaaacggtagttacgggtttatttacgtaaacccttactttacgtaccgttaacgtaacaacgtaccgtacgaacccttacccgtaaccccgttaccgacccgtttaaccgttccgggtttaccggaccgggtaaaacgggtaccgtaacggtacgtaacgtttaaccgaaacggttaacgttaacgtcggtagttacccgtaacgtacctacgtcttccgtctttaacccg

SEQ ID NO: 234368 - DNA, 825 bp, Homo sapiens
  misc_feature: GYAE6OF01A7YK8.2.43.D10.1.454.CMB.1.raw
  modified_base (365)..(365): a, c, t, g, unknown or other
  misc_feature (365)..(365): n is a, c, g, or t
tcagacgctcgacacacgaccggtgctcgatttagactagcagtaaggggagtctcaggcaggacacagcatggacatgagggtccccgctcagctccgtggggctcctgctactgtcggctccggaggtgccagatgtgaacatacgacatacgaccctagtcctccactccctcctgtctgctatcgtggtacgggacgaccgtagtaccaccgtactccgtacgttccggaccgggacctaacggtaccgtaaccgggtacccgttaaacctaccgtttaaattttaaacgttaggtaactaccgaaccgaaaccgtaaaaaccgggcggggccaaccggtcccctacgacgtacctcgtanacctctacgtcgctcgactacgtacgtagtcgttacggagaggtacggtccggtaccctccggtacgtccggggtccgttaacggcgggtacggtagtagggtacggtggttacgggaccggtactacgtttaccctttacctacccccgaactaacgttaccgacgtacgtaccgttacgtaactacgtaacctaacgggttaggttaaccggttactttaacgtaaacccgtttaaccttttacgttacccgttaacggtaacctaacgtaacgttccgtaaaccccttaacccgttacccccgtaccgtacccgtttaacccgttacgggttaccccggaacccgggttaaggaacccgggtaggttaacgaccggttaaacgtaaaaccgggagttaaacccggtcggttaaccgtactaacccgaacctaccttacgttaccggttcccttaccc

SEQ ID NO: 234369 - DNA, 815 bp, Homo sapiens
  misc_feature: GYAE6OF01DH20V.2.43.D10.1.454.CMB.1.raw
  modified_base (314)..(314): a, c, t, g, unknown or other
  misc_feature (314)..(314): n is a, c, g, or t
tcagacgctcgacacacgaccggtgctcgatttagactagcagtaaggggagtctcaggcaggacacagcatggacatgacgggtccccgctcagctccgtgggggcctcctgctactggtcggccgtccggagggtcgccagatgagacatcgacatcgaccacgtcctccactccctcctgtcctgactattcgtggtacgggacgaccggctaccacactaccgtacgttcggccgggactacggacgtaccggtaaccttaacctactttaaagtttaacgtagtactacgaaacgaaaccaaaacgggnggaccaccggtccccatacgcctctagcttcctgtcgtctacaccgtactaccgtaggtatccgaacggacgggttccggttccgaccccggttacccgtacggtttcggtaccgggtttacggacgggtcggacggttagggttaccgcggttaacgggacggttaacttacccttaccgttccccacgttaaccgacctaagttccgacgttagacttaccgaacgtaaacgttaagtcgtttaaaggttctttaaccgtaactttaccgtttactccgggttaactaaacggtaacctacggtaaaccccgttaccgtaaacccccttaccccgtaaaccccgtacctttaaacccgggtttaccggaccccgggtaaacccggggaacggggttaaacccgtaggttaaccccgtaaacggtacctaaaacgggggaacgttaccgtcgggtactacccgtacgtaccttacggttctttcggttaaccttaccccg

SEQ ID NO: 234370 - DNA, 796 bp, Homo sapiens
  misc_feature: GYAE6OF01AZVR8.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatcgacccagtctccatcctccctgtctgcatcgtggtgggacgaccgagtccaccatccacgttcgggccgggacaacggtcgacggtacccgtttaaacctaacctttaagttttaaagttggtaactaccgaacgaaaccgaaaaaaccggacgggggaccgaaccggtccccctacgacggtaccttcccgttagtaacttcccgttcgtcgtccgttccgacctaccgtaccgtaagttaacttcggacgtaacgggtacggttcggtacccgtaccctacggtccggttaccggttacgacggtcggtgtaagggtcggtagtccggtagggtactacgtttacctttcccgtaccctacaacccgtactacacggtacctacggtcctaacggtaacctaacgggtggttaacggttttaacgtttaccgtactttaaaccggttttccttaccgttagtaaccaacggtcgtaactaccctaacccgtaacccacccgttacctacgtttaccggttacgaccccggggtaaagggtaacgtacggtaccggtaaacgtaccgttaaaggaaaacggttcggttacgggtaccggttactaacccggttacttaaaaccgtgtttacccgtccgtttaacccg

SEQ ID NO: 234371 - DNA, 745 bp, Homo sapiens
  misc_feature: GYAE6OF01AEOXW.2.43.D10.1.454.CMB.1.raw
  modified_base (208)..(208): a, c, t, g, unknown or other
  misc_feature (208)..(208): n is a, c, g, or t
  modified_base (316)..(316): a, c, t, g, unknown or other
  misc_feature (316)..(316): n is a, c, g, or t
  modified_base (456)..(456): a, c, t, g, unknown or other
  misc_feature (456)..(456): n is a, c, g, or t
  modified_base (734)..(734): a, c, t, g, unknown or other
  misc_feature (734)..(734): n is a, c, g, or t
tcagacgctcgacacacgaccggtgctcgatttagactagcagtaaggggagtctcaggcaggacacagcatggacatgagggtccccgctcagctccgtggggctcctgctactgtggctccgaggtgccagatgtgacatcgacatcgacccagtcctcactccctccctgtctgacagtctggtcgggacgaccgagtccaaccnctactaccgttcggaccggacaacggtccgtaacggtacccttaacgtaacctttaacgttttaaaacgttcggtaacttaaccgacggtaaaccgtaaaaaccgggnggggtaccaacccggtcccctagtaacccgtccgttaccgtaggtacctttcgtaccgttcggaccttccgaccgtactccgaagtcgttacgcggtaacggtcggtcgtcccgtacgtcgtaccgggtcgttaaccggngtacggtccgaggtcggtacgtacggtacggtaaccgttacgttaaccttccctacccctaacgacctacgtaccgacggtactacgttcgtaacggtaactaacggtcgtagttccttacggtacttaaccgtttgtaaccgttcgaaacttaacgaaccgttcctaaaccgttaccgacccctttaccggaccttaacccggttacgtaccggtaaccggtacggacgtacgtactcgtaacctaagtaacggtgtaacgacgtcgtactaccgtnacttcgtgtcc

SEQ ID NO: 234372 - DNA, 743 bp, Homo sapiens
  misc_feature: GYAE6OF01AGF8D.2.43.D10.1.454.CMB.1.raw
tcagacgctcgacacacgaccggtgctcgatttagactagcagtaaggggagtctcaggcaggacacagcatggacatgagggtccccgctcagctccgtggggctcctgctactggtggctccggaggtgccagatggtagacagtcgacagtccggacccctagttcctccacttccctcccgtggtcctagctacgtccgttgggacggggacgaccgagttaccacctatccgtacgttcgggcccggactaacggtccgacgggtacccgttaacctaacctttaagttttaaacgtgggtactacgagaaaccgaaaacggtcggggaccacgtccccagacgtcctaccgtagacttccgtcgtcgacctcgactacctacgtacgtacgtacgacgtacgagggttccgaccgttaccgcggttaccgggtcggttacgtacggtacgggtctaggtcggtacgttcggtacggtagttaccgttacctttaccctacccgactaaccgctacgaccgtacggtcgtacgtacgtaacggtaagttacgtacgttagttacctaccggttacctttcgaccgtaaggtacaaaccgtgtaccggtaaccctaccgtacccgttacctaccggttacttacccgttaccggacccggttaaggtacgtacggtacggtactaacgtaaacctaggtacgttacgctctaacctccgaagtccgttcgttcctaccc

SEQ ID NO: 234373 - DNA, 488 bp, Homo sapiens
  misc_feature: GYAE6OF02GB1JN.2.43.D10.1.454.CMB.1.raw
tcagacgctcgacacacgaccggtgctcgatttagactagcagtaagggagtctcaggcaggacacagcatggacatgagggtccccgctcagctcctggggctcctgctactgtggctccgaggtgccagatgtgacatcgacatgacccagtctccatcctcctgtctgcatctgtgggagaccgagtcaccatcacttgccgggcaagtcaggccgttaacaccttaatttaaattggtatcagacaaaaaccgaggggcacgcccctcagctcctgatctctgctgcatccagattgcagagtggcgtccatcgcgttcagtgcagtggatcgtgggacagtatttcctccctcaccatcagcagtctgacaaactgagtatttgactaactttacttctgtacaacagagctacacctacccgcacctactttcgcccgagggaccaggtgatctacaaagactgtgctgccacatctgttcc

SEQ ID NO: 234374 - DNA, 479 bp, Homo sapiens
  misc_feature: GYAE6OF02GXLLB.2.43.D10.1.454.CMB.1.raw
  modified_base (352)..(352): a, c, t, g, unknown or other
  misc_feature (352)..(352): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagcaaaaaccaggggcagcccctcagctcctgatctctgctgcatccagattgcagagtggcgtcccatcgcggttcagtggcagtggatcgtgggacagtatttcnccctcaccatcagcagtctgcaaactgaggtatttgctaacttacttctgtcaacagagctacacctacccgcactactttgcccagggaccaggtgatctacaaagactgtgctgcaccatctgtc

SEQ ID NO: 234375 - DNA, 477 bp, Homo sapiens
  misc_feature: GYAE6OF02GZW1J.2.43.D10.1.454.CMB.1.raw
  modified_base (268)..(268): a, c, t, g, unknown or other
  misc_feature (268)..(268): n is a, c, g, or t
  modified_base (349)..(349): a, c, t, g, unknown or other
  misc_feature (349)..(349): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctattaaattggtatcagcaaaaaccaggggcagcccctnagctcctgatctctgctgcatccagattgcagagtggcgtcccatcgcgttcagtggcagtggatcgtgggacagatttcnccctcaccatcagcagtctgcaaactgaggtatttgctaacttacttctgtacaacagagctacactacccgcactactttgcccagggaccaggtgactctacaaagactgtgctgcaccatctgtc

SEQ ID NO: 234376 - DNA, 534 bp, Homo sapiens
  misc_feature: GYAE6OF02GOUES.2.43.D10.1.454.CMB.1.raw
  modified_base (88)..(88): a, c, t, g, unknown or other
  misc_feature (88)..(88): n is a, c, g, or t
  modified_base (126)..(126): a, c, t, g, unknown or other
  misc_feature (126)..(126): n is a, c, g, or t
  modified_base (182)..(182): a, c, t, g, unknown or other
  misc_feature (182)..(182): n is a, c, g, or t
  modified_base (206)..(206): a, c, t, g, unknown or other
  misc_feature (206)..(206): n is a, c, g, or t
  modified_base (221)..(221): a, c, t, g, unknown or other
  misc_feature (221)..(221): n is a, c, g, or t
  modified_base (244)..(244): a, c, t, g, unknown or other
  misc_feature (244)..(244): n is a, c, g, or t
  modified_base (254)..(254): a, c, t, g, unknown or other
  misc_feature (254)..(254): n is a, c, g, or t
  modified_base (281)..(281): a, c, t, g, unknown or other
  misc_feature (281)..(281): n is a, c, g, or t
  modified_base (351)..(351): a, c, t, g, unknown or other
  misc_feature (351)..(351): n is a, c, g, or t
  modified_base (439)..(439): a, c, t, g, unknown or other
  misc_feature (439)..(439): n is a, c, g, or t
tcagacgctcgacacacgaccggtgctcgatttagactagcagtaagggagtctcaggcaggacacagcatggacatgagggtcccgntcagctcctggggctcctgctactgtggctccgaggtnccagatgtgacatcgacatgacccagtctccatcctcctgtctgcatctgtggganaccgagtcaccatcacttgccggnaagtcaggccttaancctattaatggatcagcaaaacngggcagcctnagctctgactctctgctgcatccagtnttcgctagacgtcggcgtaccagtccgcgttacagtgactaggtcgactcgtgggactagtcttcgcctnaccgtatcgagtctagtcgtagacaacgtggacgtatttcgacctattacgtcgtacgtacaacgtgtacgtctaccgacgtacccgntaccgtacgtttgacccgtagggtacctaggtcgtactcgtaacgaaacgtcctaggtacggtactagacccgtaactacgtaccgtagttaccg

SEQ ID NO: 234377 - DNA, 499 bp, Homo sapiens
  misc_feature: GYAE6OF02F686K.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagcaaaaaccaggggcagcccctcagctcctgatctctgctgcatccagattgcagagtggcgtcccatcgcggttcagtggcagtggatcgtgggacagatttctccctcaccatcagcagtctgacaaactgaggtatttgctaacttacttctgtcaacagacgctacacctaccccgctactactttcgacccgaggggacctagggtggactactacaaaagtactgtaggctcgacaccactctgttc

SEQ ID NO: 234378 - DNA, 499 bp, Homo sapiens
  misc_feature: GYAE6OF02HDUY0.2.43.D10.1.454.CMB.1.raw
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (298)..(298): a, c, t, g, unknown or other
  misc_feature (298)..(298): n is a, c, g, or t
  modified_base (357)..(357): a, c, t, g, unknown or other
  misc_feature (357)..(357): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacaccttaatttaaattggtatcagacaaaaaccnggggcagcccctnagctcctgatctctgctgcatccagnttgcagagtggcgtcccatcgcgtttcagtggcagtggatcgtgggacagtactttccnccctcaccatcagcagtctgacaaacgtgaggtatttgactaactttacttctgtacaacagagactacacctacccgctactactttcgacccgtagggaccaggtcgactctacaaagactgtagctacgcacatctgtc

SEQ ID NO: 234379 - DNA, 478 bp, Homo sapiens
  misc_feature: GYAE6OF02JC15S.2.43.D10.1.454.CMB.1.raw
  modified_base (253)..(253): a, c, t, g, unknown or other
  misc_feature (253)..(253): n is a, c, g, or t
  modified_base (266)..(266): a, c, t, g, unknown or other
  misc_feature (266)..(266): n is a, c, g, or t
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
  modified_base (475)..(475): a, c, t, g, unknown or other
  misc_feature (475)..(475): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccttaacacctattaaattggtatcagcaaaaccnggggcagcccctnagctcctgatctctgctgcatccagattgcagagtggcgtccatcgcggttcagtgcagtgatcgtggacagatttcncctnaccatcagcagtctgcaaactgagtatttgctaacttacttctgtacaacagagctacacctacccgctactactttcgaccctagggaccgagtgactctacaaagtactgtagctgcaccatctntac

SEQ ID NO: 234380 - DNA, 499 bp, Homo sapiens
  misc_feature: GYAE6OF02IGCTE.2.43.D10.1.454.CMB.1.raw
  modified_base (356)..(356): a, c, t, g, unknown or other
  misc_feature (356)..(356): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagacaaaaaccaggggcagcccctcagctcctgatctctgctgcatccagattgcagagtggcgtcccatcgcggttcaggtggcaggtggatcgtgggacagtatttccnccctcaccatcagcagtctgacaaactgaggtattttgactaactttacttctgtcaacagagactacacctacccgcactacctttcgcccagggaccaggtcgactctacaaacgactgtacggctgccaccatcctgttc

SEQ ID NO: 234381 - DNA, 569 bp, Homo sapiens
  misc_feature: GYAE6OF02IGBX4.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtaatcagacaaaaaccgaggggcacgccccctcagcctcctgattcctctgctgcatccagattgcagagtcggccgtccagtcgcggttcagtggcagtggatcgtgggactagtactttcctccctcaccatcagcagtctgacaaacgtgagtatttcgactaacttacttctgtacaacgagacgtactaaccaccgtaaccccgactaaccttacttttcgacccgtaacggggaacctaagggttacggtacttaaccgtaacgtaaaacggtaacttacggtacggtacgtacgaccctaaccgtacttccgtagttaccc

SEQ ID NO: 234382 - DNA, 666 bp, Homo sapiens
  misc_feature: GYAE6OF02HSLH5.2.43.D10.1.454.CMB.1.raw
  modified_base (207)..(207): a, c, t, g, unknown or other
  misc_feature (207)..(207): n is a, c, g, or t
  modified_base (261)..(261): a, c, t, g, unknown or other
  misc_feature (261)..(261): n is a, c, g, or t
tcagacgctcgacacacgaccggtgctcgatttagactagcagtaagggagtctcaggcaggacacagcatggacatgagggtcccgctcagctcctgggctcctgctactgtggctccgaggtgccagatgtgacatcgacatgacccagtctccatcctccctgtctgcatctgtgggagaccgagtcaccatcacttggccggnaagtcaaggccgttaaacacctatttaaacttggtaatcaagacaaaaaaccgnggggacaacgcccctagacgcctcctagatctcgtgctgcaactccagtattcgacagtagtcggcgtcccatcggcggtttcagtggcagggtgactcgtggggaactaggtactttccgtccctcaacgtatcctagactacgttcgtgactaaacgtggaacgggtttatttacggactaaacttttactttacttacgttaccaaacgacggtaacgtaccttaacgaaccccttaaccccggtactaaacgttcctttttaacggaccccgtaagggggtaacccctaagggggttccggtaagttacccttaaacgtaaaaaaccgggtaacgtttaaccgggtcggttaacttaccgggaacctaaaccccggtttattacccgttcggtttaacccg

SEQ ID NO: 234383 - DNA, 564 bp, Homo sapiens
  misc_feature: GYAE6OF02GVGBH.2.43.D10.1.454.CMB.1.raw
  modified_base (255)..(255): a, c, t, g, unknown or other
  misc_feature (255)..(255): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctattaaattggtatcagacaaaaacnggggcacgcccctcagctcctgatctctgctgcatccagattgcagagtggccgtcccatcgcgttcagtggcaggtggatcgtagggacagtatttcctccctcaccatcagacagtcctagactaaacgtgtaggtattttcgactaactttacttctacgtacaactagacgtacctaccaccctacccgacctacctaccgttttcgacccgtacggggaacctagggtacggtacgttacgtaacgaaaaggtaaccgttacggtacggtacgtcggacctaaccgtacgttccgttcgttacc

SEQ ID NO: 234384 - DNA, 503 bp, Homo sapiens
  misc_feature: GYAE6OF02GA20O.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagcaaaaccaggggcagcccctcagctcctgatctctgctgcatccagattgcagagtggcgtcccatcgcggttcagtggcagtggatcgtgggacaggtatttctccctcaccatcagcagtctgacaaactgaggtatttgactaacttacttctgtacaacagagactacacctaccccgctacctactttcgcccgaggggacctagggtcgacgtctaacaaacgtactgtggctgccaccacttctgttcc

SEQ ID NO: 234385 - DNA, 542 bp, Homo sapiens
  misc_feature: GYAE6OF02F37NC.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagacaaaaaccaggggcagcccctcagctcctgatctctgctgcatccagattgcagagtggctcccatcgcggttcagtggcagtggatcgtgggacagactttcctccctacacctatccagcagtcagacaaacgtgagtatttcgactaactttacttctacgtacaacgagacgactacctacctaccccgctaacctaaccgttttcgaccccgtacggggacctaagggtcgtacttaaccgtaacgaaaacgtacgtaggtacggcctaggaccacctacgtctgttcc

SEQ ID NO: 234386 - DNA, 491 bp, Homo sapiens
  misc_feature: GYAE6OF02JE7RE.2.43.D10.1.454.CMB.1.raw
  modified_base (256)..(256): a, c, t, g, unknown or other
  misc_feature (256)..(256): n is a, c, g, or t
  modified_base (348)..(348): a, c, t, g, unknown or other
  misc_feature (348)..(348): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagcaaaaaccnggggcagcccctcagctcctgatctctgctgcatccagattgcagagtggcgtccatcgcgttcagtggcagtggatctgggacagatttcnccctcaccatcagcagtctgcaaactgagtattttgactaacttacttctgtcaacagagactacactaccccgacacctacttttcgacccgaggggaccaggtggatcgtacaaagtactgtggctcgaccaccatctgtc

SEQ ID NO: 234387 - DNA, 532 bp, Homo sapiens
  misc_feature: GYAE6OF02JZHOS.2.43.D10.1.454.CMB.1.raw
  modified_base (214)..(214): a, c, t, g, unknown or other
  misc_feature (214)..(214): n is a, c, g, or t
  modified_base (263)..(263): a, c, t, g, unknown or other
  misc_feature (263)..(263): n is a, c, g, or t
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
  modified_base (311)..(311): a, c, t, g, unknown or other
  misc_feature (311)..(311): n is a, c, g, or t
  modified_base (314)..(314): a, c, t, g, unknown or other
  misc_feature (314)..(314): n is a, c, g, or t
  modified_base (328)..(328): a, c, t, g, unknown or other
  misc_feature (328)..(328): n is a, c, g, or t
  modified_base (370)..(370): a, c, t, g, unknown or other
  misc_feature (370)..(370): n is a, c, g, or t
  modified_base (376)..(376): a, c, t, g, unknown or other
  misc_feature (376)..(376): n is a, c, g, or t
  modified_base (423)..(423): a, c, t, g, unknown or other
  misc_feature (423)..(423): n is a, c, g, or t
  modified_base (432)..(432): a, c, t, g, unknown or other
  misc_feature (432)..(432): n is a, c, g, or t
  modified_base (452)..(452): a, c, t, g, unknown or other
  misc_feature (452)..(452): n is a, c, g, or t
  modified_base (479)..(479): a, c, t, g, unknown or other
  misc_feature (479)..(479): n is a, c, g, or t
  modified_base (520)..(520): a, c, t, g, unknown or other
  misc_feature (520)..(520): n is a, c, g, or t
tcagacgctcgacacacgaccggtgctcgatttagactagcagtaaggggagtcgtcaggcaggacacagcatggacatgagggtccccgctcagctcctggggctcctgctactgtggctccgaggtgccagatgtgacatcgacatgacccagtcctccatcctccctgtctgcattctgtgggagaccgagtccaccatcacttgccgggnaagtcaggccgttaacaccttatttaaactggtatcagacaaaaaccgngggactagcccctgagtctcctgactcgtcngctgcactcagnttcgnagngtgcctaccatcgngttcagtggctagtgatcgagggactagtactttcgccctanaaccgntcgagtctagtctagactaaacgtgaggtactttgactaactttctntagtcaacngtacactaccaccttacccntaccttctttcggaccgacgggtaacnggtactacctacgtaacaagtcgtgtcgctaccgacacctntaccctgttacc

SEQ ID NO: 234388 - DNA, 516 bp, Homo sapiens
  misc_feature: GYAE6OF02GV9LH.2.43.D10.1.454.CMB.1.raw
  modified_base (269)..(269): a, c, t, g, unknown or other
  misc_feature (269)..(269): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagcaaaaaccaggggcagcccctnagctcctgatctctgctgcatccagattgcagagtggcgtcccatcgcggttcaggtggcaggtggatcgtgggactagtactttcctccctcaccatcacgcagtctagacaaactgaggtatttgactaactttacttctgtaccaacagacgacctaccacctaccccgctacctactttcgacccgacggggaccgacggtaggactactaactaaagaactagtggctcgccaccatctgtc

SEQ ID NO: 234389 - DNA, 502 bp, Homo sapiens
  misc_feature: GYAE6OF02G7R2Y.2.43.D10.1.454.CMB.1.raw
  modified_base (270)..(270): a, c, t, g, unknown or other
  misc_feature (270)..(270): n is a, c, g, or t
tcagacgctcgacacacgaccggtgctcgatttagactagcagtaaggggagtactcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagcaaaaaccaggggcagcccctnagctcctgatctctgctgcatccagattgcagagtggctcccatcgcggttcagtggcagtggatcgtgggacagtactttcctccctcaccatcagcagtctgcaaactgaggtatttgactaacttacttctgtcaacagagactacacctacccgactactaccttttcgacccgacggggaccacggtgactctacaaacgacgtgtggctcggaccaccatctgttc

SEQ ID NO: 234390 - DNA, 616 bp, Homo sapiens
  misc_feature: GYAE6OF02F3PEZ.2.43.D10.1.454.CMB.1.raw
  modified_base (264)..(264): a, c, t, g, unknown or other
  misc_feature (264)..(264): n is a, c, g, or t
  modified_base (278)..(278): a, c, t, g, unknown or other
  misc_feature (278)..(278): n is a, c, g, or t
  modified_base (307)..(307): a, c, t, g, unknown or other
  misc_feature (307)..(307): n is a, c, g, or t
tcagacgctcgacacacgaccggtgctcgatttagactagcagtaagggggagtctcaggcaggacacagcatggacatgagggtccccgctcagctcctggggctcctgctactgtggctccgaggtgccagatgtgacatcgacatgacccagtctccatcctccctgtctgcatctggtgggagaccgagtccaccatccacttggccgggcaagtcaggccgttaacaccttaatttaaattggtatcagacaaaaccgnggggcacgcccctnagcctctgactctctgctgcactccagtnttgcagtagtcggccgtccagtcggtcggttcaggtcggctaggtggacttcggtagggactagttactttcctccctacacctatacacgtctagttctacgacctaaacgtggaaggttatttcgaacttaactttacttcgtacgttaccaacgtacgtacgtacctaccgtacccgtaccccgactaaccgttaccgtttaccggacccggtaacggggaccctaagggtcgtaacgttccgtaaacgtaaaacggtacgttaggtcggtacgtacgacctaaccgtacttccgttacgttaccc

SEQ ID NO: 234391 - DNA, 526 bp, Homo sapiens
  misc_feature: GYAE6OF02JIH0B.2.43.D10.1.454.CMB.1.raw
  modified_base (184)..(184): a, c, t, g, unknown or other
  misc_feature (184)..(184): n is a, c, g, or t
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
  modified_base (363)..(363): a, c, t, g, unknown or other
  misc_feature (363)..(363): n is a, c, g, or t
  modified_base (414)..(414): a, c, t, g, unknown or other
  misc_feature (414)..(414): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctcctgtctgcatctgtggganaccgagtcaccatcacttgccgggcaagtcaggccgttaacacctatttaaatggtatcagacaaaaaccngggcagcccctnagctcctgatctctgctgcatccagattgcagagtcggcgtaccagtcgcggttcaggtcggctaggtggatcgtgggacagtactttcctccctnacctatcacgcagtctagactaaacgtgtagtattagactaacttactctntacaacgagagactaccacctacccgactaccttacgtttcgacccgtacgggaccaggtcgactctaacgtaaacgacgtcgtacgtctcgacctactactcgtattaccg

SEQ ID NO: 234392 - DNA, 526 bp, Homo sapiens
  misc_feature: GYAE6OF02IM5NQ.2.43.D10.1.454.CMB.1.raw
  modified_base (185)..(185): a, c, t, g, unknown or other
  misc_feature (185)..(185): n is a, c, g, or t
  modified_base (254)..(254): a, c, t, g, unknown or other
  misc_feature (254)..(254): n is a, c, g, or t
  modified_base (268)..(268): a, c, t, g, unknown or other
  misc_feature (268)..(268): n is a, c, g, or t
  modified_base (356)..(356): a, c, t, g, unknown or other
  misc_feature (356)..(356): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtggganaccgagtcaccatcacttgccggcaagtcaggccttaacacctatttaaattggtatcagacaaaaccngggacagcccctanagctcctgatctctgctgcatccagattgcagagtggcctccatcgcgttcagtggcagtggactcgtggggaactaggtacttttcncccttgaccatcagcagtcctgacaaactgaggtatttcgactaacttacttctagtacaacagacgtactaccacctacccgctaactctttacgacccgtagggaccaggtcggtactacgtacaaacgtaacgtagtcggtactcgacctaccacttctagttaccg

SEQ ID NO: 234393 - DNA, 572 bp, Homo sapiens
  misc_feature: GYAE6OF02HSCN0.2.43.D10.1.454.CMB.1.raw
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
  modified_base (353)..(353): a, c, t, g, unknown or other
  misc_feature (353)..(353): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaatggtatcagcaaaaaccnggggcagcccctnagctcctgatctctgctgcatccagattgcagagtggctccatcgcggttcagtggcaggtggatcgtgggactagtactttccnccctcacctatcagcagtctgactaaacgtgtaaggtattttacgaccttaaacctttactttctacgtacaaacgtagaacgtacttaacccaaccctaccccgactaaccttaccgttttcgacccgtaaggggaaccctagggtacggtactaccgtaaccgaaaacggtaccttaggtcggacttacggacctaaccgtacttcctaggttaccc

SEQ ID NO: 234394 - DNA, 608 bp, Homo sapiens
  misc_feature: GYAE6OF02IOQKF.2.43.D10.1.454.CMB.1.raw
  modified_base (254)..(254): a, c, t, g, unknown or other
  misc_feature (254)..(254): n is a, c, g, or t
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
tcagacgctcgacacacgaccggtgctcgatttagactagcagtaaggggaggtctcaggcaggacacagcatggacatgagggtccccgctcagctcctggggctcctgctactgtggctccgaggtgccagatgtgacatcgacatgacccagtctccatcctcctgtctgcatctgtggagaccgagtcaccatcacttgccgggcaagtcaggccgttaacacctatttaaattggtatcagacaaaacngggacagccctanagctctgatctntgctgcatccagattgcagagtggcgtccatcgcgttcaggtgcagtggactcgtgggactaggtacttttccgaccttcgactactcacgctagtctgacaaacgtgaaggtattttgacctaactttacttctacgttacaacctagtaacgtaccttaaccaaccgttacccccgactaaccgttacctttttaccggaccccgtaagggggtaaccccaaggggttaccggtaacgtttaaccgtaaccgtaaaaacggtaaaccgttacgggttaggacccgttacggtaaccctacccgtaaacgtttccgtacggtttaccc

SEQ ID NO: 234395 - DNA, 513 bp, Homo sapiens
  misc_feature: GYAE6OF02FT8MQ.2.43.D10.1.454.CMB.1.raw
  modified_base (363)..(363): a, c, t, g, unknown or other
  misc_feature (363)..(363): n is a, c, g, or t
tcagacgctcgacacacgaccggtgctcgatttagactagcagtaaggggagtcgtcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagacaaaaaccgaggggcacgcccctcagctcctgatctctgctgcatccagattgcagagtcggcgtcccatccgcggttcaggtggcaggtggatcgtggggacagtactttccnccctcacctatcagcagtctgacaaacgtgaggtatttgactaactttacttctgtacaacgagtacgactacacctacccgactactactttcgaccgagggaccaggtcgatcgtaacaaacgactgtgctcgaccactactctgtcc

SEQ ID NO: 234396 - DNA, 595 bp, Homo sapiens
  misc_feature: GYAE6OF02IJ82J.2.43.D10.1.454.CMB.1.raw
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (304)..(304): a, c, t, g, unknown or other
  misc_feature (304)..(304): n is a, c, g, or t
  modified_base (378)..(378): a, c, t, g, unknown or other
  misc_feature (378)..(378): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatcgacccagtctccatccctcctgtctgcatcgtgtgggagaccgagtcaccatcacttgccgggcaagtcaggccgttaacacctatttaaatggtatcagacaaaacngggcacgcccctnagctctgatctctgctgcactccagattgacaagngtgcgtccatcgcgttcagtggcagtggatcgtggactagtatttcctccctacacctatcagctaagtctaanaaactggacggttatttcgacttaacgtttacttcgtacgtacaaacacgtacgtacctaacctaaccgtacccccgtacgtaaccttaccgttttaccgggaccccgtaaagggggtaaccctaaagggttcggtaacttaaccgtaaactaaaaacggtaccttaggtcggtacgtcggaccctaacctaacgttccgttacgttctttaacccg

SEQ ID NO: 234397 - DNA, 595 bp, Homo sapiens
  misc_feature: GYAE6OF02JDPU2.2.43.D10.1.454.CMB.1.raw
  modified_base (266)..(266): a, c, t, g, unknown or other
  misc_feature (266)..(266): n is a, c, g, or t
tcagacgctcgacacacgaccggtgctcgatttagactagcagtaagggagtctcaggcaggacacagcatggacatgagggtccccgctcagctcctggggctcctgctactgtggctccgaggtgccagatgtgacatcgacatgacccagtctccatccctccctgtctgcatctgtgggagaccgagtcaccatcacttgccggcaagtcaggccttaacacttatttaaatgtatcagacaaaaccgagggcacgcccctnacgctcctgactctctgctgcatccagtattcgacgaggacgtcggaccgttcccagtccggtcggttcaggtcggcaggtcggacttcggtacgggactagtactttcctccctacgacctactaccgagctagtctgaacctaaacgtgaacggttattttacgaccttaaacgtttacttcgtacgtaccaacgagtacgaccttaacgacccgtaacccgactaaccgttacgtttaccgacccggtaacgggtaccctagggtcgtaccgttaccgtaacaaacgtactaggtaccgactacgacctacctagtacctagtacc

SEQ ID NO: 234398 - DNA, 565 bp, Homo sapiens
  misc_feature: GYAE6OF02IQ3UZ.2.43.D10.1.454.CMB.1.raw
  modified_base (185)..(185): a, c, t, g, unknown or other
  misc_feature (185)..(185): n is a, c, g, or t
  modified_base (249)..(249): a, c, t, g, unknown or other
  misc_feature (249)..(249): n is a, c, g, or t
  modified_base (263)..(263): a, c, t, g, unknown or other
  misc_feature (263)..(263): n is a, c, g, or t
  modified_base (346)..(346): a, c, t, g, unknown or other
  misc_feature (346)..(346): n is a, c, g, or t
tcagacgctcgacacacgaccggtgctcgatttagactagcagtaaggggaggtctcaggcaggacacagcatggacatgagggtccccgctcagctcctggggctcctgctactgtggctccgaggtgccagatgtgacatcgacatgacccagtctccatcctcctgtctgcatctgtggganaccgagtcaccatcacttgccggcaagtcagccgttaacactatttaaatgatcagacaaaacngggacagacccctnagctacctgactctctgctgcatccagatgcagagtgcgtccatcgcgttcagtggcagtggatcgtagggaccagatttccncctcacctatccaagctagtctagcaaactgagtatttgacttaacttacgttctagtacaactagagtaccttaacgacttaccccgactaaccgttacttttacgcccctaacgggggaacctaagggttcggtaacgtaacgttaaccaaaaacggttaccgtacggttaacgggtcctacggtacccgtaacccgtatttacccgtgtttaaccc

SEQ ID NO: 234399 - DNA, 543 bp, Homo sapiens
  misc_feature: GYAE6OF02GWBBZ.2.43.D10.1.454.CMB.1.raw
  modified_base (254)..(254): a, c, t, g, unknown or other
  misc_feature (254)..(254): n is a, c, g, or t
  modified_base (266)..(266): a, c, t, g, unknown or other
  misc_feature (266)..(266): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacaccttatttaaatggtatcagcaaaacngggcagcccctnagctcctgatctctgctgcatccagtattgcagagtcgtccgtcccatccgcgttcagtggcagtggatcgtgggactagtatttcctccctcaccatcacgtcagtcctagacaaacgtgaaggtacttttcgacttaacgtttacttctagttacaactgacgtacctaccaccgtaccccgactaccttaccgtttcgacccgtagggacctaagggtcgaacgtcgtaacaaaaggtactacggtagcttacgacctactactcgtattaccg

SEQ ID NO: 234400 - DNA, 541 bp, Homo sapiens
  misc_feature: GYAE6OF02FF2WN.2.43.D10.1.454.CMB.1.raw
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagacaaaaaccnggggcagcccctnagctcctgatctctgctgcatccagtattgctagagtggccgtccagtccgcggttcaggtggctaggtggatcgtggggacagtactttccgtaccctcaacctatcacgctagtctacgacctaaacgtggaaggtattttcggactaactttacttctagtaccaaacagacgactaccacctaccccgactacctactttcgcccgtagggacctaggtcgagtaccagaaacgtactcggtagctacgacctacacttctgttacc

SEQ ID NO: 234401 - DNA, 479 bp, Homo sapiens
  misc_feature: GYAE6OF02F3MSY.2.43.D10.1.454.CMB.1.raw
  modified_base (256)..(256): a, c, t, g, unknown or other
  misc_feature (256)..(256): n is a, c, g, or t
  modified_base (352)..(352): a, c, t, g, unknown or other
  misc_feature (352)..(352): n is a, c, g, or t
  modified_base (382)..(382): a, c, t, g, unknown or other
  misc_feature (382)..(382): n is a, c, g, or t
  modified_base (398)..(398): a, c, t, g, unknown or other
  misc_feature (398)..(398): n is a, c, g, or t
  modified_base (409)..(409): a, c, t, g, unknown or other
  misc_feature (409)..(409): n is a, c, g, or t
  modified_base (422)..(422): a, c, t, g, unknown or other
  misc_feature (422)..(422): n is a, c, g, or t
  modified_base (462)..(462): a, c, t, g, unknown or other
  misc_feature (462)..(462): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagcaaaaaccnggggcagcccctcagctcctgatctctgctgcatccagattgcagagtggcgtcccatcgcggttcagtggcagtgatcgtgggacagtatttccncctcaccatcagcagtctgacaactgagtntttgctaacttctctntacaacagacnctacactacccgntactactttcgccgagggacaggtgactcacaagtactgngtcncgcacnctctgtc

SEQ ID NO: 234402 - DNA, 602 bp, Homo sapiens
  misc_feature: GYAE6OF02H1PS0.2.43.D10.1.454.CMB.1.raw
  modified_base (210)..(210): a, c, t, g, unknown or other
  misc_feature (210)..(210): n is a, c, g, or t
  modified_base (258)..(258): a, c, t, g, unknown or other
  misc_feature (258)..(258): n is a, c, g, or t
  modified_base (271)..(271): a, c, t, g, unknown or other
  misc_feature (271)..(271): n is a, c, g, or t
  modified_base (356)..(356): a, c, t, g, unknown or other
  misc_feature (356)..(356): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggnaagtcaggccgttaacacctatttaaattggtatcagacaaaaaccgnggggcagcccctnagctcctgatctctgctgcatccagattgcagagtggcgtcccatcgcggttcagtggcaggtgatcgtgggactagtactttcnccctacaccatcagctagtctagactaaacgtggaggttattttacgaccttaactttaccttcttacgtacaaacagtaacgacctaaccaccctaaccccgactaacccttaccgttttccggaccccgtaagggggtaaccctaaggggtcggtaaacgttaccgtaacgtaaaacggtaaccgttacggttacggtaccgttacggacccgtaacccgtaacgttaccgttacgtttacccg

SEQ ID NO: 234403 - DNA, 523 bp, Homo sapiens
  misc_feature: GYAE6OF02H8CZK.2.43.D10.1.454.CMB.1.raw
  modified_base (210)..(210): a, c, t, g, unknown or other
  misc_feature (210)..(210): n is a, c, g, or t
  modified_base (403)..(403): a, c, t, g, unknown or other
  misc_feature (403)..(403): n is a, c, g, or t
  modified_base (415)..(415): a, c, t, g, unknown or other
  misc_feature (415)..(415): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggnaagtcaggccgttaacacctatttaaattggtatcagacaaaaaccgaggggcagcccctcagctcctgatctctgctgcatccagattgcagagtggcgtcccatcggcggttcagtggcaggtggatcgtgggacagtctttcctccctcaccatcacgcagtctgacaactggagtatttgactaacttnttctgtacaacngactcctaccacctaccccgctaactaccgtttcgacccgtaggggaccagggtcgactctaacgaaagtacgtagtcggtactcgtaccaaccgtattccgtgttcc

SEQ ID NO: 234404 - DNA, 714 bp, Homo sapiens
  misc_feature: GYAE6OF02JS9F2.2.43.D10.1.454.CMB.1.raw
  modified_base (187)..(187): a, c, t, g, unknown or other
  misc_feature (187)..(187): n is a, c, g, or t
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
tcagacgctcgacacacgaccggtgctcgatttagactagcagtaaggggaggtctcaggcaggacacagcatggacatgagggtccccgctcagctcctggggctcctgctactgtggctccgaggtgccagatgtgacatcgacatgacccagtctccatcctccctgtcctgcatctgtggganaccgngtccaccatcacttcggcccgggnaagtcacggtccgttaaaccaccttaatttaaacttggtactctagaccaaaaccgtagggacacggcccctgacgtcctcctagactctctgacttcgacactccagtacttgccagtcgtggccgtaccagtccgcggttcagtcggacgagttggacttcggtacggggactaggtaccttttcccgtcccgtctaacccgtactaccgtaacggtcccgtaaggttccctacgtaaccgtaaacgttacgggtaaggtttactttttacgggaaccctttaaacctttcgtttacccgttagtaccctaaacgacgttacgtacccttaaccgtaccccgttaaccccggactttaaacgttaacccgttttcggaaccccgtaagggggtaccctacggggtttgaacccgtttaccgaaacgaaaacggttacccgtggttaccggtacctacggtaccccaaacgtttaccgttacccgttggtttaaccc

SEQ ID NO: 234405 - DNA, 580 bp, Homo sapiens
  misc_feature: GYAE6OF02IFM9Y.2.43.D10.1.454.CMB.1.raw
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
  modified_base (335)..(335): a, c, t, g, unknown or other
  misc_feature (335)..(335): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggaaagtcaggccgttaacacctatttaaatggtatcagcaaaaaccnggggcagcccctnagctcctgatctctgctgcatccagattgcagagtggcgtccatcgcggttcagtggcagtgatcgngggacagtactttctcccgtcaaccctatccagtcacgtctagacctaaacgtggtaaggtatttttacgaccttaaactttacctttctacgttaccaaacaagtacgtaccttaaccaccctaaccccgactaacctacgttttccgacccgtaacggggaacctaagggtcggtaacttaccgtaacaaaacggtaacgtacggttacggacgtacgaccacctacttcttcgttcttaccg

SEQ ID NO: 234406 - DNA, 565 bp, Homo sapiens
  misc_feature: GYAE6OF02HOZEX.2.43.D10.1.454.CMB.1.raw
  modified_base (257)..(257): a, c, t, g, unknown or other
  misc_feature (257)..(257): n is a, c, g, or t
  modified_base (357)..(357): a, c, t, g, unknown or other
  misc_feature (357)..(357): n is a, c, g, or t
  modified_base (524)..(524): a, c, t, g, unknown or other
  misc_feature (524)..(524): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagacaaaaacgnggggcacgcccctcagctcctgactctctgctgcatccagattgcagagtggccgtccatcgcggttcagtggcagtggatcgtgggactagactttccnccctcaacctatcgagtcagtctgactaaacgtgaacggttatttcgacttaactttacttctgtaccaatagacgtcctaaccacctaccccgactaaccttactttccgacccgtaaggggtacctaagggtcggaacgttcgtaacgtaaaacgacgttacggnggtacctacggaccctaaccgtaacttccgttacgttaccg

SEQ ID NO: 234407 - DNA, 516 bp, Homo sapiens
  misc_feature: GYAE6OF02GAOHW.2.43.D10.1.454.CMB.1.raw
  modified_base (185)..(185): a, c, t, g, unknown or other
  misc_feature (185)..(185): n is a, c, g, or t
  modified_base (210)..(210): a, c, t, g, unknown or other
  misc_feature (210)..(210): n is a, c, g, or t
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtggganaccgagtcaccatcacttgccgggnaagtcaggccgttaacacctatttaaatggtatcagcaaaaaccaggggcaagcccctnacgctcctgatctntgctgcatccagtattgcagtagtggctcccatcgcggttcagtggcaggtgatcgtgggactagtactttctccctacaccatcaagcagtctgaccaaactgaggtattttgactaatttcttctgtacaacagagtactacctacctacccgcacctactttcgacccgagggtacctagggtcgaatcaactaaagacgttgtggactggacctaccattcctgttacc

SEQ ID NO: 234408 - DNA, 504 bp, Homo sapiens
  misc_feature: GYAE6OF02I187E.2.43.D10.1.454.CMB.1.raw
  modified_base (184)..(184): a, c, t, g, unknown or other
  misc_feature (184)..(184): n is a, c, g, or t
  modified_base (266)..(266): a, c, t, g, unknown or other
  misc_feature (266)..(266): n is a, c, g, or t
  modified_base (297)..(297): a, c, t, g, unknown or other
  misc_feature (297)..(297): n is a, c, g, or t
  modified_base (310)..(310): a, c, t, g, unknown or other
  misc_feature (310)..(310): n is a, c, g, or t
  modified_base (346)..(346): a, c, t, g, unknown or other
  misc_feature (346)..(346): n is a, c, g, or t
  modified_base (380)..(380): a, c, t, g, unknown or other
  misc_feature (380)..(380): n is a, c, g, or t
  modified_base (397)..(397): a, c, t, g, unknown or other
  misc_feature (397)..(397): n is a, c, g, or t
  modified_base (486)..(486): a, c, t, g, unknown or other
  misc_feature (486)..(486): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctcctgtctgcatctgtggganaccgagtcaccatcacttgccgggcaagtcaggccgttaacacctattaaatggtatcagacaaaaccagggcaagccctanagctctgatctctgctgcatccagatgcagngtggctcccatcncgttcagtggcagtggatcgtgggacagtatttccnccctcaccatacagcagtctgactaaactgagtntttagactaacttcgtntgtcaacacgatactacacctaaccctcaaccttctttacgccgaacgggtaccacggtgacttacgaacaaagtacgtagtacggtcncgtaccactctactgtcc

SEQ ID NO: 234409 - DNA, 705 bp, Homo sapiens
  misc_feature: GYAE6OF02II02I.2.43.D10.1.454.CMB.1.raw
  modified_base (275)..(275): a, c, t, g, unknown or other
  misc_feature (275)..(275): n is a, c, g, or t
  modified_base (491)..(491): a, c, t, g, unknown or other
  misc_feature (491)..(491): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacattacccagtctccatcctccctgtctgcatctgtgggacgaccgagtccaccatcacttgccgggacaagtcagggacccgttaaacaccttatttaaaagttgggtactacgaagaccaaaaaaccgngggggacacgtccccctagacgtcctcccgttagactcgtcctggcttagccatccagtattcgaccaggtggtcggtccacctagtccggtcgttacgaacggttggcgtaaggttcgggaagtccgttaggggaacctaaaggttaccttttcccgtcccctaaccaacctacgtacgaacgtacgtaacgggttcacggtaacgttaaaccgnggttaaacggtatttttcgaacttaaacgttttacctttacgtacggtaacctaagtacggttacgtacccttaacccgtaacccgtaaacccccgtacttaacccgtttaaccttttcgggaccccgtaaacgggggtaacctaaacggggtcggtaactccgtaacaaaacgtccgtagttccgacgtcgaccacgtactgtctcgtttacc

SEQ ID NO: 234410 - DNA, 536 bp, Homo sapiens
  misc_feature: GYAE6OF02IGJSK.2.43.D10.1.454.CMB.1.raw
  modified_base (259)..(259): a, c, t, g, unknown or other
  misc_feature (259)..(259): n is a, c, g, or t
  modified_base (411)..(411): a, c, t, g, unknown or other
  misc_feature (411)..(411): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtccaccatcacttgccgggcaagtcaggccgttaacacctaatttaaattggtatcagacaaaaaccnggggacagcccctcagctcctgatctctgctgcatccagattgcagagtggcctccatcgcgttcagtgcagtgatcgtgggacagtactttcctcctcaccatcagcagtctgactaactgtagtatttgactacttacttctcgtacaanagagacctacacctacccgtactaccttactttcgacccgtacgggtaccaggtacggtaactccgtaacgtaaaacggtaacgttgtacggtctacggacctacccgtacttcgttagttaccc

SEQ ID NO: 234411 - DNA, 849 bp, Homo sapiens
  misc_feature: GYAE6OF02JQEEY.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtcctccatcctcctgtctgcatctgtgggacgaccgagtccaccatcacgttcggccgggacaaggtccacgggtacccgtttaaacaccctttaagttttaaaagttcgggttaattaccgaacgtaaccgaaaaaaacccggacggggggtaccaaccggtccccccttacgaacggtccttacccgttggtaaccttccgttaccgtcggtacccgttcggacctaaccgttacccgtaaggttacgtttcggacgtaacggggtaacgggttaccggggtaccccgtaccccgtaacggttcccggggtaccgggtttaccggtaacgggttcggggtaccgtaagggttacgggtaacggttccgggtacgggggtaacctacgggtttaccttttcccgttaccccgtactaacccgtactaccgtaacgtaccgttaacggtccgtacgtaaccgtaaacgttggtaacggttatttacggtaaccctttaaaccgttttccttaccgttacgttaaaccgtaacgtaacggtacgtacccttaacctaacccgtaccccgtacttaaccgttacccgtttacggacccggtaacggggtaaccgtacggtacggtaccgttacgtaaacgttaaacgacgttacgtacggtaccgttacggaccttacgtacgttccgtacgttacc

SEQ ID NO: 234412 - DNA, 546 bp, Homo sapiens
  misc_feature: GYAE6OF02GBJVB.2.43.D10.1.454.CMB.1.raw
  modified_base (297)..(297): a, c, t, g, unknown or other
  misc_feature (297)..(297): n is a, c, g, or t
  modified_base (320)..(320): a, c, t, g, unknown or other
  misc_feature (320)..(320): n is a, c, g, or t
  modified_base (359)..(359): a, c, t, g, unknown or other
  misc_feature (359)..(359): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagcaaaaaccaggggcagccccctcagcctcctgatctctgctgcatccagnttgcagagtggccgtcccatcgnggttcagtggcagtggatcgtgggacagatttctccctnaccatcagcagtctgacaaactgaaggtattttgactaactttcttctagtccaaacagacgtctacacctaccccgctaaccgtacttttcggacccgtaaggggaccctaagggtacgagttacctaacgaaaaacggtacctaggttcggacgttacgaccaaccctaattccgttagttaccg

SEQ ID NO: 234413 - DNA, 556 bp, Homo sapiens
  misc_feature: GYAE6OF02GVCAE.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccggcaagtcagagcattagcagctatttaaattggtatcagcagaaaccagggaaacgacccctaaactcctgatctatgttacatccagtttgactaaaggtcggggtacccagtcaaggttcagtggcagtggatcgtagggacagtatttcactctcaccatcagcagtctgacaactgaagtatttgactaacttactacttagtacaaacagtaacgttacacgttacccctggtaccgttcggaccgtaacgggaaccgaaaggtacgaaactacgaaacgtaacgtaggtcggtactacgtacctaccgtagtactacgttccttactacttcctacccgtacc

SEQ ID NO: 234414 - DNA, 585 bp, Homo sapiens
  misc_feature: GYAE6OF02IXJIW.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagacaaaaaccgaggggcacgcccctcagctcctgatctctgctgcatccagtattgcaggagtcggccgtcccagtcggtcggttcaggtggctaggtggatcgtaggggactagtactttcctccctacacctactcagcagttctgacaaacgtgaggttatttcgactaactttacttcgtcgtacaacgtacgacgtacctaaccaacccgtaccccgtactaaccttacttttaccgaccccgtaaggggtaaccctagggtacggtaacttaccgtaacgtaaaacggtaccgttaggtacgtacctacggacctacctagttcgtcgttacc

SEQ ID NO: 234415 - DNA, 630 bp, Homo sapiens
  misc_feature: GYAE6OF02JZP32.2.43.D10.1.454.CMB.1.raw
  modified_base (188)..(188): a, c, t, g, unknown or other
  misc_feature (188)..(188): n is a, c, g, or t
  modified_base (232)..(232): a, c, t, g, unknown or other
  misc_feature (232)..(232): n is a, c, g, or t
  modified_base (262)..(262): a, c, t, g, unknown or other
  misc_feature (262)..(262): n is a, c, g, or t
  modified_base (274)..(274): a, c, t, g, unknown or other
  misc_feature (274)..(274): n is a, c, g, or t
  modified_base (306)..(306): a, c, t, g, unknown or other
  misc_feature (306)..(306): n is a, c, g, or t
  modified_base (606)..(606): a, c, t, g, unknown or other
  misc_feature (606)..(606): n is a, c, g, or t
  modified_base (624)..(624): a, c, t, g, unknown or other
  misc_feature (624)..(624): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatcgacccagtctccatcctcctgtctgcatctggtagggacnccgagtccacatcacttcggccgggcaagtcaggcccttaaacncgttaattaaattggatcagacaaaaacgnggggcacgcccncagctcctgatctctagctgcatccagattcncaggcgtgccgtcccagttccgcgtttcagtggcagtggactcgtagggactacggtaatttccgtacccgttcaacccgtacttaccgaacggtacctaaccgggttctacggtaacctaaaaccggtgggtaacggttactttttacggaaccctttaaaccgtttactttaccgtacggttaactaaacccggaaggtaaccaccgtttaaccgaaccgtttaccccgactaccttaaccgtttcgacccgtagggtaccaggtcgactacgtaccaaagtaacgttgtaccggtcncggacctacacgttaccngttacc

SEQ ID NO: 234416 - DNA, 693 bp, Homo sapiens
  misc_feature: GYAE6OF02G0WBR.2.43.D10.1.454.CMB.1.raw
  modified_base (254)..(254): a, c, t, g, unknown or other
  misc_feature (254)..(254): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaatggtatcagacaaaacgnggggacacgcccctcagctcctgatctctgctgcactccagtattgacagaggtcggccgtcccagtccggtcggttacgaggtcggcgtaggtggtacttcggtagggactagttactttcctccctacacctactacgacgtacgtagtccgtacgtaacctaaacgtggtaagttacttttacggacctttaacctttacttcgtacgtaacaacgtagtaaccgtaccttaacccgtaaccctaaccccgtaccttaacccgtttacccgttttaccggaaccccgggtaccggggtaacccgtaacgggttacggtaaccgtttaacccggttaaaccggtaaaaaccggttaaccggttacgggttaccggtaccggttaaccggtaacccgtaacccggtttaacgtttccccggtttacgtttaacccccg

SEQ ID NO: 234417 - DNA, 544 bp, Homo sapiens
  misc_feature: GYAE6OF02JS7BA.2.43.D10.1.454.CMB.1.raw
  modified_base (92)..(92): a, c, t, g, unknown or other
  misc_feature (92)..(92): n is a, c, g, or t
  modified_base (273)..(273): a, c, t, g, unknown or other
  misc_feature (273)..(273): n is a, c, g, or t
  modified_base (349)..(349): a, c, t, g, unknown or other
  misc_feature (349)..(349): n is a, c, g, or t
  modified_base (362)..(362): a, c, t, g, unknown or other
  misc_feature (362)..(362): n is a, c, g, or t
tcagacgctcgacacacgaccggtgctcgatttagactagcagtaagggagtctcaggccaggacacagcagtggactatgagggtccccgntcagctcctggggactcctgctactgtggctccgaggtgccagatgtgtacattcgacatgacccagtctcatcctcctgtctgcatcgtgtggggagaccgagtccaccggatcaacttgccggcaagtcaggccgttaacacctatttaaatggatcagacaaaacctgggcagccctnagctacctgatctacgtgctgcatccagaattgcagagtggcgtccatcgcggttcagttgcagtgatctgggacngaatttcaccctnaccatcagcaacgtctagactaaacttgaacggattttcgctaacttattcgatacaaacagagacttacgaacctacccgcaactacttttagacccgaaggggtaccaaggttggtaactccttaacaaaaacgaaccgttagtaggtaccgttggaccacccaagttccgttagttccg

SEQ ID NO: 234418 - DNA, 623 bp, Homo sapiens
  misc_feature: GYAE6OF02ITXR6.2.43.D10.1.454.CMB.1.raw
  modified_base (212)..(212): a, c, t, g, unknown or other
  misc_feature (212)..(212): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttggccggganaagtcgacggtccgttaacaccttaatttaaatggtatcagacaaaaaccgaggggcacgcccctacagctcctgatctctgctgcatccagtattgcagagtcggccgtccagtccggtcggttcgacggtcggacgaggttggattcggtagggactagtactttcccgtaccctcacctactcgagcctagtacctagacctaaacgtggtaacgttactttggaccttaacgtttacttcgttacgtacaacgtacgacgtacctaaccaccctacccgctaaccgttacccgttttacggacccgtaacggggtacccgtaagggttacggtactaaccggtaacgaaaacgtacgttacggtacggaccgttacgaccctaaccggtaacttccgtacgtttacc

SEQ ID NO: 234419 - DNA, 556 bp, Homo sapiens
  misc_feature: GYAE6OF02HI2H2.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagacaaaaaccaggggcacgcccctcagctcctgatctctgctgcatccagattgcagagtggcgtcccatcgcgtcagtggcagtggactcgtgggacagtctttcccgccctcaccatccagctagtctagacaaacgtgaggttactttgacctactttacttctatcaacgagtacgacctaaccacctacccgactaaccttaccgtttccgacccgtacgggacccgtagggtaggtacttacgaacgtaaaacgtaccgttggtacggtcctacggaccctaccgtaacttccgtacgttaccg

SEQ ID NO: 234420 - DNA, 546 bp, Homo sapiens
  misc_feature: GYAE6OF02HGV38.2.43.D10.1.454.CMB.1.raw
  modified_base (254)..(254): a, c, t, g, unknown or other
  misc_feature (254)..(254): n is a, c, g, or t
  modified_base (267)..(267): a, c, t, g, unknown or other
  misc_feature (267)..(267): n is a, c, g, or t
  modified_base (293)..(293): a, c, t, g, unknown or other
  misc_feature (293)..(293): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctcctgtctgcatctgtgggagaccgagtcaccatcacttgccggcaagtcaggccgttaacaccttatttaaattgtatcagacaaaacgngggcacgcccctnagctctgactctctgctgcatccagnttgacagagtcggcgtccatcgtcgtcagtggcagtggatcgtgggactagtactttcctacctcacctactcagtctacgtctgacctaaacgtggtagttagtttacgacttaacctttacttctcgtactaactacgatactaccacctacccgctaccttactttacgaccgtacgggaccgtaggtacgtactacgtaacgaaacgtacgttagtcgtcgtacgaccgtacctacgtcgttagttacc

SEQ ID NO: 234421 - DNA, 568 bp, Homo sapiens
  misc_feature: GYAE6OF02IZZF4.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacaccttatttaaattggtatcagacaaaaaccgaggggacacgcccctcacgctcctgactctctgctgcatccagattgcagagtggcgtcccagtcgcggttcagtgcagtggatcgtgggacagtactttcctccctacaccatcagctagtctgacctaaacgtggaggtattttcgactaaactttacttcttacgtacaaacagtacgtacctaaccacctaaccccgctaacttaccgttttcgacccgtaaggggaaccctagggtacggtacctactaaccgaaaaggtaacttaggtacgacgtacgtacctaaccgacgttcctcggttacc

SEQ ID NO: 234422 - DNA, 634 bp, Homo sapiens
  misc_feature: GYAE6OF02J28XJ.2.43.D10.1.454.CMB.1.raw
  modified_base (263)..(263): a, c, t, g, unknown or other
  misc_feature (263)..(263): n is a, c, g, or t
  modified_base (276)..(276): a, c, t, g, unknown or other
  misc_feature (276)..(276): n is a, c, g, or t
  modified_base (284)..(284): a, c, t, g, unknown or other
  misc_feature (284)..(284): n is a, c, g, or t
  modified_base (292)..(292): a, c, t, g, unknown or other
  misc_feature (292)..(292): n is a, c, g, or t
  modified_base (396)..(396): a, c, t, g, unknown or other
  misc_feature (396)..(396): n is a, c, g, or t
  modified_base (627)..(627): a, c, t, g, unknown or other
  misc_feature (627)..(627): n is a, c, g, or t
tcagacgctcgacacacgaccggtgctcgatttagactagcagtaagggagtctcaggcaggacacagcatggacatgagggtccccgctcagctcctggggctcctgctactgtggctccgaggtgccagatgtgacatcgacatgacccagtctccattccctccctgtctgcatcgtgtgggacaccgagtcaccatcacgttgccgggcaagtccaggtaccgttaacaccttatttaattggtatcagacaaaaccgngggcacgcccctnacgcctcngactcctntgctagcatccgagtattcgctaggacgtcggccgtacccagttccggacggttcaggttcggcgtaggtggacgttcgtagggaacctacgttacgtttcccnccgtaccacctactccacgctacgtctacgacctaaacgttggtaacgttatttacgtaccttaacctttacgttccttagtacctaacgtacgtactacctaacccgtaccctacccgtaccttaccgttaccgtttccggaacccgtacgggtaaccctagggtacgtacgtaaccgtaacgtaaacgtacgttcggtacgtactacgacctaaccgttacttccgttnttacccg

SEQ ID NO: 234423 - DNA, 606 bp, Homo sapiens
  misc_feature: GYAE6OF02JEUJD.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccggcgaagtcgaggccgttaacacctaatttaaattaggtatcagacaaaaccaaggggcacgcccctcagctcctgatctctgctcgcactccagattcgcagtaggtcggccgtcccagtcgcggttcgagtggcaggtggacgtcgtgggacagtactttccgtccctcacctagtcctaagctaacgtctgaccaaaacgttggaacggttattttcgacctaacttttacttctacgttacaaaccgagtacgtaccttacccaacccgttaccccgaccttaacttaaccgttttccggacccgtacgggggaacctaagggtcgaacgttacctaacgtaaaaacggtacgttacgggtcgacgtcggacccaccgttacttcgttacttaccg

SEQ ID NO: 234424 - DNA, 584 bp, Homo sapiens
  misc_feature: GYAE6OF02FWG2A.2.43.D10.1.454.CMB.1.raw
  modified_base (184)..(184): a, c, t, g, unknown or other
  misc_feature (184)..(184): n is a, c, g, or t
  modified_base (208)..(208): a, c, t, g, unknown or other
  misc_feature (208)..(208): n is a, c, g, or t
  modified_base (253)..(253): a, c, t, g, unknown or other
  misc_feature (253)..(253): n is a, c, g, or t
  modified_base (348)..(348): a, c, t, g, unknown or other
  misc_feature (348)..(348): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctcctgtctgcatctgtggganaccgagtcaccatcacttgccggnaagtcaggccgttaacaccttattaaatggtatcagacaaaaacnggggcagcccctcagctctgatctctgctgcactccgagtactgcagagtggcgtccatcgcgttcagtggcagtggatctggacagtacttccncctcaccatacgacgtcgaagttctcgactaaacgtggtaaggtacttttacggaaccttaacgtttaaccttcgttacgtactaaacgagtaactcccttaaaccgacccttaaccccgaccgtaaccttaccttttccggaacccgtaacgggtacccgtaaggttcggacgtactaaccgaaaaggtaactacgggtacgtcgttacgacccgtaccacttacgtgtttaccc

SEQ ID NO: 234425 - DNA, 490 bp, Homo sapiens
  misc_feature: GYAE6OF02G5WOL.2.43.D10.1.454.CMB.1.raw
  modified_base (248)..(248): a, c, t, g, unknown or other
  misc_feature (248)..(248): n is a, c, g, or t
  modified_base (260)..(260): a, c, t, g, unknown or other
  misc_feature (260)..(260): n is a, c, g, or t
  modified_base (281)..(281): a, c, t, g, unknown or other
  misc_feature (281)..(281): n is a, c, g, or t
  modified_base (311)..(311): a, c, t, g, unknown or other
  misc_feature (311)..(311): n is a, c, g, or t
  modified_base (339)..(339): a, c, t, g, unknown or other
  misc_feature (339)..(339): n is a, c, g, or t
  modified_base (475)..(475): a, c, t, g, unknown or other
  misc_feature (475)..(475): n is a, c, g, or t
  modified_base (488)..(488): a, c, t, g, unknown or other
  misc_feature (488)..(488): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccggcaagtcaggccttaacactattaattggatcagcaaaacngggcagcccctnagctcctgatctctgctgcanccagattgcagagtgcgtcccatcgcgttnagtgcagtgatcgtggactagatttccnccctacaccatcagcagtctgacaaacgtgacgtatttagactaacttacgttctagtacaacagacgctaccacctacccgctactacgtttcgaccgtagggaccagtcgatactactaaaagcgttgcgtacncgacctacatctntc

SEQ ID NO: 234426 - DNA, 566 bp, Homo sapiens
  misc_feature: GYAE6OF02HAQ7Y.2.43.D10.1.454.CMB.1.raw
  modified_base (265)..(265): a, c, t, g, unknown or other
  misc_feature (265)..(265): n is a, c, g, or t
  modified_base (279)..(279): a, c, t, g, unknown or other
  misc_feature (279)..(279): n is a, c, g, or t
  modified_base (337)..(337): a, c, t, g, unknown or other
  misc_feature (337)..(337): n is a, c, g, or t
  modified_base (357)..(357): a, c, t, g, unknown or other
  misc_feature (357)..(357): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctggtggagaccgagtcaccatccacgttggcccgggcaaagtcacggtccttaaacaccttatttaaattggtatcagacaaaaacgnggggcacgcccctnacgctctagactctctgctgcactaccagtattgcagagtggccgtccagtcgcgttnagtgcagtgatcgtaggacngtactttcctaccctcaccatcagcacgtctagactaactggagttagtttgacttactttacttcgtacgtacaacgtagacgtacctaaccaacccgtaccccgactaaccttccgtttaccgacccggtaacgggaccgtagggtacgtactactaacgaaacgtaacgttacgtagccgtacgacctaccgtacttcgtcgttcc

SEQ ID NO: 234427 - DNA, 602 bp, Homo sapiens
  misc_feature: GYAE6OF02GLC85.2.43.D10.1.454.CMB.1.raw
  modified_base (258)..(258): a, c, t, g, unknown or other
  misc_feature (258)..(258): n is a, c, g, or t
  modified_base (273)..(273): a, c, t, g, unknown or other
  misc_feature (273)..(273): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacaccttatttaaattggtatcagacaaaaaccnggggacacgcccctnagctcctgatctctgctgcatccagtatgcagagtggcgtcccagtcgcggttcaggtggctaggtggatcgtagggactagtactttcctccctcaccatcacgctagtcgtagaccaaacgtggtaacggttatttcgacttaaccgtttacttcgtagttaccaacgtacgtagtacctaaccgaaccctaccccgtacctaaccgtaccgttttaccggacccggtaagggaacccgtagggtacgtaacgttactaaccggtaaaacgtaccgttacggtacggtaccgttcggaccctaccgtacgttccgttacgttacccg

SEQ ID NO: 234428 - DNA, 573 bp, Homo sapiens
  misc_feature: GYAE6OF02IQX4P.2.43.D10.1.454.CMB.1.raw
  modified_base (299)..(299): a, c, t, g, unknown or other
  misc_feature (299)..(299): n is a, c, g, or t
  modified_base (393)..(393): a, c, t, g, unknown or other
  misc_feature (393)..(393): n is a, c, g, or t
tcagacgctcgacacacgaccggtgctcgatttagactagcagtaagggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccggcaagtcacggccgttaacacctatttaaattggtatcagacaaaaaccaggggcacgcccctcagctcctgactctctgctgcatccagnttgcaggagtggccgtccatcgcgttcaggtggcagtggatcgtgggacagtatttcctccctcaccatcagctagtctgactaacgtgagttntttgactaacttcttctcgtacaacgagactacctaccacctacccgactaccttaccgtttcgacccggtaacggggtaacctacgggttacggtaccttaacgtaaccgaaaaacggttaaccgtacggttacggtaccgttacggaccctaaccgtactttccgttacgtttacccg

SEQ ID NO: 234429 - DNA, 571 bp, Homo sapiens
  misc_feature: GYAE6OF02IENRK.2.43.D10.1.454.CMB.1.raw
  modified_base (190)..(190): a, c, t, g, unknown or other
  misc_feature (190)..(190): n is a, c, g, or t
  modified_base (257)..(257): a, c, t, g, unknown or other
  misc_feature (257)..(257): n is a, c, g, or t
  modified_base (269)..(269): a, c, t, g, unknown or other
  misc_feature (269)..(269): n is a, c, g, or t
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
  modified_base (428)..(428): a, c, t, g, unknown or other
  misc_feature (428)..(428): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgngtcaccatcacttggccgggcaagtcaggccttaacaccttatttaaatggtatcagacaaaaacgngggcagcccctnagctcctgactctctgctgcatccagtattgcagagtcggccgtccatcgtcgttcagtggcagtggatcgtggactagtctttccncctcaccatcganctagtctgacaaacgtggaagttattttacgaccttaaactttcttctagtacaaacgngtaactcctaaccgaaccctaccccgtactacgttaccgtttcggacccgaaggggtaccaacgggtcggtaactaccgtaaacaaaaggtaccttaggtacggtaccgttacggaccctaaccgtacttccgttaggttccc

SEQ ID NO: 234430 - DNA, 620 bp, Homo sapiens
  misc_feature: GYAE6OF02JKV0Y.2.43.D10.1.454.CMB.1.raw
  modified_base (181)..(181): a, c, t, g, unknown or other
  misc_feature (181)..(181): n is a, c, g, or t
  modified_base (186)..(186): a, c, t, g, unknown or other
  misc_feature (186)..(186): n is a, c, g, or t
  modified_base (260)..(260): a, c, t, g, unknown or other
  misc_feature (260)..(260): n is a, c, g, or t
  modified_base (274)..(274): a, c, t, g, unknown or other
  misc_feature (274)..(274): n is a, c, g, or t
  modified_base (496)..(496): a, c, t, g, unknown or other
  misc_feature (496)..(496): n is a, c, g, or t
  modified_base (524)..(524): a, c, t, g, unknown or other
  misc_feature (524)..(524): n is a, c, g, or t
tcagacgctcgacacacgaccggtgctcgatttagactagcagtaagggagtctcaggcaggacacagcatggacatgagggtccccgctcagctcctggggctcctgctactgtgctccgaggtgccagatgtgacatcgacatgacccagtctccatcctcctgtctgcatctgtgganaccgngtcacctatcacttggccgggataacgtcaggtccgttaaacaccttatttaaatggtatcagacaaaaaccgngggcacgccctacngcctctgattctcgtgctcgacacttccaagtcttgactagtagtcggtaccgtaccctagtcccggtagttaccgagtcgggactaaggttggactcgtcggggaactacgtactttccctaccccgtacacccgtaatccgaatccgtacgttcgtacgaacgtaaacttggtaacggttcttttacggaccttaaacgtttctaccgttataccgaaancgtaagtaccttaacccacgtacccctntaaccttcgtttacgaccccgggaggttaacccgtaggtccgacttactaacgaaaacgtcgtcgtaggtcctacaccgacctagtcttaccgttc

SEQ ID NO: 234431 - DNA, 591 bp, Homo sapiens
  misc_feature: GYAE6OF02IX016.2.43.D10.1.454.CMB.1.raw
  modified_base (184)..(184): a, c, t, g, unknown or other
  misc_feature (184)..(184): n is a, c, g, or t
  modified_base (252)..(252): a, c, t, g, unknown or other
  misc_feature (252)..(252): n is a, c, g, or t
  modified_base (295)..(295): a, c, t, g, unknown or other
  misc_feature (295)..(295): n is a, c, g, or t
  modified_base (373)..(373): a, c, t, g, unknown or other
  misc_feature (373)..(373): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtacatcgacatgacccagtctccatcctccctgtctgcatctgtggganaccgagtcaccatcacttgcgggcaagtcaggccttaacacctattaaattggtatcagcaaaaaccnggggacagcccctcgacgctctgactctacttgctgcatcagntgcaggacgtcgctccagtccgcgttcagtgacgtggtacgtacgtcgttacggatacgttcttcctccacctcactnacgctgtcctagacaagtagtagttacttagtacttaccttacgtttctactaacgtatacgacgtacctaccgtaccacccgtacaaaccttttttcgaccccaccgggggtaacccgtaagtcgggtaacgtaccttccggtaaaagaaaacccgtttacgtggccggtttacgacgtacccccgtaatccttaccggttacgtttccctaaccgg

SEQ ID NO: 234432 - DNA, 751 bp, Homo sapiens
  misc_feature: GYAE6OF02JJ0X6.2.43.D10.1.454.CMB.1.raw
  modified_base (257)..(257): a, c, t, g, unknown or other
  misc_feature (257)..(257): n is a, c, g, or t
  modified_base (271)..(271): a, c, t, g, unknown or other
  misc_feature (271)..(271): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacaccttattaaattgtatcagacaaaaaccgngggacacgcccctnacgctcctagacttcctctgctcgactactccgaagtatttcggaccgtaaggtacggttacggggtccccgttaccccgaacgtttccgggtaccgggttttcgaaacggggtttccgggaccggtaaggggtttacgggtaacgtttccgggttaacgggggtaaccttaacgggtttacctttttccccgtaccccccttacgtaacccgtaacgttacccgaacggtaccgttaaccggttccgttaacggtaaccgtaaaacggttcgggtaaacggtttaactttttaccggaacctttaaaccgttttaccgttcgtacgttaaccaaacgtagaccgtacctaaccgtacccgtaccccgactaaccgttacctttcggaacccgaacgggggtacctagggttacggacttaccgtaaacgaaaagtccgttaggtaccgtactacgacctaaccgtacttcgtaccttac

SEQ ID NO: 234433 - DNA, 631 bp, Homo sapiens
  misc_feature: GYAE6OF02FV52L.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgcccgggcaagtcaggccgttaacaccttaatttaaattggtatcagacaaaaaccgaggggcacgccccctcagctcctgatctctgctgcatccagtattgcagagtggcgtcccatccgcggttcaggtcggcaggtggtatcgtagggacagtactttcctccctacacctatcacgtcagtctacgactaaacgtggtaacggttattttacgaccttaaactttaccttcgtacgtaccaaacgtagtaacgtaccttaacccaacccgttaacccccgacttaaccgttacccgttttaccggaccccggtaacggggtaacccgtaagggtcggtaacgttaccgtaaaccgtaaaaacggtaccgttaggtacggtaccgttacggaccctaacccgtacgtttaccgttcgttacccg

SEQ ID NO: 234434 - DNA, 585 bp, Homo sapiens
  misc_feature: GYAE6OF02H0G5R.2.43.D10.1.454.CMB.1.raw
  modified_base (212)..(212): a, c, t, g, unknown or other
  misc_feature (212)..(212): n is a, c, g, or t
  modified_base (266)..(266): a, c, t, g, unknown or other
  misc_feature (266)..(266): n is a, c, g, or t
tcagacgctcgacacacgaccggtgctcgatttagactagcagtaagggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccggganaagtcaggtccttaaacaccttaatttaaagttggtatcaagaccaaaaaccgnggggcaacgcccctcacgctcctgattctactgctcgctactccagattgcagagtggcctcccagtccggcggttcaggtggctagtggatcgtgggactagtctttcctccctctaacctagtaccaagctaacgtctagactaaactggaggttatttagaccttaatttacttactagtacaacgtaagacactaaccaccgtacccacctacctaccgtttaccgacccgtaacgggaccgtaagggtcgtaacgtacttaacgaaaagtacgtacggtcggtactcggaacccacctacgtccgtagttaccc

SEQ ID NO: 234435 - DNA, 634 bp, Homo sapiens
  misc_feature: GYAE6OF02HW7SW.2.43.D10.1.454.CMB.1.raw
  modified_base (210)..(210): a, c, t, g, unknown or other
  misc_feature (210)..(210): n is a, c, g, or t
  modified_base (259)..(259): a, c, t, g, unknown or other
  misc_feature (259)..(259): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctcctgtctgcatctgtgggagaccgagtcaccatcacttggccgggnaagtcaggccgttaacacctatttaaattggtatcaagacaaaaaccgngggacacgcccctcagctctgactctctgctgctatccagtacttgcaaggtaggtcgggccgtacccgtagtccggtcggttacgtaggtggaccgaggtcggattcggtagggactagttactttaccctccgtacctactactaccacgtaccgtagtccgtagaacctaaaacgtggtaaggttacttttcgaacctttaactttaccgtttctacgtaccaaacgagtaccgtaccttaacctaaccgtacccgacttaaccgttaccgtttaccggacccggtaacgggaaccgtagggtacggtacgtaacgtaacgaaaacggtaccgtaggtacgtcgtacgacccgtactacgttcgtcgttacc

SEQ ID NO: 234436 - DNA, 610 bp, Homo sapiens
  misc_feature: GYAE6OF02IA9BM.2.43.D10.1.454.CMB.1.raw
  modified_base (212)..(212): a, c, t, g, unknown or other
  misc_feature (212)..(212): n is a, c, g, or t
  modified_base (258)..(258): a, c, t, g, unknown or other
  misc_feature (258)..(258): n is a, c, g, or t
  modified_base (372)..(372): a, c, t, g, unknown or other
  misc_feature (372)..(372): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtggggagaccgagtcaccatcacttggccgggnaagtcaggccttaacacctaatttaatggtatcagacaaaaaccgngggcacgcccctcagctctgtatctctgctgccatccagattgcagagtcggcctcccgagtccggcggttcgaggtggctaggtggtactcggtcgggactaggtactttccncccttacacctatcgacgactagttcgtacgaacaacgttacggtaaggttactttacggacctttaactttacttcttagtaccaacgtaagactaccttaccacccgttacccgtacctaccgttaaccgtttccggaacccggtacgggtaaccgtagggtacggacttaccgaacgtaaaacgtaccgttaggaccggtacgtcgaccgtacccgttattacccgtcgttaccc

SEQ ID NO: 234437 - DNA, 588 bp, Homo sapiens
  misc_feature: GYAE6OF02G0309.2.43.D10.1.454.CMB.1.raw
tcagacgctcgacacacgaccggtgctcgatttagactagcagtaaggggagtctcaggcaggacacagcatggacatgagggtccccgctcagctcctgggggctcctgctactgtggctccgaggtgccagatgtgacatcgacatgaccccagtctccatcctccctgtctgcatctgtgggagaccgagtcaccatcacttgccgggcaagtcagggccgttaacaccttaatttaaattggtatcagacaaaaaccaggggcacgcccctcagctcctgatctctgctgcatccagattgcagaggtcggccgtcccatccggcggtttcaggtcggcaggtggatcgtggggacagtactttcctccctcacctatcacgcagtctgacaacgtgagtatttgactactttacttctcgtacaacagacgtacctaccaccctaccccgccaaccgttacttttaccggacccggtaacggggaacccgtaagggtacggtaacttaccgtaaacgtaaaacggtaaccgttcggttacggacgttacggaccctaaccgtaccttaccgttacggttaccc

SEQ ID NO: 234438 - DNA, 888 bp, Homo sapiens
  misc_feature: GYAE6OF02JLMOJ.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggacgaccgagtccaccatctacgttcggcccggggacaacggtccagggtaccccgtttaaaccaaccttaacttttaaagttgggtaattccgaacgtaaccaaaaaacccggaggggaccacgacccccgtcgaacgtccttcccgtagtaccttcgtcgtcgcctggacctacgtaccctaaggtacgtttcgacgtaacgggtaacggttccggggtaccccgttacccccgtaaggtttcccggtacccgggtttacgtaccggggttacgggaccgttaaggggtttcggtaacggtttccggttacgggggaaaccgtttacggttaaccgtttttccccgttacccccgttaaccgtaacccgtacgtacccgtaacggtccggtaacggttaccgtacggtaacctaaaccggttaacggtaacggtttaccgttttacggtacctttaaacccgtttaccgtttaccgttaccgttaccgtaaccgtacggtaaccgaccgttacccctaaccccgttaacccccgtaccttaacccgttaaccgttttacccgggaacccgggttaaccgggggtaacccgtaacgggggtttaccggaacgtttacccggttaaacgtaaaacggtaacccggtttacggtacggttaccggtaccggtaccctaaccgtttaccgttcgtttaccgttacccg

SEQ ID NO: 234439 - DNA, 726 bp, Homo sapiens
  misc_feature: GYAE6OF02GBGQD.2.43.D10.1.454.CMB.1.raw
  modified_base (260)..(260): a, c, t, g, unknown or other
  misc_feature (260)..(260): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggtccgttaacaccttatttaaattggtatcagacaaaaaccgnggggacacgcccctcagctacctgatctctgctcgacactccgaagtacttgacaggtacgtcgggccgttacccgagttccggtaccggtttcgtaagggtcgggtacctagggttcggtagttccggtaggggaaccgtacgttacttttccccgtaccccgtacaacccgtaactcgaacgtctaacggttccgtagtaacctaaaccgttagggtaggtttaacttttacggaaccttaaccgtttaccttcgttacgtacctaaacgacgtaacgtacccttaaccgtaacccgtaaccccgtacttaacccgtttaaccgttttaccggaaccccgggttaacggggtaacccgtaagggttacggtaaccgttaacccgtaaaccgtaaaacgggtaaccgttcgggttacggtaccgttaccgtaccctaacccgtactttaccgtacgttttacccg

SEQ ID NO: 234440 - DNA, 732 bp, Homo sapiens
  misc_feature: GYAE6OF02JS81V.2.43.D10.1.454.CMB.1.raw
  modified_base (259)..(259): a, c, t, g, unknown or other
  misc_feature (259)..(259): n is a, c, g, or t
  modified_base (305)..(305): a, c, t, g, unknown or other
  misc_feature (305)..(305): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggtcaagtcaggccgttaacaccttatttaaatggtatcagtacaaaaccgnggggacacgcccctacacgtcctctgactctctgctgcatccagtnttcgcagtagtcggccgtacccagtccgtcgttcaggttggactaggttggacttcggtggggactacgtacgtttccctcccgtactaccgtagtccgaacggtcctaacgttccgtacgaaccgtaaacggttcggtaacgtttacgttttaccggaacctttaaacctttaccgttttaccgtaccggttaaccgtaaacgtacggtaaccgttacccttaacccgttaaccccgttaaccccccgtaccgtaaacccttttcccggtttttaacccggaccccggggttaaacccggggtaaccggttaaccgggttacggtacccgttaaaccgtaaacccgtaaaaggttacccggtttcggtaccggtaccgttacggaacccgttaaccgtaaccgttccgtttaccgggtttaacccc

SEQ ID NO: 234441 - DNA, 521 bp, Homo sapiens
  misc_feature: GYAE6OF02IL5T2.2.43.D10.1.454.CMB.1.raw
  modified_base (210)..(210): a, c, t, g, unknown or other
  misc_feature (210)..(210): n is a, c, g, or t
  modified_base (449)..(449): a, c, t, g, unknown or other
  misc_feature (449)..(449): n is a, c, g, or t
  modified_base (515)..(515): a, c, t, g, unknown or other
  misc_feature (515)..(515): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggnaacgtcacggccgttaacacctaatttaaatggtatcagacaaaaaccaggggcaacgcccctcagctcctgactctctgctgcatccagattgcagagtggccgtccatcggcgttcagtgctagtggatcgtgggacagtactttccgtccctcacctattcagtcagtctgacaaactggaaggtatttcggactaactttacttctagtcaaacgagacgtctacactaccccgnacttcttcgaccgagggaccaggtcgtagtctaaccgaaaatcgtagtgctcgaccacacgttccngttccc

SEQ ID NO: 234442 - DNA, 726 bp, Homo sapiens
  misc_feature: GYAE6OF02IW6NZ.2.43.D10.1.454.CMB.1.raw
  modified_base (279)..(279): a, c, t, g, unknown or other
  misc_feature (279)..(279): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttcggccgggcaagtcgacggccgttaaacaccttaatttaaagttggtatcagaacaaaaaccgagggcacgccctnacgctcctgactctctgctgcactccagtattgactaggacggtcggccgtacctacgtcggtccggttcaggttcgggacgtagggttcggacgttacggtcggggtaactaggttaaccttttccgtccccgttaaccgacctaacgttaccgtacgacgttacggttccgtacggtaaaccgtaaacgttacgggttaacggttaagtttttacgtaccgtttaaaaccttttaccgtttaccgttacgttaaccgtaaaccgtacgtaacgttacccgttaaacccgaacccgttaacccccgacttaacccgttaccgtttttacccgggacccgttaaccggggtaaccgtaacgggtacgtaacgtaaccgtaaacgtaaaaccgtaacgttacgtacggtacctacggtaccctaaccgtacgttaccgtgtttacccg

SEQ ID NO: 234443 - DNA, 723 bp, Homo sapiens
  misc_feature: GYAE6OF02JUKOO.2.43.D10.1.454.CMB.1.raw
  modified_base (98)..(98): a, c, t, g, unknown or other
  misc_feature (98)..(98): n is a, c, g, or t
  modified_base (223)..(223): a, c, t, g, unknown or other
  misc_feature (223)..(223): n is a, c, g, or t
  modified_base (347)..(347): a, c, t, g, unknown or other
  misc_feature (347)..(347): n is a, c, g, or t
  modified_base (690)..(690): a, c, t, g, unknown or other
  misc_feature (690)..(690): n is a, c, g, or t
tcagacgctcgacacacgaccggtgctcgatttagactagcagtaaggggaggtcgtcaggcaggacacagcatggacatgagggtcccgctcacgcnccctggggctcctgctactgtggctccgaggtcgccaggatcgtggaccatccgacagtgaccccagtcctccgatccctcctggtctgacctatctggttcgggagacccggtatccgaacctntcgactttgcccgggggtcaaaggttccagggtaccccttaacgaccttatttaaacgtggtattacacgacaaaaccgtggacgactccccgtacagacctcgtcgactccggtactcgtacncgtacctacgtcctacgtacgttcgcttaaggaacggtcggttacccgacccgtcgttaccggccggtttacccgaagggttccgggattaccgggtaggtaacgtaccggttggggaaaccctgggtaacccttttccgtacccttacccgtacctaacgtactaccgtacgtaaccggtcgttaaccgaggttaaaccctaggttacgtaaagttccggttactaacgttacttactgtactactagacgtactaccgacctcccgactaccttaaccgttccacggtaccggacgtacgtacggtaacctcgttaaaccaacggtaaactcggtaaccgngttacgacccaacggttctaccggttacttccg

SEQ ID NO: 234444 - DNA, 720 bp, Homo sapiens
  misc_feature: GYAE6OF02JX3DS.2.43.D10.1.454.CMB.1.raw
  modified_base (255)..(255): a, c, t, g, unknown or other
  misc_feature (255)..(255): n is a, c, g, or t
  modified_base (603)..(603): a, c, t, g, unknown or other
  misc_feature (603)..(603): n is a, c, g, or t
  modified_base (700)..(700): a, c, t, g, unknown or other
  misc_feature (700)..(700): n is a, c, g, or t
tcagacgctcgacacacgaccggtgctcgatttagactagcagtaaggggaggtctcaggcgaggacacagcatggacatgagggtcccgctcagctcctggggcgtcctgctactgtggctccgaggtgccagatgtgacatcgacatgacccagtctccatcctccctgtctgcatctgtgggagaccgaggtccacctatcacttcggccgggcaaaggtcacgggccttaacaccttattaaattaggttntactacgactaaaacaggggcacgaccccgtcacgtcctcctcgactctcgtcgccttagcctataccctaaggtactcggtcaggtacggttcggaccggttcccaacgttccggtaccgggtttactaacggttcggggccgtaggttacgggactttccgggtacgggaacgtaacgttaacgttttcccggtaccctttcccgtaacgtaacttcggacgtacgttaacggtccttaagtaacccgtaaacggttacggtacgggttacgtttcggacttaccgtttaacttccgacgttcaaccgttagacgtactacccgtactaccccgcgttaaaccctnttttacccgacccgggaagggtaacccagggtttacggacgttaaccgttaacccgtaaaaagtacgttcgggtacgtaaccgttggaacccccttnaaggtttccctacggtttcc

SEQ ID NO: 234445 - DNA, 695 bp, Homo sapiens
  misc_feature: GYAE6OF02G9JF4.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctaatttaaattggtatcagaccaaaaaccgaggggcacgcccctcagccttcctgactctctgctgctatccagtattgcaggtagtcggccgtccccgagttccggtccggtttcagggtcggacgtaggtcggtactcggtaggggactacgtacttttacccgtcccctaccgtaacccgtactaccgtacgtccgtaacgttccgtacgtaacctaaaccgttaggtaacggttattttacggtaacctttaacctttaccgttaccgttacgtaccaaaccgtacgaaccgttacccttaaccgtaacccgttacccccgtactaacccgttaccgttttaccggaccccggtaacggggtaacccggtaggttacggtaacgttaacctaaccggaaaacgttacgtacggttaccggtaccgttacgacccgtaacccgtacttaccgttcgttacccg

SEQ ID NO: 234446 - DNA, 639 bp, Homo sapiens
  misc_feature: GYAE6OF02IOU2E.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatccctccctgtctgcatctgtgggagaccgagtcaccatcacttgccgggcaagtcaggaccgttaacaccttaatttaaattggtatcagacaaaaaccaggggacacgcccctacagctcctgactctctgtctgcactccagtattgcaggagttcgtccgtccctagtccggtcggttacgaggtcggacgtaggtggactcgtagggaactagtactttccctccctactaccatcaagctagtctagactaaacgtgaacggttactttacgacttaaactttaccttcgtacgtacaacgtacgtacggtactaaccgtaacccgtaccccgtactaccgtttaaccgttttaccggaaccccgggtaacggggtaaccgtaacgggttacggtaacttacgtaaaacgaaaacggttaccgtaggttaacggtacctacggtacccaacctaacgttcgttagtttacccc

SEQ ID NO: 234447 - DNA, 666 bp, Homo sapiens
  misc_feature: GYAE6OF02I5OD1.2.43.D10.1.454.CMB.1.raw
  modified_base (193)..(193): a, c, t, g, unknown or other
  misc_feature (193)..(193): n is a, c, g, or t
  modified_base (274)..(274): a, c, t, g, unknown or other
  misc_feature (274)..(274): n is a, c, g, or t
  modified_base (367)..(367): a, c, t, g, unknown or other
  misc_feature (367)..(367): n is a, c, g, or t
  modified_base (401)..(401): a, c, t, g, unknown or other
  misc_feature (401)..(401): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatccctccctgtctgcatctggtagggacaccgngtccaccatcacttcggccgggacaagtcgacggtacccttaacaccttaatttaaagttggtactcacgacaaaaaccgnggggacaacggcccctacagtcctccgtagactcctcgtcgctcgactactccagtattcgacagagtcggccgtccagtcggtcgtgacggnggctaggtgacgtcgtaggtactagtctttcccnccctcgtacctatacgacgtacgtagtcctacgaacctaacgttaggtacgttaagtttcgtaaccgttaaacttttcttaccgttacgtaacctaaacgtaggtaaccgtacccttaacccgtaacccgttaaccccggtacctaaccgtttacctttaccggaacccggtaacggggtacctaacgggtacgtacgtaacgtaaaccgtaaaacggtcgttacggtacgtactccggaacctaccgtactcggtaccttaccg

SEQ ID NO: 234448 - DNA, 512 bp, Homo sapiens
  misc_feature: GYAE6OF02IMD0U.2.43.D10.1.454.CMB.1.raw
  modified_base (317)..(317): a, c, t, g, unknown or other
  misc_feature (317)..(317): n is a, c, g, or t
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggtccgttaacaccttaatttaaacttggtatcagtacaaaaccgagggcacgcccctgacgctctgactctctgctgacatcagtattgcagagtcgccncatcgcgttcagtcgcngtgatcgnggactagtacttcncctcactancagcgatctagacaacgtgagtatttgactacttactcgtcgtacaagagatactacaccgtacccgctactactttcgaccgtacggtacaggtacgtacgtctaacaagtacgtagtaggtctacgtaccactactactagttac

SEQ ID NO: 234449 - DNA, 658 bp, Homo sapiens
  misc_feature: GYAE6OF02I3XFL.2.43.D10.1.454.CMB.1.raw
  modified_base (299)..(299): a, c, t, g, unknown or other
  misc_feature (299)..(299): n is a, c, g, or t
  modified_base (447)..(447): a, c, t, g, unknown or other
  misc_feature (447)..(447): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctggtgggacaccgagtccaccatccacttggccgggacaaggtcacgggccgtttaaacaccttaatttaaaagttggtaacttcaacgaaccaaaaaaccgtggggaccaacggcccctanaccgtctcctagactctctcgctgcactcagatcgcagagtcggcctccagtccgtcggttacgagtcggactaggtcggacttgacgggtactagtacgtttcctcccgtactacagttaccagtaccgagttctagacctaaacgngggttaagtactttaggaccttaaactttacgttacgtacgttaccgaacgtaagactaccgttaaccacccgttacccgacttaacccgttactttaccccggaaccggtaacggggtaacccgtaagggtaccgtaacgttaaccctaaagtaaacgaccgtttagggccgtaacgttcgacccgtaactacgttaccgttagttaccc

SEQ ID NO: 234450 - DNA, 586 bp, Homo sapiens
  misc_feature: GYAE6OF02IHJZY.2.43.D10.1.454.CMB.1.raw
  modified_base (335)..(335): a, c, t, g, unknown or other
  misc_feature (335)..(335): n is a, c, g, or t
  modified_base (473)..(473): a, c, t, g, unknown or other
  misc_feature (473)..(473): n is a, c, g, or t
tcagacgctcgacacacgaccggtgctcgatttagactagcagtaaggggagtctcaggcgaggacacagcatggacatgagggtccccgcctcagctcctggggcgtcctgctactgtggctccgaggtgccagatgtgacatcgacatgacccagtctccatcctccctgtctgcatctgtgggagaccgagtcaccatcacttgccgggcaagtcacggccgttaacaccttatttaaattggtatcagacaaaaaccgagggcaacgcccctcagcctcctgctctctgctgcactccagattgcagagtggcctccatcgcgtcagtcgnaggtgatcgtgggacagtatttccctcctacactatcacgctacgtctggaccaaacgttggaggtacttttggaaccttaactttacttcgttacgtccaaacgtgtaacctacctaaccctaccgtaaccccccgntaaccgtttaacccgtttcggaccccgtaacggggaccgtaacgggtcggtacacgttaaccgaaaaggtacgttcggtacggtctcgtacccaacgtacttccgtgttaacc

SEQ ID NO: 234451 - DNA, 761 bp, Homo sapiens
  misc_feature: GYAE6OF02G8626.2.43.D10.1.454.CMB.1.raw
  modified_base (146)..(146): a, c, t, g, unknown or other
  misc_feature (146)..(146): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacntgacccagtctccactccctcctgtctgcatctggtggacgaccgagtccacctatcacgttcggaccgggactaacggtccgacgggtacccttaaaccaacctttaaaggttttaaaagttcgggtaacttaccgaacgtaaaccgaaaaaaccggtacggggaccaaccggtcccccgtaacgaacgtcccgtaccgtacgaacttcctacgtccgtctcggtacctaaccgtctaagtacgttacgacgtacggtagtccgggaccgtacccgtacggtccggtcggttacgacgggttcgaccggttaggtacggtactcggtagggactaacggttactttacctccctaccgtaccgtactaccgagtccgtaacgtcgttacgaacgttaaagtcggtaaggttactttacgtaactttaaccgttcttaacgtcgtacaacgtaaggtacctacctaacccgtacccgtacccgaccttaacgtttaaccttacccggacccgggaacgggttaacccgtacggggacttaaccggtaactaaccgtaaaacggtcgttacggtaacgtccgtaacggaaccctaccggtacttgtaccctttacg

SEQ ID NO: 234452 - DNA, 900 bp, Homo sapiens
  misc_feature: GYAE6OF02IDV25.2.43.D10.1.454.CMB.1.raw
  modified_base (127)..(127): a, c, t, g, unknown or other
  misc_feature (127)..(127): n is a, c, g, or t
  modified_base (242)..(242): a, c, t, g, unknown or other
  misc_feature (242)..(242): n is a, c, g, or t
tcagacgctcgacacacgaccggtgctcgatttagactagcagtaaggggagtctcaggcaggacacagcatggacatgagggtccccgctcagctcctggggctcctgctactgtggctcgaggtnccagatgtgacatcgacatcgacccagtctccatcctcctgtctgcatctggtagggacgaccgagtccaccagtctacggttcgccgggacaaggtcacgggtacccgttaaanacccttaagtttaaattcggtaacttcaacgaacgaaaaaacccgaggggtaccacggtacccctcgaacgtctccgtggtaacctctccgtgtccgtcgtacgtacctaccgtaagtacgtttcgacgaacggtaacggttcggtccgttacccgtacggttaccgggtaccggtttaccggtaggttcgggaccgttaacggtcggtacgttacgggtaacgggggtaaccctaagggtttacctttttaccccgtaccccgtttaacccgtaaccgttaacgtaacccgttaaccgggtaccctttaacgggttacccgttaacgaaacccggttaaaaacggtttcggggtaaacggtttttaacgtttttaaccgggtaaacccttttaaaccgtttttaaccgttaccggtttaaccgggtaactaaaaccgggtaacgttaaccggttaacccttaacccgtaaaccccgtaaccccggttaactttaacccgttttaaccggtttttaccggaaccccgggttaaaacggggtacccgtaagggggttaaccggttaacgttacccggtaaacgttaaaaacggtaccgggttagttaccggtacgtacgttacccggtaaccgtactttacccggttagttttaacccg

SEQ ID NO: 234453 - DNA, 739 bp, Homo sapiens
  misc_feature: GYAE6OF02I7ZHI.2.43.D10.1.454.CMB.1.raw
  modified_base (128)..(128): a, c, t, g, unknown or other
  misc_feature (128)..(128): n is a, c, g, or t
  modified_base (187)..(187): a, c, t, g, unknown or other
  misc_feature (187)..(187): n is a, c, g, or t
  modified_base (192)..(192): a, c, t, g, unknown or other
  misc_feature (192)..(192): n is a, c, g, or t
  modified_base (213)..(213): a, c, t, g, unknown or other
  misc_feature (213)..(213): n is a, c, g, or t
  modified_base (264)..(264): a, c, t, g, unknown or other
  misc_feature (264)..(264): n is a, c, g, or t
  modified_base (277)..(277): a, c, t, g, unknown or other
  misc_feature (277)..(277): n is a, c, g, or t
  modified_base (284)..(284): a, c, t, g, unknown or other
  misc_feature (284)..(284): n is a, c, g, or t
  modified_base (304)..(304): a, c, t, g, unknown or other
  misc_feature (304)..(304): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtnccagatgtgacatcgacatgacccagtcctccatcctccctgtctgcatctggtggganaccgngtcacatcacttggccggganaagtcacggtccgttaacaccttaatttaaatggtatcagaaccaaaacgngggcacgcccctnacgctcngactctctgctgcactcagnttcgacaggagtcgccgtccagtcggcgttcgacggtcgcgtaggtcggtactcggtacggggactaggttacctttcccgtacccttaccgtaacctacgtaccgtaaccggtaccgttaacggttacttaccgtaaccgtaaacggttacgggtaaacggttttacgtttaccggtaaccctttaaaccgttttcccgtttaaccgttaaccgttaaaccgaaacgttaaccggtaacgttaacccctaacccgttaaaccccgggttcccctaaccgttaacccgtttaacggtttccccggaaccgggtaaccgggtaaccgtaacgggttacgtaacccgttacgtaaacccggtaaaagttaccggttacggtaccggttacctaccggtaacccgttaacccgtacgttttaccgtcgtttaaccccg

SEQ ID NO: 234454 - DNA, 590 bp, Homo sapiens
  misc_feature: GYAE6OF02IDJTC.2.43.D10.1.454.CMB.1.raw
  modified_base (259)..(259): a, c, t, g, unknown or other
  misc_feature (259)..(259): n is a, c, g, or t
  modified_base (273)..(273): a, c, t, g, unknown or other
  misc_feature (273)..(273): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctcctgtctgcatctgtgggagaccgagtcaccatcacttgccgggcaagtcaggccgttaacaccttaatttaaattggtatcagacaaaaaccgnggggcacgcccctnagctctgactctctgctgcatccagtattgacaggagtcggccgtccagtcgcggttcaggtcggcaggtggatcgtgggactagtctttccgtccctacacctatcacgctacgtctacgacaaacgtggagttatttacgactaacgtttacttctacgtacaactagacgtacctaccacccgtaccccgtctaaccgttaccgtttcggaacccggtaacggggtaccgtaagggttcggtaactccgtaaacggaaaacgtacggtacggtacggtccgtacgaccctaaccgtacgttaccgtcgttaccc

SEQ ID NO: 234455 - DNA, 796 bp, Homo sapiens
  misc_feature: GYAE6OF02HTLZS.2.43.D10.1.454.CMB.1.raw
  modified_base (173)..(173): a, c, t, g, unknown or other
  misc_feature (173)..(173): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcctgatcgacccagtcctccatcctcctgtcngcatcgtgtagagacagacgtccaccatccacgttcggaccgggacaagtccgaaggacgtctaattaggctaagtctttaaagttttaaagtttaggtacttacgaacgaccgaacggaaaaccgaaaggggtaaaccacccccttaaaacgttcccgtaggtaacttcgttaacgttacggtttaacacttaccgtagttttacgacgtaaaacgggttcggggtaccctaagttacgtaaggtttccgtaaggtcggtacgtagggtacggtacttacggtaggggaactaggtttaactttccaacttccctacgacctagttacacggtaacgttcgtaccgtacgtacctaaacgtacggtaaaggtttacttttaccggaactttaaaccgtttacgtaccgttacggttaaaccaaacgtaacgttaacggttaacccgtaacccggtttaccccggtacggggtaacccggtttaccgggaaccgttaaacgggggaacctaaaaggggttaacgaacgtaaccgtaaacggtaaccggttgaaccgggtactaaccggtacaaccgttccgttacgttaccgttacctttaaccgtccgttacccttaccccg

SEQ ID NO: 234456 - DNA, 680 bp, Homo sapiens
  misc_feature: GYAE6OF02GAGV5.2.43.D10.1.454.CMB.1.raw
  modified_base (185)..(185): a, c, t, g, unknown or other
  misc_feature (185)..(185): n is a, c, g, or t
  modified_base (272)..(272): a, c, t, g, unknown or other
  misc_feature (272)..(272): n is a, c, g, or t
  modified_base (314)..(314): a, c, t, g, unknown or other
  misc_feature (314)..(314): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtggganaccgagtcaccatcacttgccgggcaagtcaggccgttaacacctaatttaaattggtatcagaccaaaaacgagggcacgcccctnacgctcctgactctcgtagctgcactccagtacttgacaggngtcggccgtcccagtccggtacggtttcgaggttcggcgtaggtggagttcgacgggtactaaggttactttcctaccctacgaccctataccgagcctaagtccgtacgaaccgtaaacgtcggtaaggttactttacgaacctttaaacgttttacgtttccgtacgttacctaaagtacgtaccgtaaccttaacccgtaacccgtaccccgttaactaaccctttacggttaccccggaacccggtaaccggggaacctagggttacggtaaccgttaaccggttaaaacaaaaccgggttacctacgggttaccgttaccgacgtacccgttaacgtaccttaccggttactttaaccccg

SEQ ID NO: 234457 - DNA, 733 bp, Homo sapiens
  misc_feature: GYAE6OF02FPK6W.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtcctccatcctccctgtctgcatctgtgggagaccgagtccaccatccgacgttggcccgggacaaacgtccgaacgggtacccgttaaacaccctttaagttttaaacgttgggtaactacgaacggaacctaaaaaaccggagggggaccacggtcccccctacgaacgtcctccgtagtacttctcgtgtctcgacctactaccgagtacgttcggacgacggtacggtcgggtaccgtacccgtagtccggtcggttcgaggtcggacgtaggtacggtacgttcggtacgggtaactacggttactttccctacccttacgaacctacgtacacgtaccgtacgtccgtacgtaccgtaaacgtcggtaagttacgtttacgtaacttaacctttaccgttcgttacgtaactaacgtacgtaacgtaccctaaccgtaccctaccccgtaccttaccgttaccgtttacccggacccggtaacggggtaacccgtagggtacggtaacgtaaccgtaacgaaacgtacgttacggtacgtacgtaccgtaccgacctacgttcgtacgttacc

SEQ ID NO: 234458 - DNA, 723 bp, Homo sapiens
  misc_feature: GYAE6OF02JUS5H.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggcctcgaggtgccagatgtagacatcgacatgacccagtcctccacttccctccctgtctgcatctggtagggacgtaccgagtccacctatcacgttcggccggtacaaggtccacgggtccctttaacaaccttaatttaaagtcggttactctaagaacctaaaaccggagggtaccaccggccccctagacgacctcctagtactacctctcgacctgccgtaacctcgtacgtagttagcgtaaggtacgtcggtaccctcccgtacggtccgtcggtttacgacggttgaccggtaggtacggtacgtcggtacggtactacgttaccttacctaccccgtctaccactaccgtacgtccgtacgtcgtaccgtaactacgtaagtacgttacgttaccgtaactttaaccgtactttcgtaaccgttaccgaagtacgtaccgttaacccgtacctccccgttaaccgccgtttaaaccttccggttacccgaaccggtaacgggaacccgttagtacgttaactccggttaaacgaacgtaaccgggttacgtacgtacccgtcggtacctaaaccgtcgtttaccgtactttaccgg

SEQ ID NO: 234459 - DNA, 639 bp, Homo sapiens
  misc_feature: GYAE6OF02IVLBY.2.43.D10.1.454.CMB.1.raw
  modified_base (184)..(184): a, c, t, g, unknown or other
  misc_feature (184)..(184): n is a, c, g, or t
  modified_base (265)..(265): a, c, t, g, unknown or other
  misc_feature (265)..(265): n is a, c, g, or t
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatccctcctgtctgcatctgtgganaccgagtcaccatcacttgccggcaagtcaggtccgttaacacctatttaatgtatcagacaaaaccgagggcacgccctnagctcctgactctctnctagcatccganattgaccagtagtcggccgtaccagtccggtggtcaggtcggactaggtggtactcgtagggactagtactttctcccttacgacctataccgtagcgttacgtactgaccgtaaacgttggaacggttactttcggaaccctttaacctttacggttaccttacgtaacaaccgtaaggaccgttaaccctaaccctaacccgtacccccgacttaacccgtttacgtttccgaaccccggttacggggtaaccgtacgggttaccgtaacggtaaccctaacggtaaacgtaacgttcgggtacgtcgttaccggaccaaccgttccgtaccgttgttaacccg

SEQ ID NO: 234460 - DNA, 795 bp, Homo sapiens
  misc_feature: GYAE6OF02G7GEH.2.43.D10.1.454.CMB.1.raw
  modified_base (268)..(268): a, c, t, g, unknown or other
  misc_feature (268)..(268): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatccctccctgtctgcatctggtgggacaccgagtccaccatcacttcggccgggacaagtcacggtccgttaacaccttaatttaattggtatcaagacaaaaaccgngggacacgcccctgacgcctctgtactctctgctcgctactccgagtattgacgaaggtaggtcgggtcccgtacccgtgttccggtaccggttacgagggtacggcggtaggttacgggtaacttcgggtaggggtaacgtacgtttaccgtttaccctcccccgtttacaacccgtacgtacctacggtaccgtaacgttccgtacggtaaaccgttaaaacgttcgggttaaacggttttactttttaacggaacccttttaaaaccgttttaccgtttaccgttaaacgttacgtaaaccgtaacgggtaaccctaccttaaacccgtaccccttaaacccccgtacgttaaacccgttttacccgtttacgggtaacccccgggtaaacggggtaacccgttaacggggttaccgttaaccggttaacccgtaaaacggttaaaaaccggtaccggttacgggttaaccgtaccggttaacccgtaacccgtaccggttacgtttaccgtaccgtttaaccg

SEQ ID NO: 234461 - DNA, 787 bp, Homo sapiens
  misc_feature: GYAE6OF02IF5X1.2.43.D10.1.454.CMB.1.raw
  modified_base (194)..(194): a, c, t, g, unknown or other
  misc_feature (194)..(194): n is a, c, g, or t
  modified_base (264)..(264): a, c, t, g, unknown or other
  misc_feature (264)..(264): n is a, c, g, or t
  modified_base (279)..(279): a, c, t, g, unknown or other
  misc_feature (279)..(279): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatcgacccagtctaccatccctccctgtctgcatctgtgggacgaccgntccacctatcacgttgccgggacaacgtcaggtacctaacacttattaagtgtactcagaacaaaaccgngggacacgcccctanacgtctcgtgactctctgctgctctaccatatcgacgtaggacgtcggcctccgagtccggtcggttacgagggtcggtacgtacggtggttactacgggtacgggtaacctacggttttaccctttcccgtacccctaccgtaaccctagtacccggaaacggtccgtacggtaaccttaccggtaaaccgtaaacggtacgggttaacgggttttactttttaccgggtaaacccttttaaaccttttaccgtttacgttaaccggttaaaccgaaaccgttaacggtaaccgttaacccgttaacccgtaaccccgtaaccccgttaaccgtaaccccttttaaccggtttaccccgggaaccccgggttaaccggggtaaccggttaacgggtaaccgttaacggttaaccctaaaacggtaaaacggttaacccgtaagggtaccgggtcccgttaaaccggaccccgttaccgtaaaccgttttccggtaccgtttaccccg

SEQ ID NO: 234462 - DNA, 581 bp, Homo sapiens
  misc_feature: GYAE6OF02FRRFN.2.43.D10.1.454.CMB.1.raw
  modified_base (245)..(245): a, c, t, g, unknown or other
  misc_feature (245)..(245): n is a, c, g, or t
  modified_base (257)..(257): a, c, t, g, unknown or other
  misc_feature (257)..(257): n is a, c, g, or t
  modified_base (287)..(287): a, c, t, g, unknown or other
  misc_feature (287)..(287): n is a, c, g, or t
  modified_base (311)..(311): a, c, t, g, unknown or other
  misc_feature (311)..(311): n is a, c, g, or t
  modified_base (329)..(329): a, c, t, g, unknown or other
  misc_feature (329)..(329): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctgtgggagaccgagtcacatcacttgccggcagtcagccttaacactattaatgtatcagacaaaacngggcacgccctnacgctcctgatctcgtgctcgcatccagtnttgcagagtggctccatcgcgttnagtggcaggtggattcgngggacagtacgttccttccccactacccatcgacgcgtagtcctaggacctaaacgtggtaaggttacttttcggaaccttaacttttaccttccgtagtaccaacgaacgtacgtacctacctacccgtaaccccgctaaccgttacctttcggacccgaacgggtaaccgtagggtacgtacgtaacctaacgtaaaacgtaccggttagtacggtccgtacgacctaaccgtacgttccgttacgttcc

SEQ ID NO: 234463 - DNA, 695 bp, Homo sapiens
  misc_feature: GYAE6OF02IP2ZT.2.43.D10.1.454.CMB.1.raw
  modified_base (128)..(128): a, c, t, g, unknown or other
  misc_feature (128)..(128): n is a, c, g, or t
  modified_base (307)..(307): a, c, t, g, unknown or other
  misc_feature (307)..(307): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtnccagatgtgacatcgacatcgacccagtctccattccctccctgtcctgcactcgtgtgggacgacccgagtaccaccatccacttggcccggctaagtcgacggtacccgttaacaaccttaattttaacgttggtactacgaagaaccaaaaaccgacggggacaaccgcccccgtnacgcctacctcgactcctctacgctcgacactccagtattcgcgagaggtcggcctcccgacgtccgtcggttcgtacggtcggaccgtaggtacggtacgtacggtacgggaacctaggttacctttcccttaccctccgtaaccacgtcgacgacgtacgtctacgaacgtaaactacggtaagtacgttttacgaactttaacccttcgtttacctacgtacaacgtacgtactaccgtaacccacccttaacccgcctaacctttaacccggttaccgaacccggtaacgggtaaccggtaacgttacgggtacttaaccgaaccgtaaacggtaaccgttacggtacgtacgtaccggcctaaccgtactaccgttagtaccc

SEQ ID NO: 234464 - DNA, 785 bp, Homo sapiens
  misc_feature: GYAE6OF02F6K5M.2.43.D10.1.454.CMB.1.raw
  modified_base (92)..(92): a, c, t, g, unknown or other
  misc_feature (92)..(92): n is a, c, g, or t
  modified_base (132)..(132): a, c, t, g, unknown or other
  misc_feature (132)..(132): n is a, c, g, or t
tcagacgctcgacacacgaccggtgctcgatttagactagcagtaaagggggtaggtctcaggcaggacacagcatggacatgaggtcccgntcgacgctcctggggctcctggctactgtgctccgaggtnccagatgtgactatcgacatcgaccagtctaccatcctcctgtcctgcatcgtgtggacgaccgagtacaaccatctacttcggccgggactaagtccgacggtaccttaaacacttaatttaaatcggtaatcgaagtaaccaaaaacgtagggtacaacgtacccctacgaaggtacctaaccgtggaactcttactggtacttgaccatttacccgaagttacttgaccgtaaaggtacggttgggacccgtaaccgtacgggttcccgtacggtttacgaggttcggacgtaggtaggtacgtcgtaacgggactaacggttactttccctaaccgttacaaccctactaccgaaacgtaccgtacgttccgtaagtaacctaaacggttcggtaaacggttagttttacgaaccgtttaaaccttttacgttaacccttaaacgtaacccttaaaggaacctaacgttaacttaacccgttaaacccttaaccccggtactttaacccgttaaccgttttaccgggaaacccggtaacggggttaacctaacggggtacgtaacgttaacggtaaaaccgtaaaacgtaccgttaaggtaccgtacgttacggtaacccgtacctttaacgttcccttaggttaaccc

SEQ ID NO: 234465 - DNA, 813 bp, Homo sapiens
  misc_feature: GYAE6OF02IKBZT.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccattccctccctgtctgctattcgtggtgggacgaccgtagtccaccatcacttggccgggacaacgtcgacggtaccgttaaccaccttaatttaatggtaactcgagaaccgaaaaccgcggggccacgccctacgagcctccgtcgactcgtacgtcgtcgttacgacctacgtcctaaggttacgttcgaccgtaacggtacggtccggtcccgttacccgtacgttccgggttacggttaccgtacgggttcgggacgttacgggttacggtaacgttaccggtaagggttacgtaaccgttttaccgttaccccttaccccgttacccgaacccgtacgtaccgtaacggaccccgtaggtttaccgaacggtacccgtaaaacgttcgggttaaacgtttacgtttaccgttaacccgtttaaaccttttaccgttaccgttaacgtaaaccctaaacgggtggtaaacccttacccgtaacccggtaccccttaaccccggtaccttaaccgttttaacccgtacccgggtacccgggttaacgggtaaccgtacgggttactaaccgttacgtaaaaccggtaaacgttaccggtacggttagacccttaacggtaccctacgtaccgttaccgtccgttaacccg

SEQ ID NO: 234466 - DNA, 555 bp, Homo sapiens
  misc_feature: GYAE6OF02FUHB5.2.43.D10.1.454.CMB.1.raw
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (394)..(394): a, c, t, g, unknown or other
  misc_feature (394)..(394): n is a, c, g, or t
  modified_base (437)..(437): a, c, t, g, unknown or other
  misc_feature (437)..(437): n is a, c, g, or t
tcagacgctcgacacacgaccggtgctcgatttagactagcagtaaggggagtctcaggcaggacacagcatggacatgagggtccccgctcagctcctgggggctcctgctactgtggctccgaggtgccagatgtgacatcgacatgacccagtctccatcctccctgtctgcatctgtgggagaccgagtcaccatcacttgccgggcaagtcaggccgttaacacttatttaaatggtatcagacaaaacgngggcacgcccctnagctcctgactctctgctgcactccagtattgcgaggtagtcgggtccgtcccagttccggcggtttcgaggtcggcgtaggtggatcggtgggactagttactttcctccctacacctatcgancagtctgacaagtgagtatttcgactacttcttctgtacaacngactactacaccctacccgctaccgttacgttccgaccgtacgggacctagggtacgtactaccgtaacgaaaacgtcgtcgtacggcgtacgacctacgtacgttcgtcgttaaccg

SEQ ID NO: 234467 - DNA, 754 bp, Homo sapiens
  misc_feature: GYAE6OF02H5YK3.2.43.D10.1.454.CMB.1.raw
  modified_base (177)..(177): a, c, t, g, unknown or other
  misc_feature (177)..(177): n is a, c, g, or t
tcagacgctcgacacacgaccggtgctcgatttagactagcagtaagggggagtctcaggcaggacacagcatggacatgagggtccccgctcagctcctggggctcctgctactgtggctccgaggtgccagatgtgacatcgacatcgacccagtctccatcctccctgtctgcntctgtgggacgaccgagtccacatcacttcggccgggacacgtcgaacgggtacccgttaaactacctttaatttaaaacgttggtaacttacgaacgaaccgaaaaaacccggtacggggaccgaccgacccccgtacgtaacgtcccgttcctacggtaactcctccgttagccttacgactacttaccgagtacgtttcgacgaggtacggttccggtccgtaccgtacgttccggtaccggttcggtaaggtcggtacggtacgggttaggacgttacggtcggggtaactacggttccgtttacccctacctaccgactaacgtcaacgtaccgttacgtactacggtaactaaacggttacggtagggttttactttaccgaaccgttttaaaccttcgttaccgttaacgtaccgtaaacgtaacgtaacgttaccctaacccgtacccgtacccctaccgttaaccgttaccgtttaccggaccgggtaacggtaccgtacgggtacgtactcgtaaacgtaacgtacgttacgacgctacgtaccacgttcttaccgtagtttacccg

SEQ ID NO: 234468 - DNA, 680 bp, Homo sapiens
  misc_feature: GYAE6OF02IDUBK.2.43.D10.1.454.CMB.1.raw
  modified_base (155)..(155): a, c, t, g, unknown or other
  misc_feature (155)..(155): n is a, c, g, or t
  modified_base (285)..(285): a, c, t, g, unknown or other
  misc_feature (285)..(285): n is a, c, g, or t
  modified_base (471)..(471): a, c, t, g, unknown or other
  misc_feature (471)..(471): n is a, c, g, or t
tcagacgctcgacacacgaccggtgctcgatttagactagcagtaaggggagtctcaggcaggacacagcatggacatgagggtccccgctcagctccgtggggctcctgctactgtggctccgaggtgccagatgtgacatcgacatgaacccngtctccatcctccctgtctgcatcgtggtaggacgacgatccacatcacgttcggccggataacgtcacggtacccttaaacaaccttaattttaaaagttggtaactacaacgaaaccaaaaaaccggngggacctaactcccccgtagacgccttccgaagtacttcctctgctacgactactaccgtagtatacgacgtaggtcggtcggaccttaccgagtccggttaccgttagaaggttcggacgtaggttaggtacgtcggtaacggtacgtacgttacctttcccgacccttacacctaatcgtaacncgtactacgtataaaccgtaagtagtacgttacgttcaacgttaacttctcgataacaaccgtaagacgacctaaaccgtacccaaccctacctaacgttccgttaccggaccgtaacgggaccgttaggtacgtacctaaacgtaaaccgaaacgttacggtggtaaccggtctaccgtaacccgttacgtacttcgttaaccgttcc

SEQ ID NO: 234469 - DNA, 913 bp, Homo sapiens
  misc_feature: GYAE6OF02HTSLU.2.43.D10.1.454.CMB.1.raw
  modified_base (218)..(218): a, c, t, g, unknown or other
  misc_feature (218)..(218): n is a, c, g, or t
  modified_base (270)..(270): a, c, t, g, unknown or other
  misc_feature (270)..(270): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtcctccatccctccctgtctgcatctggtgggacgaccgagtccaccatcacttcggccggganaacgtcacggtaccttaacaccttaatttaaattggtatcagacaaaaacgngggcacgccctcagctctgatctctcgctgcactcagtatgacgagtaggtcggccgtaccagttccggtacggttcgaggttcggacgtaggttaggtacgttcggtagggactaggttaccttttacccgtaccccgtacctaaccctagttacccgtaacggtaccgtaacggttaccgtacggtaaaccgttaaaacgggttcgggttaaacgggttttaacgtttttaaccggtaaacccgttttaaaaccctttttacccgtttttaaccgtaaccggtttaaacccgtaaaaacccgggtacggttaaacccggtttaaccccggtttaaacccccgtaaacccccgtttaaacccccccggtaaccgtttaaaccccgtttttaaacccgggtttttacccccggggaaaacccccggggtttaaaccggggggggtaaaccccggtttaaacggggggtttaacccgggttaaacccggtttaaaaccccggtttaaaaaccggggtaaaaaaccgggttaacccgggttttaaccggggttaacccggggtttaaccccgtaaccggggttaaacccccttaaaccccggtttaaccgttttaccccggtttaacccggtttttaacccccgg

SEQ ID NO: 234470 - DNA, 598 bp, Homo sapiens
  misc_feature: GYAE6OF02I67R9.2.43.D10.1.454.CMB.1.raw
  modified_base (262)..(262): a, c, t, g, unknown or other
  misc_feature (262)..(262): n is a, c, g, or t
  modified_base (572)..(572): a, c, t, g, unknown or other
  misc_feature (572)..(572): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtcctccatcctccctgtctgcatctggtgggacgccgagtcaccatcacttgccgggcaagtcacggccgttaaacaccttaatttaaatggtatcagacaaaaacgnggggcacgccctcagcctcctgactctatgctcgcatcccagtatcgcgagaggtggcccgtccatcgtcggttcaggtggcaggtgagtctaggggaacacgttacgtttcctacccgtacaaccctagtccgtaaacgcgtacgttccgtagaacctaaaagtggtaacggttattttacggacttaacgttttacttcgtagtacaactagacgtacctaccacccgttaacccgactaccgttacgtttccgaccgtaacggggtaacaacgggtcggaacttccgtaaacaaaaggtactaggtnacgtcgacacctattacgtcgttacc

SEQ ID NO: 234471 - DNA, 858 bp, Homo sapiens
  misc_feature: GYAE6OF02GOTFO.2.43.D10.1.454.CMB.1.raw
tcagacgctcgacacacgaccggtgctcgatttagactagcagtaagggagtctcaggcaggacacagcatggacatgagggtccccgctcagctcctggggctcctgctactgtggctccgaggtgccagatgtgacatcgacatgacccagtcctccatccctcctgtctgcatctgtgggacgaccgagtccacctatccgactttcggcccgggactaaacggtccgacgggtacccgtttaaacctaacccgttaaattttaaaacgttacggttaacttaccgtaacggtaacccaaaaaaaacccggtacgggggtaccaaccggtccccccgttacgaaccggttacccttcccgtacggtaaccttccgttaccgtcggttaccttacggtacccgtaacgttacccggtaacggttaacgtttcggaaccgtaagggtaaccgggttcccggtaccccggttaccctacgggttccgtcgggtttacccgaagggttcgggtaccgtaacgggttacggtaacgtttacgggtacggggtaacctacggtttaccgttttcccctaccccgtaccgtaacccgtaaccgttaccgtacggtaccgtaaccggttcctaaccggtaaaccgtaaacgttacggttaacggtttacgttttaccggaacctttaaccgtttaccgtttacctacgtaacctaacgtacgtaccgtaaccttaccgtaaccccgtacccgtacttaaccgttacctttaccggaaccggtacggtacccgtaggtacgtacgtacgtaaaccgaaacgtcgttcggacgtctacgtacccacttacgtccgttgttacccg

SEQ ID NO: 234472 - DNA, 601 bp, Homo sapiens
  misc_feature: GYAE6OF02HY19C.2.43.D10.1.454.CMB.1.raw
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
  modified_base (596)..(596): a, c, t, g, unknown or other
  misc_feature (596)..(596): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctggtgggagaccgagtcaccatcacttcggccgggacaagtcacggtcccgttaacaccttatttaaattggtatcagacaaaaaccgnggggcacgcccctanacgctcctgtactctctgctgctatccgagtacttgcagtaggtcggccgtaccagtccggtcggttacgaggtcggtcaggtcggtactcggtagggactaggttactttccctaccctacacctatccgacgacctacgtcgtacgactaacgtgtacgttagtttcgaaccttaactttcgttactacgtaccaacgagtacctacctaacctacccgtaccgtacctaccgttacgttccgaaccggacgggtacctaggtcgtaactctaacgaaagtacgtcgtacgctacgaccctacgtcttccgtnttacg

SEQ ID NO: 234473 - DNA, 628 bp, Homo sapiens
  misc_feature: GYAE6OF02G0ZCC.2.43.D10.1.454.CMB.1.raw
  modified_base (273)..(273): a, c, t, g, unknown or other
  misc_feature (273)..(273): n is a, c, g, or t
  modified_base (285)..(285): a, c, t, g, unknown or other
  misc_feature (285)..(285): n is a, c, g, or t
  modified_base (301)..(301): a, c, t, g, unknown or other
  misc_feature (301)..(301): n is a, c, g, or t
  modified_base (340)..(340): a, c, t, g, unknown or other
  misc_feature (340)..(340): n is a, c, g, or t
  modified_base (623)..(623): a, c, t, g, unknown or other
  misc_feature (623)..(623): n is a, c, g, or t
tcagacgctcgacacacgaccggtgctcgatttagactagcagtaaggggagtctcaggcaggacacagcatggacatgaggggtccccgctcagctcctgggggctcctgctactgtggctccgaggtgccagatgtgacatcgacatcgacccagtctccatcctcctgtctgcatctggtgggagaccgagtccaccatccacttcggccgggcaagtcgacggtacccgttaacaccttaatttaaagttggtatcagacaaaaaccgngggcacgccctnacgctcctgactcctntgctcgcactaccagtacttgcagcgtcgggcctacccngtcgtcggtttacgaggtcggctaggtggacttcggacggggactaggttcctttaccgcccgttacacccagtaccgacgactacggtcgtacgaacgtaacgtggtaacggttactttcggacttaaccttcttacttacggtaacctaacgtacgtaccgtaccttaccacccgttaacccgaccttacgtttaccgtttccgacccgggtaagggtacctagggtacgtacgtaactaaccgaaatcgtagtacgtactcggacctacttacgttactnttacc

SEQ ID NO: 234474 - DNA, 553 bp, Homo sapiens
  misc_feature: GYAE6OF02GBG23.2.43.D10.1.454.CMB.1.raw
  modified_base (263)..(263): a, c, t, g, unknown or other
  misc_feature (263)..(263): n is a, c, g, or t
  modified_base (276)..(276): a, c, t, g, unknown or other
  misc_feature (276)..(276): n is a, c, g, or t
  modified_base (290)..(290): a, c, t, g, unknown or other
  misc_feature (290)..(290): n is a, c, g, or t
  modified_base (324)..(324): a, c, t, g, unknown or other
  misc_feature (324)..(324): n is a, c, g, or t
  modified_base (335)..(335): a, c, t, g, unknown or other
  misc_feature (335)..(335): n is a, c, g, or t
tcagacgctcgacacacgaccggtgctcgatttagactagcagtaaggggagtcgtcaggcaggacacagcatggacatgagggtccccgctcagctcctggggctcctgctactgtggctccgaggtgccagatggtgacatcgacatgacccagtctccatcctccctgtctgcatctgtgggagaccgagtcgaccatcacttgccgggcaacgtcaggccgttaacaccttatttaaattggtactcagactaaaaccnggggcagcccctnagctctgactctcngctgcatccgagtacttgcagtagtcgcgtaccngtcgtcggttnagtgcaggtggatcgaggacgagtactttccaccctcaccatacgagcacgtcagactaacgtgacgtatttcgactactttactcgtactacacagacgtactaccgacctacccgctaaccttacgtttcgacccgtacggggacctagggtacgactacgtaacgaaacgtacgttaggtacggtcgtacgaccgacgacgttcgtacgttaccc

SEQ ID NO: 234475 - DNA, 781 bp, Homo sapiens
  misc_feature: GYAE6OF02GJA33.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatccctcctgtctgcatctgtgggacgaccgagtccaaccatccgacgttcgggcccgggactaaacgtccgaacgggtaccccgtttaaacaacctttaaatttttaaaagttggttaactaccgaaggtaaacccaaaaaaccggcggggaccaaccggtcccccctacgaacgtcccttccgtagaccttccttcgtcgtcctcgacctactacccgagttatcgacgaggtacggtcggtcccgtaccctagtcccggtacggtttcgacgggttcggacgtacgggtcggtacgttacggtacgggaactacggttacctttcccctaccctacgtaacctacgtcgtacgaccgtacgtacgtacgtaacctaaacgtggtaacggtttatttacgtaaccttaacttttaccttacgtacgtaacgtaacgtacgtaaccgtaaccgtacccgtaaccccgtacccgtaaccttaaccgttacccgtttaccggaaccccgggttaacgggaccgttaagggttaccgtaccgttaaccgttaaaccgtaaacggtaccgttacggttacgtacccgtaccggacctaacccgttacgtttccgttacttacccg

SEQ ID NO: 234476 - DNA, 711 bp, Homo sapiens
  misc_feature: GYAE6OF02JHARA.2.43.D10.1.454.CMB.1.raw
  modified_base (269)..(269): a, c, t, g, unknown or other
  misc_feature (269)..(269): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctccctgtctgcatctggtgggacgaccgagtccaccatcacttgccgggacaagtcacggccgttaacaccttaatttaaattggtactacagaaccaaaaaccgnggggacacgcccctgacgtcctcctgactcctcgtcgctgccactccgagtacttcgacaaggtacggtcggtccgtacccgtagtccggtcggttacgagggtacggccgtaaggtcggacttcggtagggaactaggttacctttccctacccgtacctacctacgtcccgtaggaccttagtccgtagaaccgtaaacgttggtaacggttttactttacgaacccgttttaactttaccgtttacgttacgtaaccaacgtaacgtacgttaacctaccctacccgttaaccccgcttaaccgtttaacccgttcgaacccgggtaacgggaacccggttagtacggtacttaacccgtaaacgtaaaacgttaccggttacggacgttaccgttaccgaaccgttaaccgttaccgtttaccgttacgtttaacccg

SEQ ID NO: 234477 - DNA, 658 bp, Homo sapiens
  misc_feature: GYAE6OF02FL5JQ.2.43.D10.1.454.CMB.1.raw
  modified_base (260)..(260): a, c, t, g, unknown or other
  misc_feature (260)..(260): n is a, c, g, or t
  modified_base (269)..(269): a, c, t, g, unknown or other
  misc_feature (269)..(269): n is a, c, g, or t
tcagacgctcgacacacgaccggtgctcgatttagactagcagtaagggggagtctcaggcaggacacagcatggacatgagggtccccgctcagctcctggggctcctgctactgtggctccgaggtgccagatgtgacatcgacatgacccagtctccatccctccctgtctgcatctggtgggagaccgagtccaccatccacttcggccgggacaaggtcagggacccgttaacaccttaatttaattggtatcanacaaaacgnggggcacgcccctcagcctcctgactctctgctgcactccagacttgacaggaggtcggccgtccagtccggtcggttacgagtcggcgtaggtggacttcgtacggggactagtactttcccgtccctacacctagtcacgtcacgttcagtacctaacgtaggtaggttacgtttacgtaacttaacctttacttcgtacgttaacaacgtaacgtacgtacctaacctaaccccgtaccccgtacttaaccctttacgttttacccggacccgggtaaccggggtaacgtacgggtacggtaaccttaccggtaaaccgtaaaacgtaaccgttggtacccgggtcttaccggtaaccgtaccgtacgttaccgttacgttacccc

SEQ ID NO: 234478 - DNA, 690 bp, Homo sapiens
  misc_feature: GYAE6OF02HJ5XU.2.43.D10.1.454.CMB.1.raw
  modified_base (193)..(193): a, c, t, g, unknown or other
  misc_feature (193)..(193): n is a, c, g, or t
  modified_base (297)..(297): a, c, t, g, unknown or other
  misc_feature (297)..(297): n is a, c, g, or t
tcagacgctcgacacacgaccggtgctcgatttagactagcagtaaggggagtctcaggcaggacacagcatggacatgaagggtccccgctcagctcctgggctcctgctactggtggctccgaggtgccagatgtgacatcgacatgacccagtctccatcctccctgtctgcatctggtgggacgaccgngtcaccatccgacgttgcccgggcaagtcgacggtccgttaaacaccttaagtttaaacttggtaatcagacaaaaaccgtcggggcagcccctgacgctaccngatctctgctgcactcagtactgcagtacgtcggacgtcccacgtcgacggtttgaacggtcggacgtaacggtcggtagtcggtgggaaccgtacggtatttcccgttacccgtacaccgtactaccgtacgtacccgtagtacgtcgtaactaaacgttgggtaaacggttacttttcggtaacttaaccgttttaccgtttacgttccggtaacctaaccgtaagtaaccgtcccttaaacccgtaacccgtaaccccgtaccttaacccgttaacgttttacccggacccggaacggggaccgttaacggttagggtaaccttaaccggaacgttaaaacgtacgttacggtcgtacggtctaaccgtactacgttccgttacgttacc

SEQ ID NO: 234479 - DNA, 873 bp, Homo sapiens
  misc_feature: GYAE6OF02HIL6H.2.43.D10.1.454.CMB.1.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgactatcgacccagtcctaccactccctccctgtctgctatctggtgggacgaccgngtccaccatcacgttcggccgganaagtcgacggtacccgttaacaccttaatttaaagttggtactacacgaaccaaaaaccggaggggtaccaaccgtcccctacgacgtcctcctagacttctcgtcgtctcgacactaccagtacgttcgaccgtaaggtacggtaccgggtcccgtacccgtaacggttccggtaccggttacgtacgggtacggtaccggtagggttacggtacgtacgggttacggtaaacgtacggtttacctttacccccgtacccgttaacccgtaaaccctagtaacccgtacggtaacccgttaacggtccccgttaacgaaaccggtaaaccgtttagggtaaacgggtttttaccgttttaaccggaacccgtttaaaacccgttttccctttaaccggttaccgtaaaccgtaaacccggttagtaacccgttaaccctaaccccgtaaacccccggtaaccccgtaacccgttaacccgttttaaccggtttacccccggaaaccccgggggtaccgggttaaaccccgttaagggggtaccgttaaccgttaaaaccccggtaaagtaaaaaccggttcggttaaccgggtacgttacccgtaccgtaaacccgttaaccgttcgtttacccggttagttacccccg

SEQ ID NO: 234480 - DNA, 795 bp, Homo sapiens
  misc_feature: GYAE6OF02ICFB9.2.43.D10.1.454.CMB.1.raw
  modified_base (92)..(92): a, c, t, g, unknown or other
  misc_feature (92)..(92): n is a, c, g, or t
  modified_base (207)..(207): a, c, t, g, unknown or other
  misc_feature (207)..(207): n is a, c, g, or t
tcagacgctcgacacacgaccggtgctcgatttagactagcagtaaggggagttcgtcaggcaggacacagcatggacatgagggtccccgntcaggcctcctggggctcctgcgtactgtggcctccgaggtgccagagtgtgacatcgacatcgacccagtcctccactccctccctgtctgcactcgtggtacgggacgaccgngtaccaacataccaacgttcggaccccgggataacgttccgacgggtacccgttaaacaaccctttaatttaaaacgttggtaaacttacctaaacggtaaccgtaaaaaccgaggggaccctaacggtaccccccttaccgaacggtaccgttacccgtacgaacgtttcctaccgtgtacccgttaggtccctaaacgttcccgaaggttactaaccgggtacctaaagggtacggtcggtacccgttacccgtacgttaccggtccggttacgtaggttcgggccgtaaggttacggtaactcggttagggaacctaaacgtttcctttacccgtacccttaccaacccgtactaccgtaccgtacgtacgtaccgtacgtaaactaacggttaccggtaggttaacttttaccggtaactttaaccgtttccttacgtttacgacctaacgtagtacttaccgtaacctacccgttacccgtacctaacgtttaccgttccggaaccgtacgggtaactaggtacgtacgttaacacggtaaatccgtaggtaccgtctaccgacgtacctagtccgttatccc

SEQ ID NO: 234481 - DNA, 692 bp, Homo sapiens
  misc_feature: GYAE6OF02G8180.2.43.D10.1.454.CMB.1.raw
  modified_base (280)..(280): a, c, t, g, unknown or other
  misc_feature (280)..(280): n is a, c, g, or t
  modified_base (296)..(296): a, c, t, g, unknown or other
  misc_feature (296)..(296): n is a, c, g, or t
tcagacgctcgacacacgaccggtgctcgatttagactagcagtaagggagtctcaggcaggacacagcatggacatgagggtccccgctcagctcctggggctctgctactgtggctccgaggtgccagatgtgacatcgacatgacccagtctccatcctccctcgtctgcatctgtgggagaccgagtcaccactcacttgccggcaagtcgacggccgttaacacctatttaaatggtattcagacaaaaaccgagggacacgcccgtcagctccngactctctgctcgcgntaccgagatcgtcagagtggcctccgatcgcggttcgtagtggctaggtgagtcgtaggactacgtactttcctccctacgaacctcgaccgtacgacctaggtctacgaacgtaaacgtcgtaagggttacttttacggaccttaaacctttttacgtcctttacgtaacctaacgtaacgttacggtaacccttaaccgtaaccccgttaaccccgtacttaacccgtttaaccggtttttacccggaacccgttaacggggggaacccttaacggggttacccggttaacgtttaaacccgggttaaacctaaaacgggtaaccgtttaccgggttacggttaaccgtccgtaaaccgtaacccgttaccctttacgtaccggttttaacccc

SEQ ID NO: 234482 - DNA, 667 bp, Homo sapiens
  misc_feature: GYAE6OF02J1Q0B.2.43.D10.1.454.CMB.1.raw
  modified_base (208)..(208): a, c, t, g, unknown or other
  misc_feature (208)..(208): n is a, c, g, or t
  modified_base (252)..(252): a, c, t, g, unknown or other
  misc_feature (252)..(252): n is a, c, g, or t
tcagacgctcgacacacgaccggtgctcgatttagactagcagtaagggagtcgtcaggcaggacacagcatggacatgagggtccccgctcagctcctgggctcctgctactgtggctccgaggtgccagatgtgacatcgacatgacccagtctccatcctccctgtctgcatctgtggagaccgagtcaccatcacttgccgggnaagtcaggtccttaacactatttaaatgactcagacaaaaccgngggtcacgccctcagcctctgactctctgctgctatccagacgtcgtcgaggagttcggcctcccgtagtccggtaccggtttcgaggtcgggtacgtaaggtcggtaacgtttcggaagggggtaacctaacggtaccgtttcccgtaccccttacgaaccctacgttacgacgtacctacgtaccgtcgtaaccgtaaacgttaccggtagtttacgttacggaacctttacgtttacttccgtacgtacaaccgtagtaccactaccgtacccgtacccgtacgtaacctttccgttacggaccccgtaaagggacccgttaagggtacgtaaccggtcttaaacccgaaaggttaaccgttcggtaacggtaaccttccgggaacctaacccggtattcgttaccgttccg

SEQ ID NO: 234483 - DNA, 729 bp, Homo sapiens
  misc_feature: GYAE6OF02GVY5W.2.43.D10.1.454.CMB.1.raw
  modified_base (312)..(312): a, c, t, g, unknown or other
  misc_feature (312)..(312): n is a, c, g, or t
tcagacgctcgacacacgaccggtgctcgatttagactagcagtaaggggagtctcaggcaggacacagcatggacatgagggtccccgctcagctcctggggctcctgctactgtgctccgaggtgccagatgtgacatcgacatgacccagtctccatcctcctgtctgcatctaggtgggacgaccgaagtccaacctatctacttggaccgggacaaagtccaaggtaccgttaaacaccttaatttaaagtggtaatacgtacgaacctaaaaaccggaggggaccacgcccctagacgctccgtanacttactctgtcctacgacacttccgaagtacgttcgactaaggtacgtcgggtacccgtaccgtacgtccggtacggttcgtaggttacggaccgtaggtacggaacgttcggtaacgggaacttaggtacctttcccgtaacccctcctaacgtacctacgtacgtcgtaacgtcgtaacgtaaacctaacggtaggtaacgttacgttttaccggaactttaaaccgtttccgttacgttaacgtaaccgtaaacgtacggtaacgtacccttaaccgaacccttaacccggtactaacctttaaccggttccgaacccgggtaacgggtaaccgtaggtacgtaaccgttaacgtaaaccgtaaaggtaccttgggaccctagtaccgtacctaccgtattccgtgttacccg

SEQ ID NO: 234484 - DNA, 767 bp, Homo sapiens
  misc_feature: GYAE6OF02IT8A5.2.43.D10.1.454.CMB.1.raw
  modified_base (134)..(134): a, c, t, g, unknown or other
  misc_feature (134)..(134): n is a, c, g, or t
  modified_base (406)..(406): a, c, t, g, unknown or other
  misc_feature (406)..(406): n is a, c, g, or t
tcagacgctcgacacacgaccggtgctcgatttagactagcagtaaggggagtctcaggcaggacacagcatggacatgagggtccccgctcagctcctggggctcctgctactgtgctccgaggtgccagatntgactatcgacatgaccagtctccatccctcctgtctgctatctggtgggagaccgagtcaccatcctattcggccgggtacaacgtccgacggtaccgttaaccaccttaatttaaagttgtatacacgaaccaaaaaccggtcggggacaccggccccttcgacgtcctccgtgtacttccttacgtcgtcgtcgaactcttacccgaagtacggttcaccgtaggtataccgggctacccacgttccggtacgttccgaggtcggacgnggtttacggattcggaacgggtactaacgggttacctttaccccgtacccttaactacctaccgtaccgtaagtcgtaccggttactccggtaaacgaaacgttacggtaacgggtttcttttaccgaacccgtttaaagttttccgttaaacgttcccgtaaacaaccgagggttaacccgtacttaacccctaccccgggttaacccaccgttaacccggttttaaccgttaccgggtaaccccgggtacggttaaccgggaacggttaaccggtcttaaaccggtaaacgtaaacgttaacggttggaccttaccggtccaacccggttaccgtaacgtttagtacccgttttacccg

SEQ ID NO: 234485 - DNA, 730 bp, Homo sapiens
  misc_feature: GYAE6OF02JIV6W.2.43.D10.1.454.CMB.1.raw
  modified_base (184)..(184): a, c, t, g, unknown or other
  misc_feature (184)..(184): n is a, c, g, or t
  modified_base (208)..(208): a, c, t, g, unknown or other
  misc_feature (208)..(208): n is a, c, g, or t
  modified_base (249)..(249): a, c, t, g, unknown or other
  misc_feature (249)..(249): n is a, c, g, or t
  modified_base (262)..(262): a, c, t, g, unknown or other
  misc_feature (262)..(262): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctcctgtctgcatctgtggganaccgagtcaccatcacttgccggnaagtcaggccttaacactatttaatgtatcagacaaaacgngggcacgcccctnagctcctgatcctctgctgctagtaccagtattcgacgagtaggtcgggtccgtccccaagtccggttcggttccgtaaggttcgggacgtacgggtggtaacgtcggtacggggactaaggttaccttttcccacccctttacgaacccgtactacccgaacgtccgtacgtaccggttactaacgtaaaccgtaggtaacgggttactttttaccggaacctttaacccgtttaccgttttacgttaccgttaaccgtaacgtaacggtaaccttaccgttaacccgtaacccgttaaccccccgtacgtaaccctttaaccgtttttccggaaccccggttaacggggaacccgttaggggtaccggtaacgttacccgttaaacgtaaaaccggttaacggttcggttaaccgtccgtaaccggtaccgtaacccggttacttaccggtttaccgtttaacccg

SEQ ID NO: 234486 - DNA, 904 bp, Homo sapiens
  misc_feature: GYAE6OF02HC9M7.2.43.D10.1.454.CMB.1.raw
  modified_base (90)..(90): a, c, t, g, unknown or other
  misc_feature (90)..(90): n is a, c, g, or t
tcagacgctcgacacacgaccggtgctcgatttagactagcagtaaggggagtctcaggcaggacacagcatggacatgagggtccccgntcagctccgtggggctcctgctactgtgctcgaggtcgccagatgtgacagtcgacatcgaccagtctcactccctcctgtctgcattcgtgggtgggacgaccgtagtaccacctaattccgtaacgttcggacccgggactaaacggtccgtaacggggtaccctttaaacctaccgtttaaaattttaacggtttacgggtaactacgtaaacggaaaccgtaaaaaacccgggtgggggtaaccctaccggtaccccctacgtacgtccttaccgtacgtaacttcctcgtcggtcgttcggtacacgtaccgtaagttacgttcgacgtagggtaacggttccggtaccgtcccgtacggttccgggtacggtttacgacggttcggacgtaggtacggtacgttcgggtacggtaacgtacggtttacctttaccgtcccgttaaccaaccgtacgtttccgaacgttaccgtacgttcgtaaccgtaacggttaacgtcggttaaacggttctttaaccggtaacgtttaaccctttacgttaaccggttacgttaaaccgaaacggttacggaaccccttaacgtaccccgttaaaccccgttcccgtaaccgttttaaacccggttttaccggttacccgggtaaacccgggtaaggggttaaacccgtacggggttaaccttaaccggttaaccgggttaaaaaccggttaaccgggtaaaccggtttccgggtaaaccgttcccggtaaacccgggttaacccttaccgggttacccttttacgggtttccctttaaccccgg

SEQ ID NO: 234487 - DNA, 891 bp, Homo sapiens
  misc_feature: GYAE6OF02FLSLA.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatcgacccagtcctccactccctccctgtctgctattcgtggtgggacgaccgtagtaccaccatcgtacttcggccggactaacgtcgacggtaccgttaacctacctttaatttaaacgttggtactaccgaacgaaaccgaaaaaccggcggggtaccaaccgcccccgttagacgtcctccgtagtactcctcgtcgctcgctacgtacctagtcgttcgacgtaggtacggtccggtcccgttcccgtacggtccggttccggttacgtagggtcggtaacggttacgggtaggtacgttccgggtacggtaaccttacgtttaccttttaccccgtaccccgtactaaccgttagtaccgtacgtcgttacggtttacccacggttaaacccgtaaggttccgggtttaaacgtttagttttacccggtaaaccgtttttaaccccgtttaccgttttaccgttaaccggtaacccgttaaggaaccccggttaacttaaccccgggttaaaccccttaaccccccgggtttaaacccgttaaccccgttttaccgttttaccccggggaacccgggtaaacccggggttaaccggttaacgggttaccgtttaacccgtaaccggttaaaaaccgggtaaacggttacccgggtttaccgggacggtttacccgtaacgggtacccccttaaaccggtttcggtttaaccccttaccgggtttacccctttaaccccgg

SEQ ID NO: 234488 - DNA, 859 bp, Homo sapiens
  misc_feature: GYAE6OF02FWXNY.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatcgacccagtctccattccctccctgtctgctattcgtttgggacgaccgagtccaccatcctacgttcggcccgggacaagttccgacggtacccgttaaactaacccgtttaaagttttaaaacgttcgggttaactacgaacgtaaaccgtaaaaaaacccggacgggggacccaaccggtcccccccttacgaccgtacccgttcccgtacggtaaccttcccgttacgtcgtccgtacggtcctaacgttacccgtaaggtacgtttcggaccgtaaacgggtaacggttccgggtaccccgttaccccgtacggttacccgggttccggttacggtacggttccggtacgtagggttacgtacggttacggtacgggaacttacgttaccttttcccctcccgtaacctaccgtacgtaccacggtactacgttaccgtaacgtaaccgtaacgttcgggtaacgttaacgtttacgtaacctttaacttaccgtttactaccgttaaacgtacgtaaccgtaccggtacccttaacctaccccgtacccgtacccgttaaccgtttacccgttaacccggtaacccgggtaaaccgggtaaccgtaaccgggttccgtaaaccgttaaccggtaaacgtaaaccgttacgttacggtcgtaccgtacggtacctaccggttacgttccgttacttccgttaacccg

SEQ ID NO: 234489 - DNA, 700 bp, Homo sapiens
  misc_feature: GYAE6OF02FS988.2.43.D10.1.454.CMB.1.raw
  modified_base (275)..(275): a, c, t, g, unknown or other
  misc_feature (275)..(275): n is a, c, g, or t
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatccctcctgtctgcatctgtgggagaccgagtcacctatcacttgccgggacaagtcaggaccgttaacaccttaatttaaattggtatcagaccaaaacgagggcacgcccctnacgtcctacctgatcctagtgactgctactccaaggtattgacaggagtggccgttcccagtcgtacggttcaggttgcgtaaggtggatccggtagggactagtacttttccctacccgttacaacctacttacacgctaacgtctaacggactaaaacgtggtaaacgggttcttttacggaaacctttacctttaacttaccggtttaagtaccgttaaacgaaccggtagtaacccgtaacccgtacccgtaaacccccggaccttaaaccttaacccgtttttacccggaacccgggttaacccgggggtaacctaacggggttaacgaacccggtttacctaaaccggtaaaaacgtcccgggttaacggtcgtaaccgttcgtaacccgaaccctttaactaccgtttacggttaccc

SEQ ID NO: 234490 - DNA, 740 bp, Homo sapiens
  misc_feature: GYAE6OF02F53TY.2.43.D10.1.454.CMB.1.raw
  modified_base (91)..(91): a, c, t, g, unknown or other
  misc_feature (91)..(91): n is a, c, g, or t
tcagacgctcgacacacgaccggtgctcgatttagactagcagtaaggggagtctcaggcaggacacgagcatggacatgagggtccccgntcagctcctgggctcctgctactgtggctccgaggtgccagatgtcgacagtcgacatgacccagtctccaatcctcctgtctgcatcgtgtaggacgaccgagtccaccgatccacgttcgccggactaagtccgacggtaccgttaaaccaccttaagtttaaattggtactactagaaccaaaaaccgcgggacacgacccctacgacgcgtaccgtagacttcgtactgtctgaccactccagtattgacacgagtacgtcctaccgtagtcgtcggttacgagtcggacgtaggtcgactcggtacggaactacggttcctttacccgtacccgtactaaccgtacgtaccgacgtaccgtacgttaccgttacgaaacccgtaaacttcgggtaacgtttacgttttaccggaacctttaaccttttaccgttcgttaacgttaaccgaaactagggtaacctaacccgttaaaccaccccgttaacccgaccttaaaccgtttaaccgtttaccggaacccggtaacgggtaaccgtaacggtacggtaacctttaacccggaaacgttaaaaaccggtaccgtacgttaccggaaccgtttaccgaacccggttaactaccgtttacccgtatttaacccg

SEQ ID NO: 234491 - DNA, 907 bp, Homo sapiens
  misc_feature: GYAE6OF02FJYC0.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatgacccagtctccatcctcctgtctgcatcgtgtgggagaccgagtcaccatcctacgttcggccgggtactaacgtcgacggtacccgtttaaaccaacctttaagtttaaaagtttcgggtaaacttaccgtaaacgaaaccgtaaaaaaccggacgggggtaccaaccggacccccttacgacggtacccttacccgttaggtaaccttcccgttacgtcggtccgttacggaccttaacgtacccgtaaaggtagttttaccggacgtaacgggtaccgggttaacccggtccccgttaacccggtacggttacccggggttccgggtttaccgacgggggttacgtaaccggttagggtacgggttaccgttaccgggtaaacggggtaacgtaaacggttttacccgttttacccgttacccccgtttaaccgtaacccgttaacgtaaccggtacccgtaacgggttaaccggtttcccgtaacgtaaacccggttaaacggttagggttaaggtttaacccgtttttacgggaaacccgttttaaccttttaaccggttaacttacccgggtaactaaaccgggtagtacctaacccggttaacccgtaacccgttccccgaacgttaccgtttaaccgttacccgggacccgtttaaacggggaaccgttaggttccgtaacgtaacgttaaaccggaaacttcggtacgtacggtcccacgtaaccctacggttaccttcgtacgtttacc

SEQ ID NO: 234492 - DNA, 858 bp, Homo sapiens
  misc_feature: GYAE6OF02HP06F.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatcgacatcgacccagtctcccatccctccctgtctcgctattcgtggtagggacgaccgtagtccaccatcacgttccggccgggtactaacggtcgaccggtacccgttaaacaccgtttaaagttttaaacgttggtaactaccgtaacggaaaacccgtaaaaaaccggacgggggacctaaacccggcccccgtaccgaccggtaccctccgtacgtaaccttccgttacctcggttccgtacgacctaccgtttaccaagttacgttcggaacgtacggggaaccgggttccggtaccccggttaccctacggttcccggggtacggtttaccggacggggttcggacggttaggtaacccgggttaactcggggtaacggggacctttaaacgttaccgtttcccccgttaccctacccgaaaccgttaccgtacccgacggtaccgttaacgtcgtaaccgaacgtaaacgggttggtaaacgtttacctttaacggtacctttaacccgtttcgttacttaggaacctacggtacgtaaccctaccttacccgtacccgtacccaccgttaacgtttaacccgttcgggtaacccgacgggttaaccggacggtttaccgtaaacggttacccaaaacggttaaaccggtacggttacgtcgtaacccgttggaaccctaccggtttaacggtttccgtacccggtttcc

SEQ ID NO: 234493 - DNA, 763 bp, Homo sapiens
  misc_feature: GYAE6OF02IIE0L.2.43.D10.1.454.CMB.1.raw
  modified_base (129)..(129): a, c, t, g, unknown or other
  misc_feature (129)..(129): n is a, c, g, or t
  modified_base (281)..(281): a, c, t, g, unknown or other
  misc_feature (281)..(281): n is a, c, g, or t
  modified_base (295)..(295): a, c, t, g, unknown or other
  misc_feature (295)..(295): n is a, c, g, or t
  modified_base (304)..(304): a, c, t, g, unknown or other
  misc_feature (304)..(304): n is a, c, g, or t
  modified_base (329)..(329): a, c, t, g, unknown or other
  misc_feature (329)..(329): n is a, c, g, or t
  modified_base (549)..(549): a, c, t, g, unknown or other
  misc_feature (549)..(549): n is a, c, g, or t
tcagacgctcgacacacgaccggtgctcgatttagactagcagtaaggggagtctcaggcaggacacagcatggacatgagggtccccgctcagctcctggggctcctgctactgtggctccgagggtnccagatgtgacatcgacatcgacccagtctccatcctccctgtctgctatctcggtgggacgacctaggtccaaccgatcctacgttggcccgggataacgtcgtacggaccgttaacaccttatttaaacgtggtatacagactaaaacgngggtcacgccctanagtcctcgntactctctgctagctaccgtcagtnttcgacacggtagtccgaccgtaccgtgtaccggtcggttacgacggtcggtacgtaggtacgtacgtacggtcggaaactcgttaactttcccggtaccctaccgtacctaagtaccgacgtacgtaacgttccgtagaaacccgttaagtaccgggaagttttacgttaacgaacccggtttaactttaacccgttcgttacgaaccgttaaaccggngttaaacggttaccccaaacccgttccgtacccccgtaaacgtttcctttacccggtttacccggaaacccccgggtgggtaaaacccggtaggttaaccgggttcccgtaaaactttaacccccgggaaaaggtttacgtaccccgggtttggtaacccgtttaccggaccccgtaaaaccgtttccggtttacttacccggggtttaacccc

SEQ ID NO: 234494 - DNA, 815 bp, Homo sapiens
  misc_feature: GYAE6OF02F16XB.2.43.D10.1.454.CMB.1.raw
tcagacgctcgacacacgaccggtgctcgatttagactagcagtaaggggagtcccaggcaggacacagcatggacatgagggtccccgctcagctcctgggctcctgctactgtgctccgaggtgccagatgtgacatcgacatcgacccagtctccactcctccctgtctgcatctggtaggacgaccgtagtccacctatccacttcgaccgagacctaagtccgacgggtacccttaaactaccgtttaaatttaaagttcggtactaccgaacggtaaaccgtaaaaaaccggcggggaccaaccgccccctacgaacgtcctcctagtaccttcctacgtcggtaccgtgacctaactccgtaagtacgttcgaacgtacggtacggttccggtccccgtaccgtacgttcccggtacggttacgacggtcggtacgtagggtacggtacgttcggaacgggtaacttacgttaccctttacccgtaccccgtaacctaccgtaacgttacgaccggtacgttacgtcgtaccgtaaaccgtaacggttacggtacgtttaaccttttgaacccctttaatttacccgttagtaaccgtaacgtaaaccgtacgtaaccgtaacccttaacccgtaaccccgttacccgtaccgttaaaccgtttcccgttacccgggaacccgggtaaagggttacccgtagggtaccgttaaggttaacccgtaaaacggttaaacgtcccgggttacggtaaccgtacccggttagaccccgttaacgtttcccgtttaacggtccctttacccgg

SEQ ID NO: 234495 - DNA, 754 bp, Homo sapiens
  misc_feature: GYAE6OF02JVTBV.2.43.D10.1.454.CMB.1.raw
  modified_base (178)..(178): a, c, t, g, unknown or other
  misc_feature (178)..(178): n is a, c, g, or t
  modified_base (306)..(306): a, c, t, g, unknown or other
  misc_feature (306)..(306): n is a, c, g, or t
  modified_base (331)..(331): a, c, t, g, unknown or other
  misc_feature (331)..(331): n is a, c, g, or t
  modified_base (449)..(449): a, c, t, g, unknown or other
  misc_feature (449)..(449): n is a, c, g, or t
  modified_base (460)..(460): a, c, t, g, unknown or other
  misc_feature (460)..(460): n is a, c, g, or t
  modified_base (523)..(523): a, c, t, g, unknown or other
  misc_feature (523)..(523): n is a, c, g, or t
  modified_base (532)..(532): a, c, t, g, unknown or other
  misc_feature (532)..(532): n is a, c, g, or t
tcagacgctcgacacacgaccggtgctcgatttagactagcagtaaggggagtctcaggcaggacacagcatggacatgagggtccccgctcagctccgtggggctcctgctactgtgctccgaggtgccagatgtgacatcgacatcgaccctagtctccattccctcctgtctgcnctgtgtagggacgaccgagtccaccagtctacgttcggcccgggtataaacggtccgaacgggtacccttaaactaccttaaagttttaaaacgttggtaactaccgaacgaaaaccgaaaaaccggnggggacctacccggtccccctaagngtacccttcctaggtaccttacttccgacgcgttaccgacttaaccctgtaacgttgttaccgacgtacggacggtccggtaccccgtacccgtaaggttcccggttacggtttaccngggtttacggngtttaacgggtcggtacgtttacgggtaccggtaccgtagttacccctttccgaccccgttanaacccgtanacgtacgtccgtaccgttacgtacgtaaagtaacggttaggttacgttacgttaacgtaacctttacgttctaccgtacgtaacgaacgtacgtaccgtacctacccgacccttaccgacttaccgttccgtaccgaacgggtaacgtaccgtcgaacttaccgaaacgtaacgtaacgtacgttacgccgtaagtccgtacctacgttacctccgtactcc

SEQ ID NO: 234496 - DNA, 860 bp, Homo sapiens
  misc_feature: GYAE6OF02JO9CW.2.43.D10.1.454.CMB.1.raw
tcagacgctcgacacacgaccggtgctcgatttagactagcagtaaggggagtctcaggcaggacacagcatggacatggacggggtccccgctcacgcctccgtgggggcctcctgctactggtggctccgaggtcgccgagtatgtagactactcgaaccagtccgaccctaggttcctcctacttccctccgtcgttcctgcctaatcgtagggtgggacgtaccgacgtaccaccacttacctacggttccggaccgggtacctaaacgggtaccgtaaccggggtacccctttaaaacccgttaacccttttaaaggttttaaaacgtttcggttaaactaacgaaccgggtaaaacccgtaaaaacccgggaacgggggtaaccgaaccccggtaccccccttacgaacccggttccccttaccgggtaacttaccggttccttaccggttccgtcccggttaaccgaccgttaaacccgtcggttaaacgttacggttaccggaacgttacgggttcgggtccggtacccggtaccgtaccggtttcccggggtagtacggttaccgggtcggtacgtacgggtcggtaacgtcggaacgtcgttacttcccgttacctcccgtaacacttaccgacgacgtcctgtacgcgtaagtaacggttgtaccgttacttacgtactttacttacgttcgaccttacgacgtacgtaacctccgtaccgtaacccgtcccgttaaccgttacgttacccgtccgggtaacccggtacggtaccgtagggtacgaccgtaacgtaaacgtcggtaacgtcggaccgtacgtacgtcccgtaactcttacgtcttaccg

SEQ ID NO: 234497 - DNA, 677 bp, Homo sapiens
  misc_feature: GYAE6OF02FWKTI.2.43.D10.1.454.CMB.1.raw
  modified_base (91)..(91): a, c, t, g, unknown or other
  misc_feature (91)..(91): n is a, c, g, or t
  modified_base (185)..(185): a, c, t, g, unknown or other
  misc_feature (185)..(185): n is a, c, g, or t
  modified_base (286)..(286): a, c, t, g, unknown or other
  misc_feature (286)..(286): n is a, c, g, or t
tcagacgctcgacacacgaccggtgctcgatttagactagcagtaaggggagtctcgaggcaggacacagcatggacatgagggtccccgntcagctcctggggctcctgctactgtggctcgaggtgccagatgtgacatcgacatgacccagtctccatcctccctgtctgcatctgtcgganccgatcactatccgtacttcggccgggactaaggtccgacggtacccgttaaacctaccgttaattttaaaagtggttatacgaagaacctaaaaaccggnggggtcaaccggcccccttcgagtcctccgtagtacttccgttagtcgtcgtcgtacctactccgaagtgtcgacgtaggtacgtcgacgtccaggtcggtcgtctaggcgtcgtaggtcgacgttgtacggaactaggttaccttcccgtcccgtacaccgtactacgtcggtacgtccggtatccgaaaccgtaacgttagggtaaccgttgtttaaccgacgtttaaccttcggttacttacgtaactaacgtacggtaccaccgtaacccgtaccctacccgtactacgttcctacccggtaccggaacggtaccgtagtcggtaacctacggaaccttaaaggtcccttggtaccgactcggtaccctagtacttcttaacggtcc

SEQ ID NO: 234498 - DNA, 754 bp, Homo sapiens
  misc_feature: GYAE6OF02IQC07.2.43.D10.1.454.CMB.1.raw
tcagacgctcgacacacgaccggtgctcgatttagactagcagtaaggggagtctcaggcaggacacagcatggacatgagggtccccgctcagctcctggggctcctgcctactgtggctccgaggtgccagatgtgacatcgacatgacccagtcctcactccctcctgtctgcatcgtgtggacgaccggagtaccacatcacgttcggccggacaacgtccgacggtacccgttaaacctaccttaatttaaaagttggtactacgagaaccaaaaaccgaggggaccaaccgcccctacgacgtccttaccgtcgtacttccgtacgtcgaccttcgactaaccttccgagtagtttcgaacgtacggtagtaccgggtaccgtaccctagtccgggtacgtttacgaggtcggcgtaggtcgacgttcggtaggtactagttactttcccgtacctacaccgtactcgtaacggactacggtccgtacgtaaccgttaaacgttaggtaacggtttagttttcgaaccctttaacgtttaccgttacgttactaacctaacgtacggtaacctcccgtaaccgtacccttaacccccggtacttaaaccctttacggtttaccccggtaaccgggaaccgggtaacccgtagggtaccggtaccttaaacggttaaacctaaaacggttaccgtacgggttacgaccggttaccgtaacccgactaccgtttaccggtccctttaccg

SEQ ID NO: 234499 - DNA, 770 bp, Homo sapiens
  misc_feature: GYAE6OF02JI16A.2.43.D10.1.454.CMB.1.raw
tcagacgctcgacacacgaccggtgctcgatttagactagcagtaaggggagtctcaggcaggacacagcatggacatgagggtccccgctcagctcctggggctcctgctactgtggctccgaggtgccagatgtgacatccgactatcgaccctagtcctaccattccctccctgtctgctatctggtggacgaccgagtccacctatctacgttcggccgggataacggtccaaccggtaccgttaaacctaccttaaagttttaaacgttggttaactacgtaacgaaaccgaaaaaccggcgggtccaaccgtccccctagacgtaccttccgtacgacttccgttcgtcgtaccgtccactaccgtaccgtaacgtcgttcgaccgtaagggtaccggtccgtacccgttcccgaagttccggtccggtttaacgcgggttacgacgttaggtacgttacgtcggttacgggtaaccttaagtttccctttccctaaccccgtcgtaaccgtacgtaccgtaccgtcttaccgttacgtaaccgtaacgtaaacgttaggtacgttttacgtttcggtaacctttaccgtttaacgtcgtacgtaaccgtaacggactacgtaccctaacccgaccccgtacccgtacttaacccgtttacgtccggaaccggaacgggtaactacgttaccggattaccggtaaaacgacggttaacgtcgtacgtaaccgtcgaaaccctgttacccttggtaacccttccg

SEQ ID NO: 234500 - DNA, 386 bp, Homo sapiens
  misc_feature: GYAE6OF01BUHT3.49.21.B10.1.454.CMB.1.raw
  modified_base (266)..(266): a, c, t, g, unknown or other
  misc_feature (266)..(266): n is a, c, g, or t
  modified_base (378)..(386): a, c, t, g, unknown or other
  misc_feature (378)..(386): n is a, c, g, or t
tcagagtcgagagacacgaccggtgctcgatttagtgtcgtcgcaaggggacattggtggttataattttgtctcctggtaccaacaccacccagacaaagccccagactcattattatggtgtcggtgaccggccctcaggggtttcgaatcgcttctctggctccaagtccggctacacggcctccctgaccctctctgggctccaggccgaggacgaggctgattattactgcgcctcatatacaaacaacaacatttgggtnttcggcggagggaccaagctgaccgtcctaggtcagcccaaggctgccccctggtcactctgttcccaccctcctctctctcgactctgagcgggctggcaaggcgcatagnnnnnnnnn

SEQ ID NO: 234501 - DNA, 383 bp, Homo sapiens
  misc_feature: GYAE6OF01DOF9C.49.21.B10.1.454.CMB.1.raw
  modified_base (380)..(383): a, c, t, g, unknown or other
  misc_feature (380)..(383): n is a, c, g, or t
tcagagtcgagagacacgaccggtgctcgatttagtgtcgtcgcaaggggacattggtggttataattttgtctcctggtaccaacaccacccagacaaagccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaacaacaacatttgggtgttcggcggagggaccaagctgaccgtcctaggtcagcccaaggctgccccctcggtcactctgttcccaccctcctctctctcgactctgagcgggctggcaaggcgcatagnnnn

SEQ ID NO: 234502 - DNA, 452 bp, Homo sapiens
  misc_feature: GYAE6OF01CXCOP.49.21.B10.1.454.CMB.1.raw
  modified_base (439)..(452): a, c, t, g, unknown or other
  misc_feature (439)..(452): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggcctacagtccggctacgacggccctcctcgaccctctcgtgggcctccgacggccgaggacgaggctgtattattactgccgcctcatataaccaaaacaacaactagtttgggtgttcggcggacggaccaagctcgaccgtccgtaggtcacgacccgaaggctccgccccccgtcggtaccaccttcgtccgttccccacccctccctccttcctcctccgtaccttcgtggacggccgggtcgtcggacgaaacgggccgactaagtagnnnnnnnnnnnnnn

SEQ ID NO: 234503 - DNA, 393 bp, Homo sapiens
  misc_feature: GYAE6OF01BK23A.49.21.B10.1.454.CMB.1.raw
  modified_base (320)..(320): a, c, t, g, unknown or other
  misc_feature (320)..(320): n is a, c, g, or t
  modified_base (332)..(332): a, c, t, g, unknown or other
  misc_feature (332)..(332): n is a, c, g, or t
  modified_base (344)..(344): a, c, t, g, unknown or other
  misc_feature (344)..(344): n is a, c, g, or t
  modified_base (355)..(355): a, c, t, g, unknown or other
  misc_feature (355)..(355): n is a, c, g, or t
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
  modified_base (384)..(393): a, c, t, g, unknown or other
  misc_feature (384)..(393): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaaacaacaacatttgggtgttcgaggacgggacggaacaagtcgtacgaccgtcgtagcacgaccgagcnccgcccgtcgcnctctccgtcccncctctctctcncgctgngcggcggtcgngacgaggcanannnnnnnnnn

SEQ ID NO: 234504 - DNA, 383 bp, Homo sapiens
  misc_feature: GYAE6OF01ETG4R.49.21.B10.1.454.CMB.1.raw
  modified_base (380)..(383): a, c, t, g, unknown or other
  misc_feature (380)..(383): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaacaacaacatttgggtgttcggcggagggaccaagctgaccgtcctaggtcagcccaaggctgccccctggtcactctgttcccaccctcctctctctcgactctgagcgggctggcaaggcgcatagnnnn

SEQ ID NO: 234505 - DNA, 446 bp, Homo sapiens
  misc_feature: GYAE6OF01EA66B.49.21.B10.1.454.CMB.1.raw
  modified_base (281)..(281): a, c, t, g, unknown or other
  misc_feature (281)..(281): n is a, c, g, or t
  modified_base (403)..(446): a, c, t, g, unknown or other
  misc_feature (403)..(446): n is a, c, g, or t
tcagagtcgagagacacgaccggtgctcgatttagtgtcgtcgcaaggggacgattgggtggttactaattttgtctcctggtaccaacacctacccagacaaagcccccagactcattatttaatggtgtcggtgaccggccctcaggggttttcgaagtcgcttctctgggtctccaagtccggcttacacggcctccctgaccctctctgggctccaggccgaggacgaggggctggattattactgcgcctcatatacaaacaacaacatttgggtnttcggcggagggtaccaagctgaaccgtccgtaggtcagcccaagggcctgccccctggtcacgtctcggttccccgcctcctctctctcgacttctgagcgggctgggcaaggcacatagnnnnnnnnnnnnnnnnnnnnnnnnnnnnnnnnnnnnnnnnnnnn

SEQ ID NO: 234506 - DNA, 388 bp, Homo sapiens
  misc_feature: GYAE6OF01AZTRG.49.21.B10.1.454.CMB.1.raw
  modified_base (381)..(388): a, c, t, g, unknown or other
  misc_feature (381)..(388): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaacaacaacatttgggtgttcggcggagggaccaagctgaccgtcctaggtcagcccaaggctgccccctcggtcactctgttcccgccctcctctctctcgactctgagcgggctggcaaggcgcatagnnnnnnnn

SEQ ID NO: 234507 - DNA, 389 bp, Homo sapiens
  misc_feature: GYAE6OF01CKRIL.49.21.B10.1.454.CMB.1.raw
  modified_base (267)..(267): a, c, t, g, unknown or other
  misc_feature (267)..(267): n is a, c, g, or t
  modified_base (381)..(389): a, c, t, g, unknown or other
  misc_feature (381)..(389): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaacaacaacatttgggngttcggcggagggaccaagctgaccgtcctaggtcagcccaaggctgccccctggtcactctgttccccgccctcctctctctcgactctgagcgggctggcaaggcgcatagnnnnnnnnn

SEQ ID NO: 234508 - DNA, 382 bp, Homo sapiens
  misc_feature: GYAE6OF01DB9IA.49.21.B10.1.454.CMB.1.raw
  modified_base (267)..(267): a, c, t, g, unknown or other
  misc_feature (267)..(267): n is a, c, g, or t
  modified_base (374)..(374): a, c, t, g, unknown or other
  misc_feature (374)..(374): n is a, c, g, or t
  modified_base (380)..(382): a, c, t, g, unknown or other
  misc_feature (380)..(382): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaacaacaacatttgggngttcggcggagggaccaagctgaccgtcctaggtcagcccaaggctgccccctggtcactctgttcccaccctcctctctctcgactctgagcgggctggcaaggcncatagnnn

SEQ ID NO: 234509 - DNA, 383 bp, Homo sapiens
  misc_feature: GYAE6OF01CMZK4.49.21.B10.1.454.CMB.1.raw
  modified_base (265)..(265): a, c, t, g, unknown or other
  misc_feature (265)..(265): n is a, c, g, or t
  modified_base (377)..(383): a, c, t, g, unknown or other
  misc_feature (377)..(383): n is a, c, g, or t
tcagagtcgagagacacgaccggtgctcgatttagtgtcgtcgcaaggggacattggtggttataattttgtctcctggtaccaacaccacccagacaaagccccagactcattatttatggtgtcggtgaccggccctcaggggtttcgaatcgcttctctggctccaagtccggctacacggcctccctgaccctctctgggctccaggccgaggacgaggctgattatactgcgcctcatatacaaacaacaacatttgggngttcggcggagggaccaagctgaccgtcctaggtcagcccaaggctgccccctggtcactctgttcccaccctcctctctctcgactctgagcggctggcaaggcgcatagnnnnnnn

SEQ ID NO: 234510 - DNA, 381 bp, Homo sapiens
  misc_feature: GYAE6OF01CO82Z.49.21.B10.1.454.CMB.1.raw
  modified_base (267)..(267): a, c, t, g, unknown or other
  misc_feature (267)..(267): n is a, c, g, or t
  modified_base (378)..(381): a, c, t, g, unknown or other
  misc_feature (378)..(381): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaacaacaacatttgggnttcggcggagggaccaagctgaccgtctaggtcagcccaaggctgccccctggtcactctgttcccaccctctctctctcgactctgacgcgggctggcaaggcgcatagnnnn

SEQ ID NO: 234511 - DNA, 391 bp, Homo sapiens
  misc_feature: GYAE6OF01CF3OL.49.21.B10.1.454.CMB.1.raw
  modified_base (268)..(268): a, c, t, g, unknown or other
  misc_feature (268)..(268): n is a, c, g, or t
  modified_base (383)..(391): a, c, t, g, unknown or other
  misc_feature (383)..(391): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaaacaacaacatttgggngttcggcggaggaccaagctgaccgtcctaggtcagcccaaggctcgccccctcggtcactctgttcccgccctcctctctctcgactctgacgcgggctggcaaggcgcatagnnnnnnnnn

SEQ ID NO: 234512 - DNA, 393 bp, Homo sapiens
  misc_feature: GYAE6OF01C9CIB.49.21.B10.1.454.CMB.1.raw
  modified_base (266)..(266): a, c, t, g, unknown or other
  misc_feature (266)..(266): n is a, c, g, or t
  modified_base (375)..(375): a, c, t, g, unknown or other
  misc_feature (375)..(375): n is a, c, g, or t
  modified_base (381)..(393): a, c, t, g, unknown or other
  misc_feature (381)..(393): n is a, c, g, or t
tcagagtcgagagacacgaccggtgctcgatttagtgtcgtcgcaaggggacattggtggttataattttgtctcctggtaccaacaccacccagacaaagccccagactcattatttatggtgtcggtgaccggccctcaggggtttcgaatcgcttctctggctccaagtccggctacacggcctccctgaccctctctgggctccaggccgaggacgaggctgattatactgcgcctcatatacaaaacaacaacatttgggngttcggcggagggaccaagctgaccgtcctaggtcagcccaaggctgccccctggtcactctcgttccccaccctcctctctctcgactctgagcgggctggcaaggcncatagnnnnnnnnnnnnn

SEQ ID NO: 234513 - DNA, 387 bp, Homo sapiens
  misc_feature: GYAE6OF01CCH3E.49.21.B10.1.454.CMB.1.raw
  modified_base (267)..(267): a, c, t, g, unknown or other
  misc_feature (267)..(267): n is a, c, g, or t
  modified_base (380)..(387): a, c, t, g, unknown or other
  misc_feature (380)..(387): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaacaacaacatttgggngttcggcggagggaccaagctgaccgtcctaggtcagcccaaggctgccccctcggtcactctgttcccaccctcctctctctcgactctgagcggctggcaaggcgcatagnnnnnnnn

SEQ ID NO: 234514 - DNA, 588 bp, Homo sapiens
  misc_feature: GYAE6OF01C80AR.49.21.B10.1.454.CMB.1.raw
  modified_base (130)..(130): a, c, t, g, unknown or other
  misc_feature (130)..(130): n is a, c, g, or t
  modified_base (137)..(137): a, c, t, g, unknown or other
  misc_feature (137)..(137): n is a, c, g, or t
  modified_base (205)..(205): a, c, t, g, unknown or other
  misc_feature (205)..(205): n is a, c, g, or t
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (494)..(496): a, c, t, g, unknown or other
  misc_feature (494)..(496): n is a, c, g, or t
  modified_base (500)..(500): a, c, t, g, unknown or other
  misc_feature (500)..(500): n is a, c, g, or t
  modified_base (511)..(511): a, c, t, g, unknown or other
  misc_feature (511)..(511): n is a, c, g, or t
  modified_base (519)..(519): a, c, t, g, unknown or other
  misc_feature (519)..(519): n is a, c, g, or t
  modified_base (521)..(521): a, c, t, g, unknown or other
  misc_feature (521)..(521): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
  modified_base (529)..(529): a, c, t, g, unknown or other
  misc_feature (529)..(529): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (554)..(554): a, c, t, g, unknown or other
  misc_feature (554)..(554): n is a, c, g, or t
  modified_base (556)..(556): a, c, t, g, unknown or other
  misc_feature (556)..(556): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
  modified_base (562)..(563): a, c, t, g, unknown or other
  misc_feature (562)..(563): n is a, c, g, or t
  modified_base (565)..(567): a, c, t, g, unknown or other
  misc_feature (565)..(567): n is a, c, g, or t
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
  modified_base (581)..(582): a, c, t, g, unknown or other
  misc_feature (581)..(582): n is a, c, g, or t
  modified_base (584)..(585): a, c, t, g, unknown or other
  misc_feature (584)..(585): n is a, c, g, or t
tcagagtcgagagacacgaccggtgctcgatttagtgtcgtcgcaagggggtacggattggtggttataattttgtctcctggtaccgaacaccacccagacaaagccccagactcattatttatcggtntccggtnaccgcctcagggggtttcaatcggcttcgtctggctccaacgtccggctacacggcctcctgaccctntctgggctccaggccgaggcgaaggctacgattacttactgcgccttcgaactatacaaacaacaactagttttgggtattacggtcggaggtacctaaggaccgttacggaacgtcccgtaacgggtaccaacggtacccaacgggaccttcggacccccttgggtacctacgtttcgtacgtttcccacccttccgttccttcttccgtccgttacgttacgttcggaacggtccgggtcttcgggtaccgaagggccgtacgacggttacgcacncgcnctncncnnncgcncgcgcgagcgngcatatcncncncncnanacanancnanagagtgngngcgacncncncncnncnnncncncncncncncnncnnctc

SEQ ID NO: 234515 - DNA, 391 bp, Homo sapiens
  misc_feature: GYAE6OF01BI5KK.49.21.B10.1.454.CMB.1.raw
  modified_base (382)..(391): a, c, t, g, unknown or other
  misc_feature (382)..(391): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaacaacaacatttgggtgttcggcggagggaccaaggctgaccgtctaggtcagcccaaggctgccccctggtcactctcgttccccaccctcctctctctcgactctgagcgggctggcaaggcgcatagnnnnnnnnnn

SEQ ID NO: 234516 - DNA, 390 bp, Homo sapiens
  misc_feature: GYAE6OF01DLAM5.49.21.B10.1.454.CMB.1.raw
  modified_base (266)..(266): a, c, t, g, unknown or other
  misc_feature (266)..(266): n is a, c, g, or t
  modified_base (380)..(390): a, c, t, g, unknown or other
  misc_feature (380)..(390): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaacacaacatttgggngttcggcggagggaccaagctgaccgtcctaggtcagcccaaggctgccccctggtcactctcgttcccaccctcctctctctcgactctgagcgggctggcaaggcgcatagnnnnnnnnnnn

SEQ ID NO: 234517 - DNA, 393 bp, Homo sapiens
  misc_feature: GYAE6OF01A6POA.49.21.B10.1.454.CMB.1.raw
  modified_base (382)..(393): a, c, t, g, unknown or other
  misc_feature (382)..(393): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaacaacaacatttgggtgttcggcggagggaccaagctgaccgtcctaggtcagcccaaggctcgccccctcggtcactctcgtccccgccctcctctctctcgactctgagcggctggcaaggcgcatagnnnnnnnnnnnn

SEQ ID NO: 234518 - DNA, 403 bp, Homo sapiens
  misc_feature: GYAE6OF01BHEIW.49.21.B10.1.454.CMB.1.raw
  modified_base (389)..(403): a, c, t, g, unknown or other
  misc_feature (389)..(403): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgacccctctctgggctccaggccgaggaccgaggctgattattactgcgcctcatataacaaaacaacaactatttgggtgttcggcggaggaccaagctgaccgtctaggtcagcccaaggctcgccccctcggtcactctcgtcccgccctcctctctctcactctgacgcggctggacgaacggcgcaatacgnnnnnnnnnnnnnnn

SEQ ID NO: 234519 - DNA, 410 bp, Homo sapiens
  misc_feature: GYAE6OF01CNGLH.49.21.B10.1.454.CMB.1.raw
  modified_base (243)..(243): a, c, t, g, unknown or other
  misc_feature (243)..(243): n is a, c, g, or t
  modified_base (269)..(269): a, c, t, g, unknown or other
  misc_feature (269)..(269): n is a, c, g, or t
  modified_base (396)..(410): a, c, t, g, unknown or other
  misc_feature (396)..(410): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctnatatacaaaacaacaacatttggggngttcgggcggaagggaccaagctgaccgtcctaggtcagcccaaggctcgcccctcggtcacttctcgttccccaccctcctctctcctcgactctcgaggcgggcgtcggcgaaggccgacatagnnnnnnnnnnnnnnn

SEQ ID NO: 234520 - DNA, 517 bp, Homo sapiens
  misc_feature: GYAE6OF01CMEF5.49.21.B10.1.454.CMB.1.raw
  modified_base (201)..(201): a, c, t, g, unknown or other
  misc_feature (201)..(201): n is a, c, g, or t
  modified_base (250)..(250): a, c, t, g, unknown or other
  misc_feature (250)..(250): n is a, c, g, or t
  modified_base (482)..(482): a, c, t, g, unknown or other
  misc_feature (482)..(482): n is a, c, g, or t
  modified_base (490)..(517): a, c, t, g, unknown or other
  misc_feature (490)..(517): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcgaggggtttcgaatcgcttctctggctccaagtccggctacacggcctccctgacccctntctgggctccgaggccgaagggaccgaggctgattattactgccgcctnaataataacaaaaacaaacaactagttttgggggtagttaccggggcggggaaacggggaacccaaaggtccttcggaacccgttaccgttaagggtccaacggcccccgaaaagggccttaccggcccccccgttcgggtacctaaccgttcttccggttcccccgtccccttccctccgtctcctacggacctcgtggaacggccgggactcggacgaaacggcccgganaagtaagnnnnnnnnnnnnnnnnnnnnnnnnnnnn

SEQ ID NO: 234521 - DNA, 405 bp, Homo sapiens
  misc_feature: GYAE6OF01CJ57N.49.21.B10.1.454.CMB.1.raw
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
  modified_base (395)..(405): a, c, t, g, unknown or other
  misc_feature (395)..(405): n is a, c, g, or t
tcagagtcgagagacacgaccggtgctcgatttagtgtcgtcgcaaggggacattggtggttataattttgtctcctggtaccaacaccacccagacaaagccccagactcattatttatggtgtcggtgaccggccctcaggggtttcgaatcgcttctctggctccaagtccggctacacggcctccctgaccctctctgggctccaggccgaggacgaggctgattattactgccgcctcatatacaaaacaacaactagtttgggtgttcggacgggagggaccaagctacggaccgtctaggtcacgacccaaggcctcgccccccgtcggtccacctctcgttcccaccctcctctctctcgactctgngcggntggcgacgcgcatgnnnnnnnnnnn

SEQ ID NO: 234522 - DNA, 400 bp, Homo sapiens
  misc_feature: GYAE6OF01BQTVP.49.21.B10.1.454.CMB.1.raw
  modified_base (276)..(276): a, c, t, g, unknown or other
  misc_feature (276)..(276): n is a, c, g, or t
  modified_base (343)..(343): a, c, t, g, unknown or other
  misc_feature (343)..(343): n is a, c, g, or t
  modified_base (385)..(385): a, c, t, g, unknown or other
  misc_feature (385)..(385): n is a, c, g, or t
  modified_base (387)..(400): a, c, t, g, unknown or other
  misc_feature (387)..(400): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctcatataacaaacaacaactatttgggtgttcggnggagggaccaagctgaccgtcctaggtcacgcccaaggctcgccccctcggtcactctcgttccccnccctcctctctctcgactctgacgcggctggcaggcgcatgncnnnnnnnnnnnnnn

SEQ ID NO: 234523 - DNA, 478 bp, Homo sapiens
  misc_feature: GYAE6OF01DQVWD.49.21.B10.1.454.CMB.1.raw
  modified_base (243)..(243): a, c, t, g, unknown or other
  misc_feature (243)..(243): n is a, c, g, or t
  modified_base (457)..(478): a, c, t, g, unknown or other
  misc_feature (457)..(478): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcgaggggtttcgaatcgcttctctggctccaagtccggctacacggcctccctgaccctctcgtgggctccaggccgaggacgaggctgattatactgcgctnatataacaaaacaacaactagttttcgggtgttcgggacggagggacccaaagcctaggtacccgtccgttaaggtccacggccccgaagggtcctccggtccccccttcgggtacccaaccttccgtttccggttccccctaccccgttcccttcctccttccgttacgaccttcgtaggcgccggggtctgggaccaaggcgacacgtagcnnnnnnnnnnnnnnnnnnnnnn

SEQ ID NO: 234524 - DNA, 434 bp, Homo sapiens
  misc_feature: GYAE6OF01DFB5H.49.21.B10.1.454.CMB.1.raw
  modified_base (268)..(268): a, c, t, g, unknown or other
  misc_feature (268)..(268): n is a, c, g, or t
  modified_base (385)..(386): a, c, t, g, unknown or other
  misc_feature (385)..(386): n is a, c, g, or t
  modified_base (389)..(434): a, c, t, g, unknown or other
  misc_feature (389)..(434): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaaacacaactatttgggngttcggcggaggaccaagctgaccgtcctaggtcagcccaaggctcgccccctggtcactctcgtcccgccctcctctctcgtcgactctgagcggctggcgaaggccgacagtagnngcnnnnnnnnnnnnnnnnnnnnnnnnnnnnnnnnnnnnnnnnnnnnnn

SEQ ID NO: 234525 - DNA, 420 bp, Homo sapiens
  misc_feature: GYAE6OF01ESEAC.49.21.B10.1.454.CMB.1.raw
  modified_base (163)..(163): a, c, t, g, unknown or other
  misc_feature (163)..(163): n is a, c, g, or t
  modified_base (246)..(246): a, c, t, g, unknown or other
  misc_feature (246)..(246): n is a, c, g, or t
  modified_base (393)..(393): a, c, t, g, unknown or other
  misc_feature (393)..(393): n is a, c, g, or t
  modified_base (399)..(420): a, c, t, g, unknown or other
  misc_feature (399)..(420): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcgaggggtttcgaatcgcttctntggctccaagtccggctacacggccctccctgacccctctcgtgggcctccgaggccgaggacgaggcctgattattctgccncctcatacaacaaaacaacaactgtttgggtgtcggcggaggacaagctacgaccgtcgtagtcacgacccaggcctcgccccctggtcactcgtcgtccccgcctcctctctctcgtactcgtgacgcggctggacgaacggcganactagnnnnnnnnnnnnnnnnnnnnnn

SEQ ID NO: 234526 - DNA, 388 bp, Homo sapiens
  misc_feature: GYAE6OF01B1S8D.49.21.B10.1.454.CMB.1.raw
  modified_base (373)..(373): a, c, t, g, unknown or other
  misc_feature (373)..(373): n is a, c, g, or t
  modified_base (380)..(388): a, c, t, g, unknown or other
  misc_feature (380)..(388): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattatactgcgcctcatatacaaacaacaacatttgggtgtgggcggaggaccaagctgaccgtcctaggtcagcccaaggctgccccctcggtcactctgtcccaccctcctctctctcgactctgacgcgggctggcaaggcgnacgtagnnnnnnnnn

SEQ ID NO: 234527 - DNA, 381 bp, Homo sapiens
  misc_feature: GYAE6OF02IK3EL.49.21.B10.1.454.CMB.1.raw
  modified_base (377)..(381): a, c, t, g, unknown or other
  misc_feature (377)..(381): n is a, c, g, or t
tcagagtcgagagacacgaccggtgctcgatttagtgtcgtcgcaagggacattggtggttataatttgtctcctggtaccaacaccacccagacaaagccccagactcattattatggtgtcggtgaccggccctcaggggtttcgaatcgcttctctggctccaagtccggctacacggcctccctgaccctctctgggctccaggccgaggacgaggctgattattactgcgcctcatatacaaacaacaacatttgggtgttcggcggagggaccaagctgaccgtcctaggtcagcccaaggctgccccctcggtcactctgttcccaccctcctctctctcgactctgagcgggctggcaaggcgcatagnnnnn

SEQ ID NO: 234528 - DNA, 383 bp, Homo sapiens
  misc_feature: GYAE6OF02HOFMT.49.21.B10.1.454.CMB.1.raw
  modified_base (377)..(383): a, c, t, g, unknown or other
  misc_feature (377)..(383): n is a, c, g, or t
tcagagtcgagagacacgaccggtgctcgatttagtgtcgtcgcaaggggacattggtggttataatttgtctcctggtaccaacaccacccagacaaagccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaacaacaacatttgggtgttcggcggagggaccaagctgaccgtcctaggtcagcccaaggctgcccctcggtcactctgtcccaccctcctctctctcgactctgagcgggctggcaaggcgcatagnnnnnnn

SEQ ID NO: 234529 - DNA, 385 bp, Homo sapiens
  misc_feature: GYAE6OF02I6NFM.49.21.B10.1.454.CMB.1.raw
  modified_base (264)..(264): a, c, t, g, unknown or other
  misc_feature (264)..(264): n is a, c, g, or t
  modified_base (377)..(385): a, c, t, g, unknown or other
  misc_feature (377)..(385): n is a, c, g, or t
tcagagtcgagagacacgaccggtgctcgatttagtgtcgtcgcaagggacattggtggttataatttgtctcctggtaccaacaccacccagacaaagccccagactcattatttatggtgtcggtgaccggccctcaggggttcgaatcgcttctctggctccaagtccggctacacggcctccctgaccctctctgggctccaggccgaggacgaggctgattattactgcagctcatatacaaacataaaacacttgggngttcggcggcgggaccaaactgaccgtcctacgtcagcccaaggctgccccctcggtcactctgttcccgccctcctctctctcgactctgagcggctggcaaggcgcatagnnnnnnnnn

SEQ ID NO: 234530 - DNA, 389 bp, Homo sapiens
  misc_feature: GYAE6OF02HB1TD.49.21.B10.1.454.CMB.1.raw
  modified_base (384)..(389): a, c, t, g, unknown or other
  misc_feature (384)..(389): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggccccctgattattactgcgcctcatatacaaacaacaacatttgggtgttcggcggagggaccaagctgaccgtcctaggtcagcccaaggctgcccctcggtcactctgttcccaccctcctctctctcgactctgagcgggctggcaaggcgcatagnnnnnn

SEQ ID NO: 234531 - DNA, 385 bp, Homo sapiens
  misc_feature: GYAE6OF02GTJ48.49.21.B10.1.454.CMB.1.raw
  modified_base (267)..(267): a, c, t, g, unknown or other
  misc_feature (267)..(267): n is a, c, g, or t
  modified_base (379)..(385): a, c, t, g, unknown or other
  misc_feature (379)..(385): n is a, c, g, or t
tcagagtcgagagacacgaccggtgctcgatttagtgtcgtcgcaaggggacattggtggttataattttgtctcctggtaccaacaccacccagacaaagccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaacaacaacatttgggtnttcggcggagggaccaagctgaccgtcctaggtcagcccaaggctgccccctcggtcactctgttcccgcctcctctctctcgactctgagcgggctggcaaggcgcatagnnnnnnn

SEQ ID NO: 234532 - DNA, 384 bp, Homo sapiens
  misc_feature: GYAE6OF02GB9IG.49.21.B10.1.454.CMB.1.raw
  modified_base (380)..(384): a, c, t, g, unknown or other
  misc_feature (380)..(384): n is a, c, g, or t
tcagagtcgagagacacgaccggtgctcgatttagtgtcgtcgcaaggggacattggtggttataattttgtctcctggtaccaacaccacccagacaaagccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaacaacaacatttgggtgttcggcggagggaccaagctgaccgtcctaggtcagcccaaggctgccccctcggtcactctgttcccaccctcctctctctcgactctgagcgggctggcaaggcgcatagnnnnn

SEQ ID NO: 234533 - DNA, 386 bp, Homo sapiens
  misc_feature: GYAE6OF02IXI1O.49.21.B10.1.454.CMB.1.raw
  modified_base (380)..(386): a, c, t, g, unknown or other
  misc_feature (380)..(386): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaaacaacaacatttgggtgttcggcggagggaccaagctgaccgtcctaggtcagcccaaggctgccccctggtcactctgttcccacctcctctctctcgactctgagcgggctggcaaggcgcatagnnnnnnn

SEQ ID NO: 234534 - DNA, 385 bp, Homo sapiens
  misc_feature: GYAE6OF02GEN7Q.49.21.B10.1.454.CMB.1.raw
  modified_base (373)..(373): a, c, t, g, unknown or other
  misc_feature (373)..(373): n is a, c, g, or t
  modified_base (379)..(385): a, c, t, g, unknown or other
  misc_feature (379)..(385): n is a, c, g, or t
tcagagtcgagagacacgaccggtgctcgatttagtgtcgtcgcaaggggacattggtggttataattttgtctcctggtaccaacaccacccagacaaagccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaacaacaacatttgggtgttcggcggagggaccaagctgaccgtcctaggtcagcccaaggctgccccctggtcactctgttcccaccctcctctctctcgactctgagcgggctggcaaggcncatagnnnnnnn

SEQ ID NO: 234535 - DNA, 383 bp, Homo sapiens
  misc_feature: GYAE6OF02F40R8.49.21.B10.1.454.CMB.1.raw
  modified_base (380)..(383): a, c, t, g, unknown or other
  misc_feature (380)..(383): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaacaacaacatttgggtgttcggcggagggaccaagctgaccgtcctaggtcagcccaaggctgccccctcggtcactctgttcccgccctcctctctctcgactctgagcggctggcaaggcgcatagnnnn

SEQ ID NO: 234536 - DNA, 398 bp, Homo sapiens
  misc_feature: GYAE6OF02IUYUT.49.21.B10.1.454.CMB.1.raw
  modified_base (269)..(269): a, c, t, g, unknown or other
  misc_feature (269)..(269): n is a, c, g, or t
  modified_base (382)..(398): a, c, t, g, unknown or other
  misc_feature (382)..(398): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaacaacaacattttggggngttcggcggagggaccaagctgaccgtctaggtcagcccaaggctgccccctcggtcactctgtccccacctctctctctcgactctgagcggctggccaaggccgcagtagnnnnnnnnnnnnnnnnn

SEQ ID NO: 234537 - DNA, 390 bp, Homo sapiens
  misc_feature: GYAE6OF02JWF9A.49.21.B10.1.454.CMB.1.raw
  modified_base (378)..(390): a, c, t, g, unknown or other
  misc_feature (378)..(390): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaacaacaacatttgggtgttcggcggagggaccaagctgaccgtcctaggtcagcccaaggctgccccctcggtcactctgtccccacctcctctctctcgactctgagcggctggcaagcgcatagnnnnnnnnnnnnn

SEQ ID NO: 234538 - DNA, 429 bp, Homo sapiens
  misc_feature: GYAE6OF02HJ1Z9.49.21.B10.1.454.CMB.1.raw
  modified_base (274)..(274): a, c, t, g, unknown or other
  misc_feature (274)..(274): n is a, c, g, or t
  modified_base (374)..(374): a, c, t, g, unknown or other
  misc_feature (374)..(374): n is a, c, g, or t
  modified_base (392)..(429): a, c, t, g, unknown or other
  misc_feature (392)..(429): n is a, c, g, or t
tcagagtcgagagacacgaccggtgctcgatttagtgtcgtcgcaaggggacgtagttggtggttataacttttgtctcctggtaccaacaccacccagacaaagcccccaggacctcattatttatggtggtcggtgaccggccctcagggtttcgaatcgcttctctggctccaagtccggctacacggcctccctgaccctctctgggcctccaggccgaggacgaggctgattatactgcgcctcatatacaaacgaacaacatttgggnttcggcggagggaccaagctgaccgtctaggtcagcccaaggcctggccccctggtccactctgttccccgccctcctctctcccgactctgagcgggcnggcgaacggcgcactagnnnnnnnnnnnnnnnnnnnnnnnnnnnnnnnnnnnnnn

SEQ ID NO: 234539 - DNA, 456 bp, Homo sapiens
  misc_feature: GYAE6OF02J2GZ6.49.21.B10.1.454.CMB.1.raw
  modified_base (232)..(232): a, c, t, g, unknown or other
  misc_feature (232)..(232): n is a, c, g, or t
  modified_base (347)..(347): a, c, t, g, unknown or other
  misc_feature (347)..(347): n is a, c, g, or t
  modified_base (408)..(408): a, c, t, g, unknown or other
  misc_feature (408)..(408): n is a, c, g, or t
  modified_base (422)..(422): a, c, t, g, unknown or other
  misc_feature (422)..(422): n is a, c, g, or t
  modified_base (426)..(428): a, c, t, g, unknown or other
  misc_feature (426)..(428): n is a, c, g, or t
  modified_base (432)..(456): a, c, t, g, unknown or other
  misc_feature (432)..(456): n is a, c, g, or t
tcagagtcgagagacacgaccggtgctcgatttagtgtcgtcgcaagggacattggtggttataatttgtctcctggtaccaacaccacccagacaaagccccagactcattattatggtgtcgtgaccggccctcaggggtttcaatcgcttctctggctccaagtccggctacacggcctccctgacccctctctgggctccaggccgaggaccgaggctgatttatacngccgcctcatataccaaaacaacaactagtttgggtgttccggcggagggaccaagcctgacccgtcctaggcagaccccaaggcctcgcccccctggtcactcctcgttccccnccccgttcctacctcgtcctccggactccgtggaggccgggtctcggggccaaggggtccncgtattacggctcncgcnnntacnnnnnnnnnnnnnnnnnnnnnnnnn

SEQ ID NO: 234540 - DNA, 395 bp, Homo sapiens
  misc_feature: GYAE6OF02FQY8Y.49.21.B10.1.454.CMB.1.raw
  modified_base (375)..(376): a, c, t, g, unknown or other
  misc_feature (375)..(376): n is a, c, g, or t
  modified_base (380)..(395): a, c, t, g, unknown or other
  misc_feature (380)..(395): n is a, c, g, or t
tcagagtcgagagacacgaccggtgctcgatttagtgtcgtcgcaaggggacagttggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaacaacaactatttgggtgttcggcggaggaccaagctgaccgtctaggtcagccccaaggctcgccccctggtcactctgttccccgccctcctctctctcgactctgagcggctggcaggcnntagnnnnnnnnnnnnnnnn

SEQ ID NO: 234541 - DNA, 385 bp, Homo sapiens
  misc_feature: GYAE6OF02JXOQP.49.21.B10.1.454.CMB.1.raw
  modified_base (269)..(269): a, c, t, g, unknown or other
  misc_feature (269)..(269): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (376)..(385): a, c, t, g, unknown or other
  misc_feature (376)..(385): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaaacaacaacatttgggtnttcggcggagggaccaagctgaccgtctagtcagcccaaggctgcccctcggtcactctgtcccgccctcctctctcgtcgactctgacgcggntgcgaggcnatgnnnnnnnnnn

SEQ ID NO: 234542 - DNA, 421 bp, Homo sapiens
  misc_feature: GYAE6OF02HRF07.49.21.B10.1.454.CMB.1.raw
  modified_base (392)..(421): a, c, t, g, unknown or other
  misc_feature (392)..(421): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtctggcagcacggcctccctgaccatctctgggctccaggctgaggacgaggctgattattactgcagctcatatacaaacataaacacttgggtgttcggcggcgggaccaaaactcgtaccgtcctacgtcagccccaaggcctgcccccctggtcacttctcgttccccacctcctctctctcgactctgacgcgggctcggcaacggcgcagtagnnnnnnnnnnnnnnnnnnnnnnnnnnnnnn

SEQ ID NO: 234543 - DNA, 392 bp, Homo sapiens
  misc_feature: GYAE6OF02HWJ35.49.21.B10.1.454.CMB.1.raw
  modified_base (276)..(276): a, c, t, g, unknown or other
  misc_feature (276)..(276): n is a, c, g, or t
  modified_base (377)..(377): a, c, t, g, unknown or other
  misc_feature (377)..(377): n is a, c, g, or t
  modified_base (381)..(392): a, c, t, g, unknown or other
  misc_feature (381)..(392): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgacccctctctgggctccaggccgaggacgaggctgattattactgcgcctcatatacaaacaacaactatttgggtgttcggnggagggaccaagctgaccgtcctaggtcagcccaaggctcgccccctggtcactctcgtccccaccttcctctctctcgactctgagcggctgcaggcgcntagnnnnnnnnnnnn

SEQ ID NO: 234544 - DNA, 389 bp, Homo sapiens
  misc_feature: GYAE6OF02GN2X2.49.21.B10.1.454.CMB.1.raw
  modified_base (374)..(374): a, c, t, g, unknown or other
  misc_feature (374)..(374): n is a, c, g, or t
  modified_base (380)..(389): a, c, t, g, unknown or other
  misc_feature (380)..(389): n is a, c, g, or t
tcagagtcgagagacacgaccggtgctcgatttagtgtcgtcgcaaggggacattggtggttataattttgtctcctggtaccaacaccacccagacaaagccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaacaacaacatttgggtgttcggcggagggaccaagctgaccgtcctaggtcagcccaaggctgccccctcggtcactctgttccccaccctcctctctctcgactctgagcggctggcaaggcncatagnnnnnnnnnn

SEQ ID NO: 234545 - DNA, 396 bp, Homo sapiens
  misc_feature: GYAE6OF02F55DQ.49.21.B10.1.454.CMB.1.raw
  modified_base (268)..(268): a, c, t, g, unknown or other
  misc_feature (268)..(268): n is a, c, g, or t
  modified_base (375)..(375): a, c, t, g, unknown or other
  misc_feature (375)..(375): n is a, c, g, or t
  modified_base (380)..(396): a, c, t, g, unknown or other
  misc_feature (380)..(396): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaacaacaactatttgggngttcggcggagggaccaagctgaccgtctaggtcagcccaaggctcgccccctggtcactctcgtccccgccctcctctctctcactctgacgcggctggcaagcgnatagnnnnnnnnnnnnnnnnn

SEQ ID NO: 234546 - DNA, 391 bp, Homo sapiens
  misc_feature: GYAE6OF02HMJ2Y.49.21.B10.1.454.CMB.1.raw
  modified_base (273)..(273): a, c, t, g, unknown or other
  misc_feature (273)..(273): n is a, c, g, or t
  modified_base (362)..(362): a, c, t, g, unknown or other
  misc_feature (362)..(362): n is a, c, g, or t
  modified_base (380)..(380): a, c, t, g, unknown or other
  misc_feature (380)..(380): n is a, c, g, or t
  modified_base (385)..(391): a, c, t, g, unknown or other
  misc_feature (385)..(391): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggttttcgaatcgcttctctggctccaagtccggctacacggcctccctgacccctctctgggctccaggccgaggacgaggctgattattactgcgcctcatataacaaaacaacaactatttgggtnttcggcggaggaccaagctgaccgtcctaggtcacgccaaggctcgccccctcggtcactctcgttcccaccctcctctctctcgactntgagcggctggacaggcnatagnnnnnnn

SEQ ID NO: 234547 - DNA, 418 bp, Homo sapiens
  misc_feature: GYAE6OF02GX9BZ.49.21.B10.1.454.CMB.1.raw
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
  modified_base (364)..(364): a, c, t, g, unknown or other
  misc_feature (364)..(364): n is a, c, g, or t
  modified_base (381)..(381): a, c, t, g, unknown or other
  misc_feature (381)..(381): n is a, c, g, or t
  modified_base (387)..(388): a, c, t, g, unknown or other
  misc_feature (387)..(388): n is a, c, g, or t
  modified_base (390)..(418): a, c, t, g, unknown or other
  misc_feature (390)..(418): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggccctccctgacccctctctggctccaggccgaggacgaggctgattattactgcgcctnatatacaaacanaactnttggtgttcggcggaggaccaagctgaccgtcctaggtcacgacccgaaggctcgaccccccgtggtcacctcgtcgttccccgccctcctctctctcgctcngacgcggctgacaggcnagtagnncnnnnnnnnnnnnnnnnnnnnnnnnnnnnn

SEQ ID NO: 234548 - DNA, 391 bp, Homo sapiens
  misc_feature: GYAE6OF02GTHRI.49.21.B10.1.454.CMB.1.raw
  modified_base (270)..(270): a, c, t, g, unknown or other
  misc_feature (270)..(270): n is a, c, g, or t
  modified_base (381)..(391): a, c, t, g, unknown or other
  misc_feature (381)..(391): n is a, c, g, or t
tcagagtcgagagacacgaccggtgctcgatttagtgtcgtcgcaagggggacattggtggttataattttgtctcctggtaccaacaccacccagacaaagcccccagactcattatttatggtgtcggtgaccggccctcaggggtttcgaatcgcttctctggctccaagtccggctacacggcctccctgacccctctctgggctccaggccgaggacgaggctgattattactgcgcctcatatacaaaacaacaacatttgggnttcggcggaggaccaagctgaccgtcctaggtcagcccaaggctgccccctggtcactctgtcccaccctcctctctctcgactctgagcgggctggacaaggcgcatagnnnnnnnnnnn

SEQ ID NO: 234549 - DNA, 457 bp, Homo sapiens
  misc_feature: GYAE6OF02FF32G.49.21.B10.1.454.CMB.1.raw
  modified_base (393)..(393): a, c, t, g, unknown or other
  misc_feature (393)..(393): n is a, c, g, or t
  modified_base (405)..(405): a, c, t, g, unknown or other
  misc_feature (405)..(405): n is a, c, g, or t
  modified_base (428)..(457): a, c, t, g, unknown or other
  misc_feature (428)..(457): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtcccggctacacggccctccctgaccctctctgggcctccaggcccggagggaccggggtctgatttattacgtgccgccttcatactaaccaaaccaacactagttttgggtagttccgggacggaggaccaagctcgaccgttccgtaggtccaacgccccgaaaggcctcgccccccgtgtccactctcgtccccaccctctccactcctccactcgngacggccggggntcggacgaacggcgcaagtcgcnnnnnnnnnnnnnnnnnnnnnnnnnnnnnn

SEQ ID NO: 234550 - DNA, 415 bp, Homo sapiens
  misc_feature: GYAE6OF02G9YQ8.49.21.B10.1.454.CMB.1.raw
  modified_base (271)..(271): a, c, t, g, unknown or other
  misc_feature (271)..(271): n is a, c, g, or t
  modified_base (345)..(345): a, c, t, g, unknown or other
  misc_feature (345)..(345): n is a, c, g, or t
  modified_base (392)..(415): a, c, t, g, unknown or other
  misc_feature (392)..(415): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctcatataacaaacaacaactagtttgggtnttcggcggagggaccaagctgaccgtcctaggtcacgcccgaaggctcgccccctcggccactctcgttccccncctcctctctctcgctctcgagcggcgtcggcgaacggcgcagtagnnnnnnnnnnnnnnnnnnnnnnnn

SEQ ID NO: 234551 - DNA, 404 bp, Homo sapiens
  misc_feature: GYAE6OF02HOWDR.49.21.B10.1.454.CMB.1.raw
  modified_base (385)..(404): a, c, t, g, unknown or other
  misc_feature (385)..(404): n is a, c, g, or t
tcagagtcgagagacacgaccggtgctcgatttagtgtcgtcgcaagggggacattggtggttataattttgtctcctggtaccaacaccacccagacaaagcccccagactcattatttatggtgtcggtgaccggccctcaggggtttcgaatcgcttctctggctccaagtccggctacacggcctccctgacccctctctgggctccaggccgaggacgaggctgattattactgcgcctcatatacaaacaacaacatttgggtgttcggcggagggaccaaagctgaccgtcctaaggtcagcccaaggctcgaccccctggtcactctacgtcccgccctctctctctcgactctgagcggctggcaaggcgcatagnnnnnnnnnnnnnnnnnnnn

SEQ ID NO: 234552 - DNA, 398 bp, Homo sapiens
  misc_feature: GYAE6OF02HUMYR.49.21.B10.1.454.CMB.1.raw
  modified_base (342)..(342): a, c, t, g, unknown or other
  misc_feature (342)..(342): n is a, c, g, or t
  modified_base (386)..(398): a, c, t, g, unknown or other
  misc_feature (386)..(398): n is a, c, g, or t
tcagagtcgagagacacgaccggtgctcgatttagtgtcgtcgcaaggggacattggtggttataattttgtctcctggtaccaacaccacccagacaaagcccccagactcattatttatggtgtcggtgaccggccctcaggggtttcgaatcgcttctctggctccaagtccggctacacggcctccctgccctctctgggctccaggccgaggacgaggctgattattactgcgcctcatataacaaaacaaacaactatttgggtgttcggcggagggaccaagctgaccgtcctaggtcacgccaaggctcgccccctcggtcactctcgttcccnccctcctctctctcgactctgagcggctggacacggcgcatagnnnnnnnnnnnnn

SEQ ID NO: 234553 - DNA, 478 bp, Homo sapiens
  misc_feature: GYAE6OF02HGGSY.49.21.B10.1.454.CMB.1.raw
  modified_base (195)..(195): a, c, t, g, unknown or other
  misc_feature (195)..(195): n is a, c, g, or t
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (271)..(271): a, c, t, g, unknown or other
  misc_feature (271)..(271): n is a, c, g, or t
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
  modified_base (422)..(422): a, c, t, g, unknown or other
  misc_feature (422)..(422): n is a, c, g, or t
  modified_base (425)..(425): a, c, t, g, unknown or other
  misc_feature (425)..(425): n is a, c, g, or t
  modified_base (431)..(478): a, c, t, g, unknown or other
  misc_feature (431)..(478): n is a, c, g, or t
tcagagtcgagagacacgaccggtgctcgatttagtgtcgtcgcaagggggacattggtggttataattttgtctcctggtaccaacaccacccagacaaagcccccagactcattatttatggtgtcggtgaccggccctcaggggtttcaatcgctttctctggctccaagtccggctacgacggcctccctnacccctctgtgggctccaggccgaggacgaggctgattatacngcgcctnatataacaaacaacaactatttgggntacggcggaaggaccaatcgagtacccgttccgaaggtcacggacccctaaaggctaccggcccccttggtaccacgtccttcggtcccccacccttcctctctacctcgactctggaggtccggctggaccaaggtccanactagnagangtnagtcannnnnnnnnnnnnnnnnnnnnnnnnnnnnnnnnnnnnnnnnnnnnnnn

SEQ ID NO: 234554 - DNA, 736 bp, Homo sapiens
  misc_feature: GYAE6OF01ARYIX.42.33.C11.1.454.CMB.1.raw
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
tcagtgacgtatgtcacgaccggtgctcgatttagagtgagctcgttgggtttgggggagtcagacccactcaggacacagcatggacatgagggtccccgctcagctcctggggctcctgctgctctggctcccaggtgccagatgtgccatccagatgacccagtctccatcctccctgtctgcgtctgtcggagacagagtcaccattatttgccgggcaagtcagggcattagaatgatttaggcgtagtanganacagacgcggaaggaaccacccgtagtcctacgtagactacgtagtggtcgactactaccttaattacgaaggttacgggttccgggtacccgtaacgtacggttacgacgccgaccgtaggtcgtcgtcggtcggcgtacgtagttacttaccgtacttcctaccaacctactaaccaaacgtccgtccgtacgaccgtacggtaccgttaaggtaaacgttttacggttttaaccggtaactttttaacgtttacgttaccgtttaaccgtaaacggtaaacgtttaccgtttaaccgttaaccccgttttaacccgtacggtaaccttaaccggtacccggggtaaacccggaaaccggggtaaaccgttaacggggggtagtaaacggttaaggtaaaacggggtaaaacgggttacgttaggggttaccggaccgttaccggaacccgtaacccgtgtttcccgggttaccc

SEQ ID NO: 234555 - DNA, 535 bp, Homo sapiens
  misc_feature: GYAE6OF01BVE0A.42.33.C11.1.454.CMB.1.raw
  modified_base (387)..(387): a, c, t, g, unknown or other
  misc_feature (387)..(387): n is a, c, g, or t
  modified_base (527)..(527): a, c, t, g, unknown or other
  misc_feature (527)..(527): n is a, c, g, or t
tcagtgacgtatgtcacgaccggtgctcgatttagagtgagctcgttgggtttgggggagtcagacccactcaggacacagcatggacatgagggtccccgctcagctcctggggctcctgctgctctggctcccaggtgccagatgtgccatccagatgacccagtctccatcctccctgtctgcgtctgtcggagacagagtcaccattatttgccgggcaagtcagggcattagaaatgatttaggctggtatcagcagaagccagggaaacgcccctaagctcctgatctatggtgcatccaattttacagagttcggggtcccgaccgtaggttcagcgccaggtggctcgtgggcgcagtatttcactctcaccatcaacngcctgcacgcctagaagtattttaggaactttattactgtactaacaagtacttacgtacttaccctcggactagttcggaccaaggggaccaagggtacggagtagtaggaaacggactggtacggtactgaccacgtntcgttacg

SEQ ID NO: 234556 - DNA, 526 bp, Homo sapiens
  misc_feature: GYAE6OF01A1BDZ.42.33.C11.1.454.CMB.1.raw
  modified_base (382)..(382): a, c, t, g, unknown or other
  misc_feature (382)..(382): n is a, c, g, or t
tcagtgacgtatgtcacgaccggtgctcgatttagagtgagctcgttgggtttgggggagtcagacccactcaggacacagcatggacatgagggtccccgctcagctcctggggctcctgctgctctggctcccaggtgccagatgtgccatccagatgacccagtctccatcctccctgtctgcgtctgtcggagacagagtcaccattatttgccgggcaagtcagggcattagaaatgatttaggctggtatcagcagaagccagggaaagcccctaagctcctgatctatggtgcatccaattttacagtattcggggtcccgaccaggttcagccgccagtggctcgtggcgcagatttcactctcaccatcaacngcctgcagcctaggaatattttaggaacttattactgtactaacaagtattacgacttacccgtcgacattccggacctaacgggacctaaagggtgggagtagtaggaaaggaacgtggtacggcttagacaccatcgttacg

SEQ ID NO: 234557 - DNA, 567 bp, Homo sapiens
  misc_feature: GYAE6OF01BV8LN.42.33.C11.1.454.CMB.1.raw
  modified_base (301)..(301): a, c, t, g, unknown or other
  misc_feature (301)..(301): n is a, c, g, or t
  modified_base (439)..(439): a, c, t, g, unknown or other
  misc_feature (439)..(439): n is a, c, g, or t
  modified_base (561)..(561): a, c, t, g, unknown or other
  misc_feature (561)..(561): n is a, c, g, or t
tcagtgacgtatgtcacgaccggtgctcgatttagagtgagctcgttgggtttgggggagtcagacccactcaggacacagcatggacatgagggtccccgctcagctcctggggctcctgctgctctggctcccaggtgccagatgtgccatccagatgacccagtctccatcctccctgtctgcgtctgtcggagacagagtcaccattattgccgggcaagtcagggcattagaatgatttaggctggtatcagcagaagccgaagggaaacgcccctaagctcctgatctagtggtnactatccaattttacgagtacgttcgggtcccgacgtaggttcacgcgcctaggtcggctcgtggcgcagtactttcacttcactaccattaccaacgcgcctagccagtacctagtaagttacttttaggaactttnttactgtactaacaagtacttacgtacttacccaggtaacacgttccggacgaaacgggccgtaaagggtcggaagtagtaagggaaacggtacgtaggtacgggactcgacctactcgttnttacgg

SEQ ID NO: 234558 - DNA, 582 bp, Homo sapiens
  misc_feature: GYAE6OF01CIBIT.42.33.C11.1.454.CMB.1.raw
  modified_base (365)..(365): a, c, t, g, unknown or other
  misc_feature (365)..(365): n is a, c, g, or t
tcagtgacgtatgtcacgaccggtgctcgatttagagtgagctcgttgggtttgggggagtcagacccactcaggacacagcatggacatgagggtccccgctcagctcctgggctcctgctgctctggctcccaggtgccagatgtgccatccagatgacccagtctccatcctccctgtctgcgtctgtcggagacagagtcaccattatttgccgggcaagtcagggcattagaaatgatttaggctggtatcagcagaagccgagggaaacgcccctaagctcctgatctatggtgcatcctaaatttacagtacgttcggggtaccccgacgtaggttcaggccgccaggtcggcttcgnggcgcagtactttccactcctacaacctataccaaacacgcctcgcacgtcctagtaagtattttaggaactttattactagttactaactaagtacttaaccgtactttaccccgtacggtaactacgttaccgggtacgaacgggtaaccaaggggttgaacggtataaggaaagggtaacgtggtacggtacgtcgacctaacgtgttcgttcg

SEQ ID NO: 234559 - DNA, 578 bp, Homo sapiens
  misc_feature: GYAE6OF01EEMOJ.42.33.C11.1.454.CMB.1.raw
  modified_base (200)..(200): a, c, t, g, unknown or other
  misc_feature (200)..(200): n is a, c, g, or t
  modified_base (324)..(324): a, c, t, g, unknown or other
  misc_feature (324)..(324): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
tcagtgacgtatgtcacgaccggtgctcgatttagagtgagctcgttggggtttgggggagtcagacccactcaggacacagcatggacatgagggtccccgctcagctcctggggctcctgctgctctggctcccaggtgccagatgtgccatccagatcgacccagtcctccatccctcctgtctgcgtctgtcgganacagagtcacctatttattcggccgggcaagtcgagggactattaagaaatgatttaggcttaggtatcgagcaaggaagaccgaaggggaaacaccccgtaagcctaccgtgatctagtggtnctatacctaatttacgagtacgttcggggaccacgtaggtcagtcgcagtgctcgngcgnagtntttcactctcactactacaacagcctagaccacgtctagtaagtagttttacggaactttattactgtacttaacgaagtacttaacgtactttacccgtaggtaactacgttaccggaaccgaaacgggtaccgaaagggtcggaagagttaaggaaaggtactggtacgctagaccactagttcgtcg

SEQ ID NO: 234560 - DNA, 702 bp, Homo sapiens
  misc_feature: GYAE6OF01CA6UH.42.33.C11.1.454.CMB.1.raw
tcagtgacgtatgtcacgaccggtgctcgatttagagtgagctcgttgggtttgggggagtcagacccactcaggacacagcatggacatgagggtccccgctcagctcctgggctcctgctgctctggctcccaggtgccagatgtgccatccagatgacccagtctccatcctccctgtctgcgtctgtcggagacagagtcacctatttagtttggccgggacaaggtcgagggcattaagaaatgtatttaggctggtatcagcaagaagccgaagggaaacgcccctaagctcctgatctagtggtgctactcctaaatttacgaggtagttcggggtacccgacgtaggttcacggcgccgtagtcggctacgtgggaccgactaagtactttaccaccttacctccaacctaactaccgaaacacggtacctacggaccacggtccctaaggtaaacgttaacgtttttacggtaaaccttttacgtttaaccgttacgttaactaaacgttaaacgttaaccgtttaaccgttaaccgtttaaccccgttacgggtaacctacggtttacccgggaacccggtaaaaccggggtaccggtaaaggggtaccgggtaaaggtaagttaaacgggtaaaacggtacggttacgggtacgggaccgttacggaccctaacccgtagttccgttaccg

SEQ ID NO: 234561 - DNA, 622 bp, Homo sapiens
  misc_feature: GYAE6OF01C1S3S.42.33.C11.1.454.CMB.1.raw
  modified_base (299)..(299): a, c, t, g, unknown or other
  misc_feature (299)..(299): n is a, c, g, or t
  modified_base (391)..(391): a, c, t, g, unknown or other
  misc_feature (391)..(391): n is a, c, g, or t
tcagtgacgtatgtcacgaccggtgctcgatttagagtgagctcgttgggtttgggggagtcagacccactcaggacacagcatggacatgagggtccccgctcagctcctgggctcctgctgctctggctcccaggtgccagatgtgccatccagatgacccagtctccatcctccctgtctgcgtctgtcggagacagagtcacctattattgccgggcaagtcagggcattagaaatgatttaggctggtaatcagcagaagccgagggaagcccctaagctcctgatctatggtncatccaattacagtattgggtacccactaggttcagcgccaggtgcctcgtggcgctagtactttcacttctacaccaatcgaacagccgtnaccagtccgtagtaaacggtacttttagggtaaactttacgtttactacgttacttaaacaaacggtaacttttaaccgggaccttttaaccccgtcgggaaccttaggtttacccgggaaccctaaagggggaaccctaaaggggttagggaaaggtaacgtaagggtaaaaacgggaacccgttggttacggggaccttacgggaccctaacctaagttccccttaagg

SEQ ID NO: 234562 - DNA, 753 bp, Homo sapiens
  misc_feature: GYAE6OF01BQ8D8.42.33.C11.1.454.CMB.1.raw
  modified_base (101)..(101): a, c, t, g, unknown or other
  misc_feature (101)..(101): n is a, c, g, or t
  modified_base (296)..(296): a, c, t, g, unknown or other
  misc_feature (296)..(296): n is a, c, g, or t
  modified_base (719)..(719): a, c, t, g, unknown or other
  misc_feature (719)..(719): n is a, c, g, or t
tcagtgacgtatgtcacgaccggtgctcgatttagagtgagctcgttgggtttggggagtcagacccactcaggacacagcatggacatgagggtccccgntcagctccgtggggctcctgctgctcgtggctcccaggtgccagatgtgccatccagatcgacccagtcctccatccctccctgtctgcgtctgtcggagacagacgtcaacctatttagttcggaccgggactaaggtcgagggactaagtttaagaaagttggtacgttttaaggcgttggtaactaccgagngaagaacggaccgaacgggaaacgtccccctaaaggccttcccgtaggtacttccgtagtggttacgacttaacttacccttaaagtttacgaacggtacggtttccggggtaccccgtaacggtacggttaccgacggtccgtaccgtagggtccggtcgttcggtacgggccgtacgtacgttactttccgacttccgtaccaaccgtaacctaaccgaaacgtaacgtcccgttacgaccgtacgtacccgttaaggtaaacggtttacttttacggtaaacttttacgtttacgtacgttaactaacgtaacgttacgtaaccgtaaccttacccggagtaccgtacgttaccggaaccgtaacgggaaccgtaagggttacgggaataacgggtaaggaaaacgggttacgtacgggngtaccgttacgacgtaacgttaccgttcgttacg

SEQ ID NO: 234563 - DNA, 697 bp, Homo sapiens
  misc_feature: GYAE6OF01DY3CR.42.33.C11.1.454.CMB.1.raw
  modified_base (286)..(286): a, c, t, g, unknown or other
  misc_feature (286)..(286): n is a, c, g, or t
  modified_base (311)..(311): a, c, t, g, unknown or other
  misc_feature (311)..(311): n is a, c, g, or t
tcagtgacgtatgtcacgaccggtgctcgatttagagtgagctcgttgggtttgggggagtcagacccactcaggacacagcatggacatgagggtccccgctcagctcctggggctcctgctgctctggctcccaggtgccagatgtgccatccagatgacccagtctccatcctcctgtctgcgtctggtcggagacagagtcacctatttattcggccgggcaagtcgagggctaattagaaattgtatttaggctaggtatcagcaagacgcgaagggaacnccctaagcctcgtgatctagtggtncatacctaatttacaggtacgttcgggaccacgtaggttcagccgaccgaggttcggccttcgcgggcgacgtaaggttacttttaccgaccttacctacctaacccgtaactaccaaaaccgtacgtacccgtacgaccgtaccggtacccgttaaggtaaacggtttacgttttttaacgggtaaacctttttacgtttaaccgttacgttaaccgttaaacgtaaacgttaacgtttaaccggtaacctttaacccggtacggtaactacgttaccgggaacccggtaaaaggggacccgtaaaggggttacggaaaggtaaggttaagggaaaacgggtacgttgggtacggtcgtaacggaccaaccgtcgttcgttaccg

SEQ ID NO: 234564 - DNA, 715 bp, Homo sapiens
  misc_feature: GYAE6OF01AIBO4.42.33.C11.1.454.CMB.1.raw
tcagtgacgtatgtcacgaccggtgctcgatttagagtgagctcgttgggtttgggggagtcagacccactcaggacacagcatggacatgagggtccccgctcagctcctggggctcctgctgctctggctcccaggtgccagatgtgccatccagatcgacccagtcctccatccctccctgtctgcgtcgtgtcggagacagagtcacctatttagttcggccgggacaaggtcgagggactagttaagaaatgtaagtttaggctaggtatcgagacgaaggaacggaccgaaggggaaaaccgcccccgtaaagccgtcccgtaggacttacgtagttcgggtcgacctaacttacccgtaaattttaaccgaagggttacgggtttaccgggggtaccccctaacggtacggggtttaccgacggtacccggaccgtacgggttccggtccgttacggtcgggaccgtacgtacggttaacttttcccaaccctttccgtaaccaaccctaactaaccgaaacccgtaccggtaccctacggacctaacggtacccgtaaggttaacgttacgttttaacggtaactttacgtacgtacgttaacttaacgattacgttaccgtaccttacccgtagaccgtacgtaccggacggtacggaacgaggtacgagtagtaggaaacgtgcgtaggcagacactgtcttacg

SEQ ID NO: 234565 - DNA, 747 bp, Homo sapiens
  misc_feature: GYAE6OF01CIOVE.42.33.C11.1.454.CMB.1.raw
  modified_base (287)..(287): a, c, t, g, unknown or other
  misc_feature (287)..(287): n is a, c, g, or t
tcagtgacgtatgtcacgaccggtgctcgatttagagtgagctcgttggggtttgggggagtcagacccactcaggacacagcatggacatgagggtccccgctcagctcctggggctcctgctgctctggctcccaggtgccagatgtgccatccagatcgacccagtcctccactcctccctgtctgcgtctgtcggagacagagtcacctattatttcgccgggcaagtcgagggcattagaaatgtatttaggcttaggtatcagcagaacgccgagggaacnccctaagcctcctgatctagtggtcactagttaccaaatttacgaggtacggttcggggtacccgtacgtacggttcacggccgtccgtaggtcgtctcgtcgggcctcgaagtactttccaaccttcctaccgaacctactaccaaaccgtcggtacccgtgacccgtaaggacccgttaagggtaaacggtttaacgtttttaacgggtaaacctttttaacgtttaaccttagttaaccgttaaacgtaaacggttaccgtttaaaccggtaaccgtttaaccccggtacgggtaacctttacggttaacccggggaacccggttaaaacgggggaacccggttaaaggggggtacggtaaacgggtaaggttaaacgggggtaaaaacgggttaccggttagggtaccgggtaaccttacgggaacccttaacccggtcgttttaccgtttaccgg

SEQ ID NO: 234566 - DNA, 680 bp, Homo sapiens
  misc_feature: GYAE6OF01C09AS.42.33.C11.1.454.CMB.1.raw
  modified_base (103)..(103): a, c, t, g, unknown or other
  misc_feature (103)..(103): n is a, c, g, or t
  modified_base (228)..(228): a, c, t, g, unknown or other
  misc_feature (228)..(228): n is a, c, g, or t
  modified_base (313)..(313): a, c, t, g, unknown or other
  misc_feature (313)..(313): n is a, c, g, or t
  modified_base (397)..(397): a, c, t, g, unknown or other
  misc_feature (397)..(397): n is a, c, g, or t
tcagtgacgtatgtcacgaccggtgctcgatttagagtgagctcgttgggtttgggggagtcagacccactcaggacacagcatggacatggacgggtccccnctcagctccgtgggctcctgctgctctggctcccgaggtgccagatgtcgccatccagatcgacccagtctccatccctcctgtctgcgtctgtcggagacagatcactattagttggccggganaagtcgagggactaagttaagaaacttgtagtttaggctaggtatcgagacaagaacgccgtaagggaacctccctaagccttcngatcgtagtggtcactatcctaaatttcgaggtacggttcgggaccctacgtaggtcaggtccgacgtaggttcggccttcggnggcctacgtaagttacttaccgacttacctaccaacctagtaccaaacgtccgtaccgtacgacgacggtacctaggttaaacgttacgttttacggtaacttttatacgttcgtaactaagtaacgttaactttaccgtaacgttaccccgaggttaactaccggtttaccgggaaacggtaaaccggggaacgtaacggggttaggaaacggtagttaaacgggaaaaggttacgttgggaacggttcctaacggaccctaaccgtacgttcggtttaccg

SEQ ID NO: 234567 - DNA, 576 bp, Homo sapiens
  misc_feature: GYAE6OF01E5SL7.42.33.C11.1.454.CMB.1.raw
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
  modified_base (406)..(406): a, c, t, g, unknown or other
  misc_feature (406)..(406): n is a, c, g, or t
  modified_base (537)..(537): a, c, t, g, unknown or other
  misc_feature (537)..(537): n is a, c, g, or t
  modified_base (563)..(563): a, c, t, g, unknown or other
  misc_feature (563)..(563): n is a, c, g, or t
  modified_base (569)..(569): a, c, t, g, unknown or other
  misc_feature (569)..(569): n is a, c, g, or t
tcagtgacgtatgtcacgaccggtgctcgatttagagtgagctcgttgggtttgggggagtcagacccactcaggacacagcatggacatgagggtccccgctcagctcctggggctcctgctgctctggctcccaggtgccagatgtgccatccagatgacccagtctccatcctcctgtctgcgtctgtcggagacagagtcacctattatttgccgggcaagtcagggcaagttagaaatgatttaggctggtatcagcagaagccaagggaaacncccctaagcctcctgactctagtggtcnctattaccctaatttaccaaggtacgttcggggtccccgaacgtaggttccgaggccgaccgtaggtcggtctcgtggcgtacagtactttccacttcnccaacctactacaacgcgtcctgactacgcctagtaacgtattttacggaactttacgttactgtactaacgtaagtactttaaccgtacttaacccgtgactacgtcgaccgtaaggaccaaggtggaanagaggaaacgtacgtggtcgtcgtanacactntcgtacg

SEQ ID NO: 234568 - DNA, 847 bp, Homo sapiens
  misc_feature: GYAE6OF01BNZWQ.42.33.C11.1.454.CMB.1.raw
tcagtgacgtatgtcacgaccggtgctcgatttagagtgagctcgttggggttggggagtcagacccacgtcaggacacagcgatggactatgagggtccccgctcagctcctgggctcctgcgtgctctgctcccaggtgccagactgtgcctatccagtactggacccaggtcctccactcctccctgtctgcgtctgtcggagctagtgtcacctattagttacgccggaacaagtcgagggtactagttaagaaatgaagttttaaggacgttaggtaactacgaacgaacgtaaggaacgtaccgaaaggggtaaaccgtaccccgtaaaggcccttacccgtaggtaacccgttaccggttacggtcgggtacgtacctaacttaccgtaaaacgtttcgaacggttacgggttcccggggtaccccgtaacggtacggttaccaggcccgtaccgtacggtacgggtcccttacggacggtaacccgcgttaacgttaccgttttacccgaacccttaccgtaaccctaaccgttaacttaacccgtaaacgttaacccgtcgttaacgtacgtacgttacccgtaagttaaacggttaacgtttttaacgggtaaccttttaacgtttacgttaccgtttactaaaccggttaacggttaacgttaacccggtaaccgtttaacccggtacgggttaacctaaccggtttacccggaacccggtaaacggggtaaaccccggtaaagggttacgggaaaccgtaagttaacggggtaaaacgttacgttaacgggtccgtaccgtacgtaaccccggtaacttccggttaccttaccgg

SEQ ID NO: 234569 - DNA, 702 bp, Homo sapiens
  misc_feature: GYAE6OF01BZKCL.42.33.C11.1.454.CMB.1.raw
  modified_base (405)..(405): a, c, t, g, unknown or other
  misc_feature (405)..(405): n is a, c, g, or t
tcagtgacgtatgtcacgaccggtgctcgatttagagtgagctcgttgggtttgggggagtcagacccactcaggacacagcatggacatgagggtccccgctcagctccgtggggctcctgctgctctggctcccaggtgccagatgtgccatccagatcgacccagtctccatccctccctgtctgcgtcgtgtcggagacagacgtcactatttagtttggccgggacaagtcgagggacaagtttaagaaattgtagtttaggctggtatcagacagaacgccgaagggaaacgcccctaagcctaccgtgactcgtagtggtcgactactactaaagtttacgaggtacggttcgggaccccgacgtaggtcacgcgccgaggtcgtctcgtcggcgtanagtactttcgactcctacacctacgtaccaacgacgtccgtacgacctaggtccttaaggtaacgttaacggtttttacggtaaaccttttaatttaccgttagtaaccctttaaacgtaacgtttaaccgtttaacccggttaacccgtttaccccggttaacggtaaccgtaaccgggtttacccggaaacccggtaacggggtaaacccgtaagggggtacggaagtaaaggtaacggaaaacgggtacgttgggtacggtaccgttacggaaccctaccttagtcgttaaccg

SEQ ID NO: 234570 - DNA, 894 bp, Homo sapiens
  misc_feature: GYAE6OF01D3KNK.42.33.C11.1.454.CMB.1.raw
tcagtgacgtatgtcacgaccggtgctcgatttagagtgagctcgttgggtttgggggagtcagacccactcaggacacagcatggacatgagggtccccgctcagctccgtgggctcctgctgctctggctcccaggtgccagatgtgccatccagatcgacccagtcctccactcctcctgtctgcgtctggtcggagacagacgtcaacctatttacgtttcggcccgggactaaggtaccgagggtactaagttaagaaaattcgtagttttaggccgttaggtataccaaggaccaaaggaacggaccgaaaggggaaacctacccccgttaaagtccgttaccgtaggtacttccgttaaggtcggttacgaccttaacttaaccttaaacgttttaacgaacgggttacggtttacccgggggtaccccgtaacggtaacgggtttccgaacgggcccgtacccgtaagggttcgggtcccgttaccggtcggggaccgtacgttaaacggtttacctttttaacccgacccgttaccttaaccccgtaaaccccttaaacgtaacccgtaaaccgtaaccggttacccgtacggtaacccgtaacccggtaccccgtttaaagggtaaaacggttttaaacgttttttaaccgggttaaaacctttttaacgttttaacccgtttagttaacccgttaaaacgttaaccggttaaaccgttttaaaccggttaaacccgtttaccccggttaaccggttaaccttaccggttaaccgggaacccgtaaaacggggtacccgttaaagggttacggaaaggtaaggtaacgggaaaaacggtacgtagggtacggtacgtaacgacccgtaacctcgttcgttaccg

SEQ ID NO: 234571 - DNA, 696 bp, Homo sapiens
  misc_feature: GYAE6OF01CP4VX.42.33.C11.1.454.CMB.1.raw
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
  modified_base (378)..(378): a, c, t, g, unknown or other
  misc_feature (378)..(378): n is a, c, g, or t
  modified_base (391)..(391): a, c, t, g, unknown or other
  misc_feature (391)..(391): n is a, c, g, or t
tcagtgacgtatgtcacgaccggtgctcgatttagagtgagctcgttggggtttgggggagtcagacccactcaggacacagcatggacatggagggtccccgctcagctccgtggggctcctgctgctctggcctcccaggtgccagatgtgccatccagatgacccagtctcactcctcctgtctgacgtctgtcggagacagagtcaacctatttagttcggccgggctaaggtcagggctattaagaaattggactttaggctggtatcagcagagcagggaacnccctaagctacnatctatgggtanctatacctaatttcgagtagttcggggaccacgtaggttcagccgacgaggtggctcggtggacncgagtaactttcncgttccacaccgtactacaacacgtcctagacgtacgtaccgtaggtaacgtttacgtttaggtaacctttttacgttaccttaggttaacctaacgtaaacggttacgtttaaaccggttaccgtttaaaccccggttacgggttaaaccctacgggtttaacccgggaaacccggtaaacggggtaaacccggttaaggggttaacgggaaacggtaaacggtttaaaggggaaaaccggttaaacggttcggtaacgggtcgttaaaccggcccgtaaaccgtaacgtttcggtttaaccgg

SEQ ID NO: 234572 - DNA, 945 bp, Homo sapiens
  misc_feature: GYAE6OF01AGUL3.42.33.C11.1.454.CMB.1.raw
tcagtgacgtatgtcacgaccggtgctcgatttagagtgagctcgttggggtttggggagtcagacccactcaggacacagcatggactatgagggtccccgctcagctcctggggctcctgcgtgctctggctcccaggtcgccagatcgtgccatccagatcgacccagtctccatcctcctgtctgcgtctgtcggagactagtagtcacctatttacttacggaccgggactaaacggtcgaggggtccttaagtttaagaaacgttaggtaacgttttacgggaccgttagggttacttaccgacgtacctaacggaacggacccgtaaggggtaaaaccgtcccccgtaaagggtcccttacccgttacggtaaccgttaccggttaccggtttacgggtacggtaccgttaacgtttaaccccgtaaagtttttaaccggacgggttaacgggttttcccgggggggttaccccgtaacccggttaacggggttttaccgaaccgggttcccggtaaccccggtttacgggttacccgggtacccgtttaaccgggttccggggtacccggtaccgttaacggtttaaccgttttacccgtaacccgttacccgttaacccgtaaacccgttaacgttacccgaaaccgttaccggttaccccgtttaacggtacccgtaacggtaacccggttaaggtaaacggttttaaacgtttttaaccgggtaaaccgttttaacgtttaaccgtttaccggtttaaccgttaaccggttaaacggttaaccggtttaaaccggttaaccgtttaacccggttaacggtaaccgttaacggttaccgggaaaccgtaaccgggtaccgtaagggtacggtacgtaacggtaacggtaacggtacgttaggttcgtacgtaccgtaccactaccgtgttaaccg

SEQ ID NO: 234573 - DNA, 780 bp, Homo sapiens
  misc_feature: GYAE6OF01A9MGY.42.33.C11.1.454.CMB.1.raw
  modified_base (294)..(294): a, c, t, g, unknown or other
  misc_feature (294)..(294): n is a, c, g, or t
  modified_base (321)..(321): a, c, t, g, unknown or other
  misc_feature (321)..(321): n is a, c, g, or t
tcagtgacgtatgtcacgaccggtgctcgatttagagtgagctcgttgggtttgggggagtcagacccactcaggacacagcatggacatgagggtccccgctcagctcctggggctcctgctgctctggctcccaggtgccagatgtgccatccagatgacccagtctccatcctccctgtctgcgtctgtcggagacagagtcacctatttagttcggccgggacaagtcgagggcaagttaagaaatgtaagtttaggcttggtatcagacaagaacgccgaagggaaacnccccgtaagctccgtgatctagtggtnctatacctaatttacgaggtacgttcggggtaccccgtacgtacggtttaccgacggtccggcccgtaagggtccggtccgtacggtcgggacgtacgtaacggtacttttaccgacctttccgtaccaaccctaactacccgaaaccgtacgtacccgtaggacccgtaacggtaccgttaacggttaaaggtttacgtttttaacgggtaaacctttttaacgtttacgttacgtttaaccgttaaacgttaaacggttaacctttaaaccgggtaaccttttaacccccggtaccgggttaaccttaccggttaacccgggaacccgggtaaaacggggttaaccccggtaaaggggtttacgggaaacgggttaaagtaacggggtaaaaaccgggtacgttacgggtaacgggtccgtaacggaacccgtaccgttaacgttccgtttaaccgg

SEQ ID NO: 234574 - DNA, 628 bp, Homo sapiens
  misc_feature: GYAE6OF01AV7LL.42.33.C11.1.454.CMB.1.raw
  modified_base (304)..(304): a, c, t, g, unknown or other
  misc_feature (304)..(304): n is a, c, g, or t
  modified_base (617)..(617): a, c, t, g, unknown or other
  misc_feature (617)..(617): n is a, c, g, or t
tcagtgacgtatgtcacgaccggtgctcgatttagagtgagctcgttgggtttgggggagtcagacccactcaggacacagcatggacatgagggtccccgctcagctcctggggctcctgctgctctggctcccaggtgccagatgtgccatccagatgacccagtctccatcctcctgtctgcgtctgtcggagacagagtcaccattatttgccgggcaagtcagggcattagaaatgtatttaggctggtatcagcagaacgccgaagggaacgccctaagcctcctagatctagtggtncatctaatttacagtagtcgggtccacgtagttcagcgccaggtcggtctcgtcggcgcgtaagtactttcaccttcctacaccctatacccgaaacacggcccttaggacctacgtcccgtaggtaaaaggttcgttttttacgggaaacctttttaagtttaccgttagttaccttaaacgtaaagttactttaaccgtaacgtttaccccgacggtaacctagttaccggaccgaaacggggtaacctaaggggtggtaacggtaagtaggaaaacggtacgtggttacgggaccttcggacctaaccgngtttcttacgg

SEQ ID NO: 234575 - DNA, 857 bp, Homo sapiens
  misc_feature: GYAE6OF01A4MIF.42.33.C11.1.454.CMB.1.raw
  modified_base (286)..(286): a, c, t, g, unknown or other
  misc_feature (286)..(286): n is a, c, g, or t
tcagtgacgtatgtcacgaccggtgctcgatttagagtgagctcgttgggtttgggggagtcagacccactcaggacacagcatggacatgagggtccccgctcagctcctggggctcctgctgctctggctcccaggtgccagatgtgccatccagatcgacccagtctccatccctccctgtctcgcgtcgtggtcggagacagagtaccacctagtttatttcggaccgggtacaaggtcgagggtactaagttaagaaatgtagtttaggctaggtatcgancgaaggaacgccgaagggaacctccccgtaagtccttccgtagtacttacgtagtcggtacgactacttaccttaaagtttacgacggttacggtttacccgggggtaccccgaaccggttaggttaccgacgtccggtaccgtagggtcggtaccgttcggtacgggccgtacgtaacggttaccttttaccaccgtttcccacccgtaaaccctaagtaacccgaaaccgtaccgtacccgtaggtacccgtaccggtacccgtttaagggtaaaacgttttacggtttttaaccgggtaaacctttttacggttaccgttaacgggtttaaccttaaaccgttaaacggtttaacccgttttaaacccggttaaacccgttttaacccccgggtaacgggtttaacccgttaaaccgggtttacccccgggggaaacccggttaaaacgggggtaccccgggttaaaagggggtaacggtaaaccgggtaagtaaacgggttaaaaccgggtcggttagggttacccgacgtaccgtaaccgaaccctttggttacccggtttacccg

SEQ ID NO: 234576 - DNA, 801 bp, Homo sapiens
  misc_feature: GYAE6OF01C45PU.42.33.C11.1.454.CMB.1.raw
  modified_base (759)..(759): a, c, t, g, unknown or other
  misc_feature (759)..(759): n is a, c, g, or t
tcagtgacgtatgtcacgaccggtgctcgatttagagtgagctcgttgggtttgggggagtcagacccactcaggacacagcatggacatgagggtccccgctcagctccgtgggctcctgctgctctggctcccaggtcgccagatgtcgccatccaagactgacccctagtcctccatccctcctgtctgcgtctggtcggagacagacgtaccacctattacgtttcggaccgggacaaggtcgagggtactaagtttacggaaaattgtaatttaacgggcttagggtatcgagacgtaagacgtacgaacgggtaaaccgtcccctaaagtccctacgtcgtaacttccgtagtcgggtacacgttaacttaacccttaaattttaccggaggttaccggtttaccggggtaacccccgtacggttaacgggtttccgacgggtccccgtacggtaacggttccgggtaccgtttacccggcgggggtaccctacgtaaaccggtttaccttttccctaaccgttcccgtttaaccaccccgtttaactaccccgtaaactcccggtccgaacgtaacccgacggttacccgtaaagggtttaactttacggtttttaaccgtaacgtttttaacgttacccgttaacgtttaccctaaacggttaacgttaaaccgtttacgtaaccctttacccgggtcgtaaccgttacggtacccgggaccgaacggggtaccgtagggagtaacggtanaagggtaaacgcgttggcgtactacgactacctagttctccg

SEQ ID NO: 234577 - DNA, 883 bp, Homo sapiens
  misc_feature: GYAE6OF01AQH4M.42.33.C11.1.454.CMB.1.raw
  modified_base (145)..(145): a, c, t, g, unknown or other
  misc_feature (145)..(145): n is a, c, g, or t
  modified_base (835)..(835): a, c, t, g, unknown or other
  misc_feature (835)..(835): n is a, c, g, or t
tcagtgacgtatgtcacgaccggtgctcgatttagagtgagctcggttggggtttgggggagtcagacccactcaggacacagcatggacatgagggtccccgctcagctccgtggggctcctgctgctctggcctcccaggtcnccagatgtgccatccagatcgacccagtcctccatccctcctgtctgtcgtcgtggtcggagacagtacgtccaacctagtttacgtttcggacccggggactaaacggttcgaacggggtacctaaacgttttaaaggaaaacgttggttaaacgttttaacggggaccgtttacggggttaattacccggaaggaccgtaaaagggaaaccggacccggaaaacgggggtaaaacccctccccccgtaaaacggtcccttacccgtaggtaactttaccgttaagggtcgggttactacccgtaaacttaccccgttaaaagttttacccgaacgggtttacgggtttacccggggtaaccccgtaacggttacgggttaccgaacgggtcccggtaccgtagggttcggtccgttaccgggtcgggtaccgtaaccgtacgtttaaaccgtttcccaaccgttcccgtaaccctaaccctaagtaaccccgaaacgttaccggtcccgttacgacccgtacgggtacccttaaaggttaaacggtttaacgttttttaaccgggtaacttacgtttaccgtaacgtacttaaacgaacgtttacgttaaacccgttaccgtttaacccggtacgtaacgttaccgtaaccgggaaccgtaacgggaaccgtaagggtagaacggtanaaacgggaagtacgttggacgttcgacgaccctagttctccgttaccg

SEQ ID NO: 234578 - DNA, 520 bp, Homo sapiens
  misc_feature: GYAE6OF02H9VQR.42.33.C11.1.454.CMB.1.raw
  modified_base (350)..(350): a, c, t, g, unknown or other
  misc_feature (350)..(350): n is a, c, g, or t
  modified_base (437)..(437): a, c, t, g, unknown or other
  misc_feature (437)..(437): n is a, c, g, or t
tcagtgacgtatgtcacgaccggtgctcgatttagagtgagctcgttgggtttgggggagtcagacccactcaggacacagcatggacatgagggtccccgctcagctcctggggctcctgctgctctggctcccaggtgccagatgtgccatccagatgacccagtctccatcctccctgtctgcgtctgtcggagacagagtcaccattatttgccgggcaagtcagggcattagaaatgatttaggctggtatcagcagaagccagggaaagcccctaagctcctgatctatggtgcatccaatttacagattggggtcccacaggttcagcgccagtgctctggcncagatttcactctcaccatcaacagcctgcagcctagaagtattttaggaactttattactgtctaacaagtattacgacttacccncggtaactacgttaccggacctaaaggggacctaagggtaggaagagtaggaaaaggacttggtcggctgccaaccattctcg

SEQ ID NO: 234579 - DNA, 496 bp, Homo sapiens
  misc_feature: GYAE6OF02HBNZT.42.33.C11.1.454.CMB.1.raw
  modified_base (373)..(373): a, c, t, g, unknown or other
  misc_feature (373)..(373): n is a, c, g, or t
tcagtgacgtatgtcacgaccggtgctcgatttagagtgagctcgttgggtttgggggagtcagacccactcaggacacagcatggacatgagggtccccgctcagctcctggggctcctgctgctctggctcccaggtgccagatgtgccatccagatgacccagtctccatcctccctgtctgcgtctgtcggagacagagtcaccattatttgccgggcaagtcagggcattagaaatgatttaggctggtatcagcagaagccagggaaagcccctaagctcctgatctatggtgcatccaatttacagattgggtccaccaggttcagcgcagtggctctggcgcagatttcactctcaccatcaacngcctgcagcctgaagtattttggaaccttattactgtctacaagtattacgattaccctcggaactattccggacctaagggaccaaggtcggaagataggaaggactgtgctgcacatctcg

SEQ ID NO: 234580 - DNA, 719 bp, Homo sapiens
  misc_feature: GYAE6OF02F81V0.42.33.C11.1.454.CMB.1.raw
tcagtgacgtatgtcacgaccggtgctcgatttagagtgagctcgttgggtttgggggagtcagacccactcaggacacagcatggacatgagggtccccgctcagctcctggggctcctgctgctctggctcccaggtgccagatgtgccatccagatgacccagtctccatcctccctgtctgcgtctgtcggagacagagtcaccattatttgccgggcaagtcagggcattagaaatgatttaggcgtagtatcgagacgaaggaacgaccggaaagggaaacccgtaccccgtaacgtcccttaccgtagtacttactaggtggtcgactactaaccttaaactttaacgaagttacgggttccggggtaccctaacggtacggttacgacggccgaccgtacggtcggtccgtcggtcgggccgacgtagtttacctttaccgtaccttcctacccaacctaactaacccaaacgtaccgtccgtacgaccgaccgtaccgtaaggtaacgtttagttttaacggtaaacttttaacgtttacgttacgttaacttaaacgtaagtttaacgtttaaccgttaaccgtttacccgtaacgtaacttaccggttaccggaaccggaacgggtaaccgtaagggtaggaagtaacggtaaagggtaaacggtacgttagggtacgtacgtaccgacctaacgtacgttcgttacg

SEQ ID NO: 234581 - DNA, 499 bp, Homo sapiens
  misc_feature: GYAE6OF02GIJYH.42.33.C11.1.454.CMB.1.raw
tcagtgacgtatgtcacgaccggtgctcgatttagagtgagctcgttgggtttgggggagtcagacccactcaggacacagcatggacatgagggtccccgctcagctcctggggctcctgctgctctggctcccaggtgccagatgtgccatccagatgacccagtctccatcctccctgtctgcgtctgtcggagacagagtcaccattatttgccgggcaagtcagggcattagaaatgatttaggctggtatcagcagaagccagggaaagcccctaagctcctgatctatggtgcatccaatttacagattggggtcccacaggttcagcgccagtggctctggcgcagatttcactctcaccatcaacagcctgcagcctgaagtattttggaactttattactgtctaacaagtattaacgattaccctcggactattcggaccaagggaccaaggtggaagataggaaagactgtggctgacaccatctcg

SEQ ID NO: 234582 - DNA, 519 bp, Homo sapiens
  misc_feature: GYAE6OF02GKJEG.42.33.C11.1.454.CMB.1.raw
tcagtgacgtatgtcacgaccggtgctcgatttagagtgagctcgttgggtttgggggagtcagacccactcaggacacagcatggacatgagggtccccgctcagctcctggggctcctgctgctctggctcccaggtgccagatgtgccatccagatgacccagtctccatcctccctgtctgcgtctgtcggagacagagtcaccattatttgccgggcaagtcagggcattagaaatgatttaggctggtatcagcagaagccagggaaagcccctaagctcctgatctatggtgcatccaatttacagtattggggtcccactaggttcagcgccagtggctctggcgcagatttcactctcaccatcaacagcctgcagcctagaagtattttggaactttattactgtactaacgaagtacttacgactttacccgtggaactagttccggaccaagggacccaagggtggaagaagtaggaaaggactggtacggctagccacctatctcg

SEQ ID NO: 234583 - DNA, 514 bp, Homo sapiens
  misc_feature: GYAE6OF02HGZPU.42.33.C11.1.454.CMB.1.raw
  modified_base (385)..(385): a, c, t, g, unknown or other
  misc_feature (385)..(385): n is a, c, g, or t
tcagtgacgtatgtcacgaccggtgctcgatttagagtgagctcgttgggtttgggggagtcagacccactcaggacacagcatggacatgagggtccccgctcagctcctggggctcctgctgctctggctcccaggtgccagatgtgccatccagatgacccagtctccatcctccctgtctgcgtctgtcggagacagagtcaccattatttgccgggcaagtcagggcattagaaatgatttaggctggtatcagcagaagccagggaaacgcccctaagctcctgatctatggtgcatcctaaatttacagtattcggggtcccgaccaggttcaggcgccaggtggctctggcgcagtatttcactctcaccatcaacngcctgcagcctagaagtattttaggaactttattactgtactactaaagtattacgtacttacccgtgactacgttcgaccgaagggaccaagggtggaagataggaaagactggtgctgcacatctcg

SEQ ID NO: 234584 - DNA, 544 bp, Homo sapiens
  misc_feature: GYAE6OF02I2L6Y.42.33.C11.1.454.CMB.1.raw
  modified_base (297)..(297): a, c, t, g, unknown or other
  misc_feature (297)..(297): n is a, c, g, or t
tcagtgacgtatgtcacgaccggtgctcgatttagagtgagctcgttgggtttggggagtcagacccactcaggacacagcatggacatgagggtccccgctcagctcctgggctcctgctgctctggctcccaggtgccagatgtgccatccagatgacccagtctccatcctccctgtctgcgtctgtccggagacagagtcaccattatttgccgggcaagtcagggcattagaaatgatttaggctggtatcagcagaagccagggaaagccccaagctcctgatctatggtncatccaatttacagtattggggtcccacacgttcacgcgccagtggctcgtggcgcagacttttcgactctcgaccatcaacagcctgcagcctgtaaagtattttacggaactttatactgttactaactaagtattaaccgactttaaccctcggtactacgttcggaccgtaagggaccgaaggtggaacgaagttaggaaaacggtacgttggtacggacgtacgaccgaccctatccttacg

SEQ ID NO: 234585 - DNA, 515 bp, Homo sapiens
  misc_feature: GYAE6OF02HVQ90.42.33.C11.1.454.CMB.1.raw
  modified_base (344)..(344): a, c, t, g, unknown or other
  misc_feature (344)..(344): n is a, c, g, or t
  modified_base (369)..(369): a, c, t, g, unknown or other
  misc_feature (369)..(369): n is a, c, g, or t
  modified_base (389)..(389): a, c, t, g, unknown or other
  misc_feature (389)..(389): n is a, c, g, or t
  modified_base (393)..(393): a, c, t, g, unknown or other
  misc_feature (393)..(393): n is a, c, g, or t
tcagtgacgtatgtcacgaccggtgctcgatttagagtgagctcgttgggtttggggagtcagacccactcaggacacagcatggacatgagggtccccgctcagctcctggggctcctgctgctctggctcccaggtgccagatgtgccatccagatgacccagtctccatcctccctgtctgcgtctgtcggagacagagcaccattatttgccgggcaagtcagggcattagaaatgatttaggctggtatcagcagaagccagggaaaagccctaaagctcctgatctatggcacatccaattttacgagattggggcccaacagggttcagcgcctagnggctcgtgcgacagattttcattcncaccaatcaaacaggttccngcanctagaagttatttacgaatttatactagtactaacaagtataacgtacttacccgtagactacgtacgaccgaaggaaccgtaggtagagacgtagaaacgatgtagcgtagacactatctg

SEQ ID NO: 234586 - DNA, 532 bp, Homo sapiens
  misc_feature: GYAE6OF02G7IDU.42.33.C11.1.454.CMB.1.raw
tcagtgacgtatgtcacgaccggtgctcgatttagagtgagctcgttgggtttgggggagtcagacccactcaggacacagcatggacatgagggtccccgctcagctcctggggctcctgctgctctggctcccaggtgccagatgtgccatccagatgacccagtctccatcctccctgtctgcgtctgtcggagacagagtcaccattatttgccgggcaagtcagggcattagaaatgatttaggctggtatcagcagaagccagggaaacgcccctaagctcctgatctatggtgcatccaatttacagattcggggcccaccaggttcagcgcagtggctctggcgcagtatttcactctcaccatcaacagcctgcacgcctagaacgtattttaggaactttagttactgtactaacaagtattaacgattacccgtcggactattccggaccaaagggaccaagggtgggaagagttaaggaaacggtaacttggtacggtcgtggaccaccgtatccgttcg

SEQ ID NO: 234587 - DNA, 561 bp, Homo sapiens
  misc_feature: GYAE6OF02F1WL3.42.33.C11.1.454.CMB.1.raw
  modified_base (276)..(276): a, c, t, g, unknown or other
  misc_feature (276)..(276): n is a, c, g, or t
tcagtgacgtatgtcacgaccggtgctcgatttagagtgagctcgttgggtttgggggagtcagacccactcaggacacagcatggacatgagggtccccgctcagctcctggggctcctgctgctctggctcccaggtgccagatgtgccatccagatgacccagtctccatcctccctgtctgcgtctgtcggagacagagtcaccattatttgccgggcaagtcagggcattagaaatgatttaggctggtatcagcagaagccagggaaacnccctaagctcctgatctatggtgcatacctaattttacgagtagtttcgggggtaccccgacctaggttcagccgccaggtcggctcgtggccgcagtatttccacttctcaccatcaacagccctgccagcctagaagtattttggaacttattactgtactacaagtattaacgtattacccgtcgaactacgttaccggaccaagggtacccgaagggtggaagaacgttaaggaaaacggtacgtagggtacggtcgtacggaccaacctacgttctacgg

SEQ ID NO: 234588 - DNA, 539 bp, Homo sapiens
  misc_feature: GYAE6OF02HPEHV.42.33.C11.1.454.CMB.1.raw
  modified_base (530)..(530): a, c, t, g, unknown or other
  misc_feature (530)..(530): n is a, c, g, or t
tcagtgacgtatgtcacgaccggtgctcgatttagagtgagctcgttgggtttgggggagtcagacccactcaggacacagcatggacatgagggtccccgctcagctcctggggctcctgctgctctggctcccaggtgccagatgtgccatccagatgacccagtctccatcctccctgtctgcgtctgtcggagacagagtcaccattatttgccgggcaagtcagggcattagaaatgatttaggctggtatcagcagaagccagggaaagcccctaagctcctgatctatggtgcatccaatttacagattggggtcccacaggttcagcgccagtggctctggcgcagtatttcactctacaccatcaacagcctgcagcctagaagtattttaggaacttattactgtactacaagtattaacgattacccgtacgtactagttccggaccaaggggtaccaaagggttagggaagtaagttagggaaaacggtaacgttggtaggtccgtaggaccaacctnttcgttacg

SEQ ID NO: 234589 - DNA, 592 bp, Homo sapiens
  misc_feature: GYAE6OF02HXDXS.42.33.C11.1.454.CMB.1.raw
  modified_base (302)..(302): a, c, t, g, unknown or other
  misc_feature (302)..(302): n is a, c, g, or t
tcagtgacgtatgtcacgaccggtgctcgatttagagtgagctcgttgggtttgggggagtcagacccactcaggacacagcatggacatgagggtccccgctcagctcctgggctcctgctgctctggctcccaggtgccagatgtgccatccagatgacccagtctccatcctcctgtctgcgtctgtcggagacagagtcacctattatttcgccgggacaagtcagggcattagaatgatttaggctggtatcagacagaagccaagggaaacgccctaagctacctgatctatggtnctactcctaattttacgagtacgttacggggtacccgtaacgtacggttcaggcgccaggtcggactcgtggcgctagtactttcactcctacactatacaacacgctcgacacgacctagtaaacgttattttacggaaactttacttacttacggtacttaacgtaaagtactttaacgtaactttacccgtacggtaacctacgttacggaaccgtaagggtacccgtaagggtacggaagtaagtaaggaaacggtacgtggtcggactcgactacgtatcttacg

SEQ ID NO: 234590 - DNA, 672 bp, Homo sapiens
  misc_feature: GYAE6OF02I46SG.42.33.C11.1.454.CMB.1.raw
  modified_base (454)..(454): a, c, t, g, unknown or other
  misc_feature (454)..(454): n is a, c, g, or t
  modified_base (460)..(460): a, c, t, g, unknown or other
  misc_feature (460)..(460): n is a, c, g, or t
tcagtgacgtatgtcacgaccggtgctcgatttagagtgagctcgttggggtttgggggagtcagacccactcaggacacagcatggacatgacgggtccccgctcagctccgtggggctcctgctgctctggctccgaggtgccagatgtgccatccagatcgacccagtcctacactcctcctgtcgtgcgttctgtcggagacagagtcaacctattagttcggaccggacaagtcggaggactaattagaaatgtagtttaggctaggtatcagacgaagtaacgacgaagggaaaccgcccgtaacgctccgtagtacttcgtagtggtagactactacctaattacgaggttacggttccgggtacccgtacgaggttcggatccgaccgtaggtcggctcggtggaccgactaagttactttacgacctctacaactactaacctancgttcncgacacgtacgtaagtatttaacgttttaaggtaactttaacgtacttacgttactaacgtaacgttacgttaacgttaaccgtttacccggtaacgtaacgttacgttaaccgggaaccgggtaacggtaccggtaagggtaaggaacggttaaggtaacggaaacgggttacgtaggtcggtacggactaccgtacgtagttacgttacg

SEQ ID NO: 234591 - DNA, 530 bp, Homo sapiens
  misc_feature: GYAE6OF02FGRXE.42.33.C11.1.454.CMB.1.raw
  modified_base (273)..(273): a, c, t, g, unknown or other
  misc_feature (273)..(273): n is a, c, g, or t
tcagtgacgtatgtcacgaccggtgctcgatttagagtgagctcgttgggtttgggggagtcagacccactcaggacacagcatggacatgagggtccccgctcagctcctggggctcctgctgctctggctcccaggtgccagatgtgccatccagatgacccagtctccatcctccctgtctgcgtctgtcggagacagagtcaccatttattgccgggcaagtcagggcattagaaatgatttaggctggtatcagcagaagcagggaancccctaagctcctgatctatggtgcatcaatttcagtattcggggtccacaggttcagcgcagtggctcgtggcgcagtactttcactcctcaccatccaacacgcctgcagcctgaatagttttagaacttatttactgttactaacaagtattaacgtattacccgttagactaacgttccggaccgtaagggtaccaagggtggaagaactagggaaacgtacgtggtacggctaccggcaaccgtatccttcg

SEQ ID NO: 234592 - DNA, 586 bp, Homo sapiens
  misc_feature: GYAE6OF02FR6UI.42.33.C11.1.454.CMB.1.raw
tcagtgacgtatgtcacgaccggtgctcgatttagagtgagctcgttgggtttgggggagtcagacccactcaggacacagcatggacatgagggtccccgctcagctcctggggctcctgctgctctggctcccaggtgccagatgtgccatccagatgacccagtctccatcctccctgtctgcgtctgtcggagacagagtcaccattatttgccgggcaagtcagggcattagaatgattaggctggtatcagcagaagcaggaaacgccctaagctcctgatctagtggtgcatcctaaatttacagtagttcggggtcccacgtaggtcagcgccaggtcggctcgtcggcgcgtagtactttcactccgtcacctactacaacacgcctgaccgagccctagtaaacgtagttttacggaactttacttacttcgtactaacaagtacttacgtaacttacccgttacggaactacttaccggaccgtaacgggacccgtaagggtacggaaggtaacgtaaggtaaaacggtacggttaggtacgggtacgtcgtacccgacgttaactcgttaccgg

SEQ ID NO: 234593 - DNA, 866 bp, Homo sapiens
  misc_feature: GYAE6OF02H70TE.42.33.C11.1.454.CMB.1.raw
tcagtgacgtatgtcacgaccggtgctcgatttagagtgagctcgttgggtttgggggagtcagacccactcaggacacagcatggacatgagggtccccgctcagctcctggggctcctgctgctctggctcccaggtgccagatgtgccatccagatgacccagtctccactcctccctgtctgcgtctgtcggagacagagtacacctatttagtttcggccgggacaacggtcgaggggtcctaagttaagaaagtgttagttttacggcttagggtactaccgagaccgaagtaaggccgaaacggggtaaacctaccccgtaacgccttaccgttacgtacttaccgtaggttcggtacgacctaacttacccgtaaacgtttttaccgaaggttacgggttccggggttaccccgtaaccggtaccggttccgaacggtcccgtaccgtaggttacgggtcctcggttacggccgtacgtaggttaccttttacccgtaccgttaccctacccgtaaccctaacgttaacccgaaactaccggtacccgttacgaccgtaaccggttaacccgttaagggttaacggtttttaaacgttttaccgggttaaaaccgtttttaacgtttaaccggttaccgtttaaccttaaacggtaaaccgttaacgttttaaacccgtaacccggtttaccccgtttaaccgggtaccttaaaccggtttacccggaacccgggaacccgggttaaccggtacggggttaaccgggtaaggtaaaccggttaacggggtaaaaacgttaccggtacggtttacggtaccggttaaccgtacccgtaaccgtaccgttacgtttaccg

SEQ ID NO: 234594 - DNA, 713 bp, Homo sapiens
  misc_feature: GYAE6OF02JISI4.42.33.C11.1.454.CMB.1.raw
  modified_base (198)..(198): a, c, t, g, unknown or other
  misc_feature (198)..(198): n is a, c, g, or t
  modified_base (283)..(283): a, c, t, g, unknown or other
  misc_feature (283)..(283): n is a, c, g, or t
tcagtgacgtatgtcacgaccggtgctcgatttagagtgagctcgttgggtttgggggagtcagacccactcaggacacagcatggacatgagggtccccgctcagctccgtggggctcctgctgctctggctcccaggtgccagatgtgccatccagatgacccagtctccatcctccctgtctgcgtctgtcgganacagagtcactatttagttcgccgggcaagtcagggcaattaagaatgtatttaggctggtatacagacagacgcgaagggaacnccctaagcctccgtagacttcgtagtggtcactagtacctaagtttaccaggtacggttccggggtaccccgaacgtagggttcaacggccggtccaggtcggtcttcggtcggacctcgtaaggttacttttacccgacttacctacccaaccgtacgttaaccaaccgtacgtccgtacgaccgtacgtaccgtaaggtaacgtttacgttttaacggtaactttactttaccgttagttaaccgtaacgttaacgttaacgtttaaccgttaaccgtttaccccgttaccggtaaccttaaaccggttcccgggtaaccgtaaacggggtaccgtaacggggtacgggtaaacgtaaggtacgggtaaaaacgggtcgttaacgggttacggaccgtacggaccctaacgttcgttaccgttaacgg

SEQ ID NO: 234595 - DNA, 744 bp, Homo sapiens
  misc_feature: GYAE6OF02HQBVR.42.33.C11.1.454.CMB.1.raw
  modified_base (431)..(431): a, c, t, g, unknown or other
  misc_feature (431)..(431): n is a, c, g, or t
  modified_base (465)..(465): a, c, t, g, unknown or other
  misc_feature (465)..(465): n is a, c, g, or t
  modified_base (496)..(496): a, c, t, g, unknown or other
  misc_feature (496)..(496): n is a, c, g, or t
tcagtgacgtatgtcacgaccggtgctcgatttagagtgagctcgttgggtttgggggagtcagacccactcaggacacagcatggacatgagggtccccgctcagctcctggggctcctgctgctctggctcccaggtcgccagatgtcgccatccagatcgacccagtcctccactcctccctgtcgtcgacgttctggtcggacgacgagagtaccacctagtttacgtttcggccggggactaacggtcgacgggtactattaaaggtaagttacgttaagtttacggtcgtaggtatcgagtacaaggaaccgaccgggaaggaaacgtacccctagtacccgtcttacggtacttcctaggtcggtacgtactaacttaccgtaaatttacgacggtacggttcggggtacccacgttcggtacncggcctcggaaggtcgcgtactgccgactacgtntttacgacgttccactacaatcccgtaaacnccgtctacggctacgtaccggtagtaacgtttacgttaaggttaaacctttagttaccgacgttaattaacccgtaaagttaaccgtacgttacccgttaaccgttacggtacgttaaaccggtacgtaaccgggtaagggtaaccggtaacggtgggtaaaccggaaggttaaacggggtaaacccgtaggtttacgggcggtaaccttacccgggtaaccgtacctttagggttaccctttaccgg

SEQ ID NO: 234596 - DNA, 514 bp, Homo sapiens
  misc_feature: GYAE6OF01ENQ8K.10.26.C04.1.454.CMB.1.raw
tcagcatagtagtgcacgaccggtgctcgatttagtctagcgactttgggtttggggtgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtctattactgtcagcagtatggtcacgtccaagtaactttggccagggaccaagctggagatacaaacgactgtggctgcaccgatctgtcttcactcttcccgcatctgactac

SEQ ID NO: 234597 - DNA, 603 bp, Homo sapiens
  misc_feature: GYAE6OF01ET973.10.26.C04.1.454.CMB.1.raw
  modified_base (343)..(343): a, c, t, g, unknown or other
  misc_feature (343)..(343): n is a, c, g, or t
tcagcatagtagtgcacgaccggtgctcgatttagtctagcgactttgggtttggggtgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttcttggtggagcctacaggccactggcacccagacaggatcagtggcagcgggtntgggacagacttcattctcaccatcaacagactgcagcctagaagatattgctagtttactactgtacagcagtattgttaaccgtccccgttgggaccttcggaccgaacgggtaccaaagggtcggacaacgtaccgaaaccgtaacgttggtcgggaccttacgaccacccgtagttacctggttccctttactaaccgttccctttcccccggacccttacgttccctacggtaccctaacttaaccgttagtccg

SEQ ID NO: 234598 - DNA, 571 bp, Homo sapiens
  misc_feature: GYAE6OF01CTMHA.10.26.C04.1.454.CMB.1.raw
  modified_base (348)..(348): a, c, t, g, unknown or other
  misc_feature (348)..(348): n is a, c, g, or t
  modified_base (366)..(366): a, c, t, g, unknown or other
  misc_feature (366)..(366): n is a, c, g, or t
  modified_base (567)..(567): a, c, t, g, unknown or other
  misc_feature (567)..(567): n is a, c, g, or t
tcagcatagtagtgcacgaccggtgctcgatttagtctagcgactttgggtttggggtgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggacaaaaacctggccaggctccccgactcctcttcttgttggagcctacagggccactggccaccccagacaggatcgagtggcagcgggtntgggacagacttcattcncaccatcaaacagactgcagcctagaaagattattgactagtttactactgtcagctaagtatcgttaccgtcccgtaggacgttcggaccgaagggaccaagggtcgactaagtaccgaacgacgtgtcggctcggactaccgattctacgttccttacacgttcccttccccgacctatcctacgacctaactacgttntcgg

SEQ ID NO: 234599 - DNA, 558 bp, Homo sapiens
  misc_feature: GYAE6OF01EHSLU.10.26.C04.1.454.CMB.1.raw
  modified_base (545)..(545): a, c, t, g, unknown or other
  misc_feature (545)..(545): n is a, c, g, or t
tcagcatagtagtgcacgaccggtgctcgatttagtctagcgactttgggtttggggtgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggacaaaaacctggccaggctccccgactcctcttctttggtgagcctacagggccactggcacccagacaggatcagtggcagcgggtctgggacagacttcattctcaccatcaacagactgcagcctagaagatatgactagtttacactgtcagcagtatcgttaccgtccccgtggtacgttcggaccgaaggggaccaagggtcggaccaacgtaccgaaaccgtaacgttggtaggcctgccacctatcgttgtcttacacttccgttccccgctactcctanacctactatgtcg

SEQ ID NO: 234600 - DNA, 519 bp, Homo sapiens
  misc_feature: GYAE6OF01D06BK.10.26.C04.1.454.CMB.1.raw
tcagcatagtagtgcacgaccggtgctcgatttagtctagcgactttgggtttggggtgctcagttaggacccagagggaaccatggaaagcccagcgcagcttctcttcctcctgctactctggctcccagagatgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggccaccccagacaggatcagtggcagcgggtctgggacagacttcattctcaccatcaacagactgcagcctgaagatattgactagtttactactgtcagcagtatgttacgtcccgtggacgttcggcaagggacaaggtgcaatcaaccgactgtgctgcacatctgtcttcatccttccgccctatctagactactctag

SEQ ID NO: 234601 - DNA, 173 bp, Homo sapiens
  misc_feature: GYAE6OF01EB9O6.10.26.C04.1.454.CMB.1.raw
  modified_base (173)..(173): a, c, t, g, unknown or other
  misc_feature (173)..(173): n is a, c, g, or t
tcagcatagtagtgcacgaccggtgctcgatttagtctagcgactttgggtttgggggaagaggaagactgactgtcccccaggagttcaggtgctgggcacagcggccctgggctgcctggtcaaggactacttcccactactatgctgagcgggctggcaaggcgcatagn

SEQ ID NO: 234602 - DNA, 718 bp, Homo sapiens
  misc_feature: GYAE6OF01EE02X.10.26.C04.1.454.CMB.1.raw
tcagcatagtagtgcacgaccggtgctcgatttagtctagcgactttgggtttggggtgctcagttaggacccagagggaaccatggaaagcccagcgcagcttctcttcatcctgctactctggctcccagacgacgaccggagagattgtattgacgcagtctccaaccaccctgttctttcgtcctccgtgggggagacgccaccctctcctgcgacgggccagtacgtaaccttttagtagttagttatttacgccttggtagtacggacaaaaaccgtggaccacggtcctccccgactcctcttcgtttggtggtacgcctacgacggccacgtcggaccaccccaggaccaggtactacgacggtcggacgacgggtcgggtcggtacgggtacacgtaccttactacgtttccgtaccacccgtaataccgaaacgtacgtaactacgacgtaacgtaccgtagtaacgtaattaacgttcgtacttaacggtttacttaacgtagtacaggtacgtaagtttactccggtttaacccggtcccggtacggtacccggttaccggtaaccggaaacgggtaaccgtaacgggtcggtaactaacgtacccgtaaacgttacgtacggtacggtcgacgaccgtaactagtccgtgttaccctacgtactcccgttacccgacttcgtactaccgtaactacgtacgtacg

SEQ ID NO: 234603 - DNA, 699 bp, Homo sapiens
  misc_feature: GYAE6OF01BS6IH.10.26.C04.1.454.CMB.1.raw
  modified_base (650)..(650): a, c, t, g, unknown or other
  misc_feature (650)..(650): n is a, c, g, or t
tcagcatagtagtgcacgaccggtgctcgatttagtctagcgacttttggggtttggggtgctcagttaggacccagagggaaccatggaaagcccagcgcagcttctcttcctcctgctactctggctccagagacgaccggagagattgtattgacgcagtctaccaacccacctgttctttgtctccggtggggggagacgccaccctctcctgcgaggccagtcgtaactttagtagtagttattagcctgtatacggacaaacgtggacacgcctaccccgactccttcttcgttggtcgacgtcctacggacggccacgtcggaccacccgagacgagacgtacgaggtcggacgacgggtcgggtacgtacgggaactacggtacttcgtacttccaccacctaataccgaacacgtactacgacgtaacgtactaagtaacgtaattagttcgtaaccgtttaaggttttacctaagttcggtaacaacggtacgttaaggtaccgtttaccggtttaacccgggttcccgggtacgggttacccggtaccggaaaccggtaacggggtacctaagggtcgaactaaccggtaccgtaaacggtgtcggcgtactccgactacgttctacgtcttacttacnccgttaccctccgacttaaccgtactcaaaccgttcttaacgtgtacgg

SEQ ID NO: 234604 - DNA, 621 bp, Homo sapiens
  misc_feature: GYAE6OF01CIVPR.10.26.C04.1.454.CMB.1.raw
  modified_base (302)..(302): a, c, t, g, unknown or other
  misc_feature (302)..(302): n is a, c, g, or t
  modified_base (375)..(375): a, c, t, g, unknown or other
  misc_feature (375)..(375): n is a, c, g, or t
tcagcatagtagtgcacgaccggtgctcgatttagtctagcgactttgggtttggggtgctcagttaggacccagagggaaccatggaaagcccagcgcagcttctcttcctcctgctactctggctcccagagacgaccggagagattgtattgacgcagtctccaaccaccctgtctttgtctccgtggggggagagccaccctctcctgcagggccagtgtaaccttttagtagtagttatttagcctggtatcggacaaaaacctggccaggcctccccgactccttcttcgtttggnggagcctacgcgggccactggccaccccagacaggatcgagtggacaggcgggtctgggacagacttcattcncacatcaacagctaagaacctgaaagtatttgactatttatttctgtccaactagaagttcgacaacgtcgacctccgacgttcggacgtacggggacctaaggtgggacgtatacgaggaacgaaccgttggtacgggacctcggacctaactacgttaccgttggttaccctttccgacgttcccttcccccggacctaactttccggtaacgtaacctaacctttaactagtccgtaacgggg

SEQ ID NO: 234605 - DNA, 174 bp, Homo sapiens
  misc_feature: GYAE6OF01B1W2G.10.26.C04.1.454.CMB.1.raw
  modified_base (173)..(174): a, c, t, g, unknown or other
  misc_feature (173)..(174): n is a, c, g, or t
tcagcatagtagtgcacgaccggtgctcgatttagtctagcgactttgggtttgggggaagaggaagactgacggtcccccaggagttcaggtgctgggcacagcggccctgggctgcctggtcaaggactacttcccactactatgctgagcgggctggcaaggcgcatagnn

SEQ ID NO: 234606 - DNA, 724 bp, Homo sapiens
  misc_feature: GYAE6OF01DNUTU.10.26.C04.1.454.CMB.1.raw
tcagcatagtagtgcacgaccggtgctcgatttagtctagcgactttgggtttggggtgctcagttaggacccagagggaaccatggaaagcccagcgcagcttctctttcccccccccctgctactctggctcccagagaagaccggagagattgtattgacgcagtctccaaccaccctgtctttgtctccgtgggggagagccaccctctcctgcagggccagtgtaaccttttagtagttagttatttagcctggtatcggacaaaactggccaggcctcccgactcctcttcgttggtgagcctacgaggccacgtggaccacccagacaggatacgagtggcaggcgggtcgtgggacaggtaccttcgtactttcctaccaacctactaccgaaacgacggtaccgtacgaccgtaacggtacccgtaaggaaacgtaactttagtttacggtacgtttaacggttttaaccttacgttcgtaccagtacgtaaggttaccgtttaccgggtttaacccgttcccccgggttagggtacccggtttacccgggaaccggtaacggggtaacccgtaggggtaccgacgtaaacgttaccgaaacccggtagtcggtacgtcgtacgaccctacgtacttcgtcgttaccttaccgtacttccccggttacccgtactaccgttacgtaacggtaccttaaccttacgttcgtaccgg

SEQ ID NO: 234607 - DNA, 869 bp, Homo sapiens
  misc_feature: GYAE6OF01BBVMG.10.26.C04.1.454.CMB.1.raw
tcagcatagtagtgcacgaccggtgctcgatttagtctagcgactttgggtttggggtgctcagttaggacccagagggaaccatggaaagccagcgcagcttctcttcctcctgctactctgctccagagacgacggagagattgtattgacgcagtcctaccaacccacctgttctttgtcgtccggtggggggagacgcctaccctctccgtgcgacgggctagtacgttaacgttttaagtagttaagtttagttacgtccgttaggtactacggaacctaaaaaccgtcggaccgtacggccctaccccggtacctttccgttccgttttcgttttggggtacggtacgtacccggtaaccggaccgggtaccccgtaaccgtccgggaacccccgaacccccggaacggaaccggaacggtacgtacggtacggtcgggacgtacggggtcgggtacggtacggggaacctaacggttaccgttactacgtttacctaccctaaacgtaactaacgaaacgtaacggtaccgtacgtacgtacgtacccggtaaagtaaacgtacgttactttcggtaacgtttaaacctttacgtacgttacgtaccgaagttaccgtaagggttttacttaccccgggttacccggtttcccggggtacgggttaacccggttacccgggaaacggtaaacggggtaccggtaacgggtacggaacctaaaccggtaacccgtaaaccggtacgtcgggtacggtacccaccggtaacaccgttattaccgggtacgttaccttacccgtacttccccggtaccctattaccgttcccgtaactaaccccttaaggtttccctgggtaccg

SEQ ID NO: 234608 - DNA, 851 bp, Homo sapiens
  misc_feature: GYAE6OF01AO65V.10.26.C04.1.454.CMB.1.raw
  modified_base (197)..(197): a, c, t, g, unknown or other
  misc_feature (197)..(197): n is a, c, g, or t
tcagcatagtagtgcacgaccggtgctcgatttagtctagcgactttgggtttgggggtgctcagttaggacccagagggaaccatggaaagcccagcgcagcttctcttcctcctgctactctggctccagagacgaccggagagattgtattgacgcagtctccaaccaccctgtctttgtctccggtggggganacgccaccctctcctcgcgacgggccagtacgtaaccttttagtagttagtttatttacgccgtaggtactaccggaacaaaaccgtcggaccgacggtccgtccccgacttccgttctttcgtttgggtacgtacgcctaacggcgggaccctacgtcggacccacccgagaacgacggtactcgagggtcggacgtacgggccgggtcggtacgggaaccgtaacggtacctttaccgtaccgtttacctaccaaccctaactaacctaaacgacgtaacgtcggaccgtacggtaccgttaagaaacgttacgtttaaacgttccgtaaccgttaacgttttaaccgtacgttacggtacctaaggtaccgttaagtttaccggttaacccggggtttacccggtcccccggggtttagggtaaccccgggtttacccggggaaaccgttaaaccggggggtaacccgtaaacgggggttaccgtaactaacccggttaaacccgtaaaccggttaccggttcggggtaccgaccgttccgaaccgtccctaaccgtttaccggttccgtttaccgttaaccggtacccttccccggttaacccgtcctaccgttaattaccccggacctttaacgttccgtaaggtccgg

SEQ ID NO: 234609 - DNA, 172 bp, Homo sapiens
  misc_feature: GYAE6OF02FI3WB.10.26.C04.1.454.CMB.1.raw
  modified_base (171)..(172): a, c, t, g, unknown or other
  misc_feature (171)..(172): n is a, c, g, or t
tcagcatagtagtgcacgaccggtgctcgatttagtctagcgactttgggtttggggaagaggaagactgacggtcccccaggagttcaggtgctgggcacagcggccctgggctgcctggtcaaggactacttcccactactatgctgagcggctggcaaggcgcatagnn

SEQ ID NO: 234610 - DNA, 173 bp, Homo sapiens
  misc_feature: GYAE6OF02G09C9.10.26.C04.1.454.CMB.1.raw
  modified_base (173)..(173): a, c, t, g, unknown or other
  misc_feature (173)..(173): n is a, c, g, or t
tcagcatagtagtgcacgaccggtgctcgatttagtctagcgactttgggtttgggggaagaggaagactgacggtcccccaggagttcaggtgctgggcacagcggccctgggctgcctggtcaaggactacttcccactactatgctgagcgggctggcaaggcgcatagn

SEQ ID NO: 234611 - DNA, 173 bp, Homo sapiens; identical to SEQ ID NO: 234610
  misc_feature: GYAE6OF02ITX6H.10.26.C04.1.454.CMB.1.raw
  modified_base (173)..(173): a, c, t, g, unknown or other
  misc_feature (173)..(173): n is a, c, g, or t

SEQ ID NO: 234612 - DNA, 619 bp, Homo sapiens
  misc_feature: GYAE6OF02I0UDD.10.26.C04.1.454.CMB.1.raw
  modified_base (395)..(395): a, c, t, g, unknown or other
  misc_feature (395)..(395): n is a, c, g, or t
tcagcatagtagtgcacgaccggtgctcgatttagtctagcgactttgggtttggggtgctcagttaggacccagagggaaccatggaaagcccagcgcagcttctcttcctcctgctactctggctcccagagacgaccggagagattgtattgacgcagtctccaaccaccctgtctttgtctcctggggggagagccacctctcctgcagggccagtgaaccttttagtagtagttatttagcctggtatcggcaaaaacctggccaggctccccgactcctcttctttcggtgagcctacagggccactggcaccccagaccaggatcagtggcaggcgggtctggggacagacttcaagttctcacatcaaacagactgcagcctagaanatattgactagtttactacgtgtacagtcaagttatacggtttaaccgtccccgttagggaaccgtttccggaccgtaaacggggtaacccgaaggttacgggactaacgtaccgaaacccgtaaacgtgtacgggactcggacctacctatcgttacgttcgttacacttacccgttacccgttactaacttccgtacggtaaccctaccgttacgtattcgg

SEQ ID NO: 234613 - DNA, 508 bp, Homo sapiens
  misc_feature: GYAE6OF02J0BKD.10.26.C04.1.454.CMB.1.raw
  modified_base (196)..(196): a, c, t, g, unknown or other
  misc_feature (196)..(196): n is a, c, g, or t
  modified_base (363)..(363): a, c, t, g, unknown or other
  misc_feature (363)..(363): n is a, c, g, or t
  modified_base (505)..(505): a, c, t, g, unknown or other
  misc_feature (505)..(505): n is a, c, g, or t
tcagcatagtagtgcacgaccggtgctcgatttagtctagcgactttgggtttggggtgctcagttaggacccagagggaaccatggaaagcccagcgcagcttctcttcctcctgctactctggctcccagagacgaccggagagattgtattgacgcagtctccaaccaccctgtctttgtctcctgggggganagccaccctctcctgcagggccagtgaaccttttagagtagttatttagcctggtatcggcaaaacctggccaggctccccgactcctcttctttggtggagcctacagggccactggccaccccagacaggatcagtggcagcgggtctgggacagacttcattcncaccatcaacagactgcagcctgaagatatgcagtttactatgtcagcagtatgttacgtcccgtgacgttcgcgaggaccaaggtgacatacaacgactgtgctgcacatctgtctcatcctccgcactctgacactactntcg

SEQ ID NO: 234614 - DNA, 576 bp, Homo sapiens
  misc_feature: GYAE6OF02IG4F7.10.26.C04.1.454.CMB.1.raw
  modified_base (295)..(295): a, c, t, g, unknown or other
  misc_feature (295)..(295): n is a, c, g, or t
  modified_base (365)..(365): a, c, t, g, unknown or other
  misc_feature (365)..(365): n is a, c, g, or t
  modified_base (392)..(392): a, c, t, g, unknown or other
  misc_feature (392)..(392): n is a, c, g, or t
  modified_base (417)..(417): a, c, t, g, unknown or other
  misc_feature (417)..(417): n is a, c, g, or t
tcagcatagtagtgcacgaccggtgctcgatttagtctagcgactttgggtttggggtgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgatcctcttctttggnggagcctacagggccacgtggccaccccagacaggatcagtggcagcgggtctgggacagacttcattcncacatcagcagcctagagcctgaagtnttttgctagttttactacttgtacngacagcgtcgcctacgtttccgggcggtaggtcgccgtacgtttcgggcggaacgggaacctaaaagtggtaacggtacgaaacgaacgtggtaggctgacaccagtcgtagttaccttcacttccgttacccgcctacgtcctacgacctacttaacg

SEQ ID NO: 234615 - DNA, 647 bp, Homo sapiens
  misc_feature: GYAE6OF02G3IKB.10.26.C04.1.454.CMB.1.raw
  modified_base (366)..(366): a, c, t, g, unknown or other
  misc_feature (366)..(366): n is a, c, g, or t
tcagcatagtagtgcacgaccggtgctcgatttagtctagcgactttgggtttggggtgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaacctggccaggctccccgactcctcttctttggtggagccctacaggggccacgtggccaccccagacaggatcagtggcagcgggtctgggacagactcattcncaccatcaacagactgcacgcctagaagatatgactagtttactactgtcagctagtacttcggttaccgttccccggtgggtaccgtttccgggaccgtaaacggggtaccctaagggtacggtaccaaacgtaccgaaacccggtaacgttggttaccgggtccttacgggaccctaacccgtacgttccgttacgggttcctttacctaccgttccccgtttaccccgtacccgttacttccggtacggtaacccctaacctttacccgtagttccgg

SEQ ID NO: 234616 - DNA, 613 bp, Homo sapiens
  misc_feature: GYAE6OF02HE8CG.10.26.C04.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (253)..(253): a, c, t, g, unknown or other
  misc_feature (253)..(253): n is a, c, g, or t
tcagcatagtagtgcacgaccggtgctcgatttagtctagcgactttgggtttggggtgctcagttaggacccagagggaaccatggaagccccagctcagcttctcttcctcctgctactctggctcccagacaccaccggagaaattgtgttgacacagtctccagccacgctgtctttgtctccaggggaaangccaccctntcctgcagggccagtcagagtgttcgcacttcgttagggtgtatcaanataaatccggccaggctcccaggctcctcatctttgatcgtctttcaacagggcccctggccgtcccaggccagggttcagtggcagtgggctggacagacttcactctcacatcagcagcctagacgcctagaagtattttgctagtttattactgtcagcagtcgtcgccctacgtttcgggcggtacggttcgcccgttaacgttttcgggaccgggtaagggaacccgtaaaagttacggaacggttaaccgaaaaccgaaccgttcggttacggcgttacggacctaacccgtaacttccgtttagttacccgtttacctaacgttcccgtttccccggtacccgtacttaccgg

SEQ ID NO: 234617 - DNA, 675 bp, Homo sapiens
  misc_feature: GYAE6OF02I0H5R.10.26.C04.1.454.CMB.1.raw
  modified_base (353)..(353): a, c, t, g, unknown or other
  misc_feature (353)..(353): n is a, c, g, or t
tcagcatagtagtgcacgaccggtgctcgatttagtctagcgactttgggtttggggtgctcagttaggacccagagggaaccatggaaagcccagcgcagcttctcttcctcctgctactctggctcccagagacgaccggagagattgtattgacgcagtctccaaccaccctgtctttgtctcctgggggagagccaccctctcctgcagggccagtgaaccttttagtagtagttatttagcctggtatcggcaaaaactggccaggctccccgactcctcttcttggtggagcctacacgggccacgtggcctaaccccaggacaggatcaagtggcacggcgggtcngggacaggacttcattccgtacaccacttcgaaacacggtaaccttgacacgcccgtagaacggtacttacgttcgacttaacggttttaactacgttcgtacaacgtacgtaagtttacttacggttaaccggtccccgttagggtacccggttcgtaacccgtaagggacccgttaagggtacggtacctaaacgttaccgaacccggtaacgttacggcggtactacgggtaccctaaccgtacttcggttaccgttcgttaacctcggttaccctcccggacttaacgttcggtacctaacctacttacgagttccgg

SEQ ID NO: 234618 - DNA, 524 bp, Homo sapiens
  misc_feature: GYAE6OF02FV4Y3.10.26.C04.1.454.CMB.1.raw
tcagcatagtagtgcacgaccggtgctcgatttagtctagcgactttgggtttggggtgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctagaagatattgctagtttactactgtcagcagtatgttacgtcccgtggacgttcggaccaagggaccaagggtgacaatcaaccgactgtgctgacaccatctgtcttcatccttcccgcatctgacactactatcg

SEQ ID NO: 234619 - DNA, 667 bp, Homo sapiens
  misc_feature: GYAE6OF02H56NK.10.26.C04.1.454.CMB.1.raw
tcagcatagtagtgcacgaccggtgctcgatttagtctagcgactttgggtttgggggtgctcagttaggacccagagggaaccatggaaagcccagcgcagcttctcttcctcctgctactctggctcccagagatgaccggagagattgtattgacgcagtctccaaccacctgtctttgtctccgtggggggagagccaccctctcctgcagggccagtgtaaccttttagtaggttagttatttagtcctggtatcggacaaaaccgtggccaggcctcccgactccttctttcgtttggtggacgtccgtacgacgggccacgtcggccacccgagacaggatcgaggtggcgacggcgggtcgtagggacagtacttctacttctcaccatacaacgagactacgcacgaccgtagaagtatttatcgtacttaagttttactacttcgtacacgtactacggttattccggttacccggtaccccggtagggttaccggttccgggaccgtaaacgggaccgtaagggtcggaactaacgtaccgaacgtacgtggtaggtctacgaccttacctacgttaccgttcgttaccgttacctacgttaccccgttccccgtaccttaacgttcccgtaaccgaacctttaccgtaattacgg

SEQ ID NO: 234620 - DNA, 551 bp, Homo sapiens
  misc_feature: GYAE6OF02GV0AU.10.26.C04.1.454.CMB.1.raw
tcagcatagtagtgcacgaccggtgctcgatttagtctagcgactttgggtttggggtgctcagttaggacccagagggaaccatggaaagcccagcgcagcttctcttcctcctgctactctggctcccagagacgaccgggagagattgtattgacgcagtctccaaccaccctgtctttgtctcctgggggggagagccaccctctcctgcagggccagtgaaccttttagtagtagttatttagcctggtatcggcaaaaacctggccaggctccccgactcctcttcttggtggagcctacagggccactggcaccccagacaggatcagtggcagcgggtctgggacagacttcattctacaccatacaacagactgccagcctagaacgatagttgactagtttactacgtgtcagcagttatcgttacgtcccgtggacgttcggacgagggaccgtaggtggacaagtccaacgtacgtcgtggctgaccactatcgtgtcttacacttccttacccgcctatcgtcactacttactatcgg

SEQ ID NO: 234621 - DNA, 650 bp, Homo sapiens
  misc_feature: GYAE6OF02G3YHV.10.26.C04.1.454.CMB.1.raw
  modified_base (196)..(196): a, c, t, g, unknown or other
  misc_feature (196)..(196): n is a, c, g, or t
  modified_base (440)..(440): a, c, t, g, unknown or other
  misc_feature (440)..(440): n is a, c, g, or t
tcagcatagtagtgcacgaccggtgctcgatttagtctagcgactttgggtttggggtgctcagttaggacccagagggaaccatggaagccccagcgcagcttctcttcctcctgctactctggctcccagacaacactgcaagaaatagttatgacgcagtctccagccaccctgtctgtgtctccgagggganagacgcccaccctctccgtgcgacggggccgtcaagtaattattgcctaaccaacgttagccttggtactacaaacaaaacgcctggaccaggcctacccagacctcctcacttctcgtggtcgctattccgtacggacgggcctacgtcgggtacgtccccgaggtcccgtaggttcgaggtcggacgtaggtcgggtactaggaacgtgtacgttcacttcacgaccatcgacggcggtcgngtcgtgtactaggtaatgtttcgacttacgtttacttacgtagtcagtactaagtaattagtcgttaggtttggttttactcgttaccgtttccgggtcccgttaaggtaaaccgtaaaggttcgtaacgttttcgaacggttaaccgtacggttggtcggtactacggtaccctactcgttaccgttgttaccttacgtacgttccccg

SEQ ID NO: 234622 - DNA, 534 bp, Homo sapiens
  misc_feature: GYAE6OF02FUXQ2.10.26.C04.1.454.CMB.1.raw
  modified_base (196)..(196): a, c, t, g, unknown or other
  misc_feature (196)..(196): n is a, c, g, or t
  modified_base (306)..(306): a, c, t, g, unknown or other
  misc_feature (306)..(306): n is a, c, g, or t
  modified_base (348)..(348): a, c, t, g, unknown or other
  misc_feature (348)..(348): n is a, c, g, or t
  modified_base (365)..(365): a, c, t, g, unknown or other
  misc_feature (365)..(365): n is a, c, g, or t
tcagcatagtagtgcacgaccggtgctcgatttagtctagcgactttgggtttggggtgctcagttaggacccagagggaaccatggaaagcccagcgcagcttctcttcctcctgctactctggctcccagagacgaccggagagattgtattgacgcagtctccaaccaccctgtctttgtctcctgggggganagccaccctctcctgcagggccagtgaaccttttagtagtagttatttagcctggtatcggcaaaaacctggccaggctccccgactcctcttctttggtggagcctacngggccactggccaccccagacaggatcagtggcagcgggtcngggacagacttcattcncaccatcaacagactgcagcctagaacgtatattgactagtttacactgtcagcagtatgttaccgcccgtgacgttcggaccaagggccaaggtcgacaatccgaaccgactgtgacctgaccaccgatctgtcttcatccttcccgctactctgacacttactatcg

SEQ ID NO: 234623 - DNA, 608 bp, Homo sapiens
  misc_feature: GYAE6OF02F3TL3.10.26.C04.1.454.CMB.1.raw
  modified_base (386)..(386): a, c, t, g, unknown or other
  misc_feature (386)..(386): n is a, c, g, or t
tcagcatagtagtgcacgaccggtgctcgatttagtctagcgactttgggtttggggtgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtacgttatttagcctggtatcggcaaaaacctggccagcctcccaggctcctcgtctatggtgcatccacaacgggccactggtactccagccaggttcaggtgcaggtgggtctgggacaggacgttcgctctcacctatcagctagtcngcacgtctagaagtattttagcttagtttattacgtgtactaggtaatagtagtagtagcgttcggccttaccgtaccttacgttttcggaccgtaacgggtacctaaggttcggaacgtacgtactaaaaccggactacggtacggcgtacgtactacctaacgtccgttacgtccgtttactaccgtttcccgttaccccgtaccttactccgttaaccg

SEQ ID NO: 234624 - DNA, 660 bp, Homo sapiens
  misc_feature: GYAE6OF02INZS4.10.26.C04.1.454.CMB.1.raw
  modified_base (105)..(105): a, c, t, g, unknown or other
  misc_feature (105)..(105): n is a, c, g, or t
  modified_base (351)..(351): a, c, t, g, unknown or other
  misc_feature (351)..(351): n is a, c, g, or t
tcagcatagtagtgcacgaccggtgctcgatttagtctagcgactttgggtttggggtgctcagttaggacccagagggaaccatggaaagcccagcgcagcttntcttcctcctgctactctggctcccagagacgaccggagagattgtattgacgcagtctcaaccacctgtctttgtctcctggggggagagccaccctctcctgcagggccaggtgaacttttagtagtagttattagcctggtatcggcaaaacgtgccaggctcccgactcctcttcttggtggacgcctacgacgggccacgtcggccgaccccaggtacaggatcgaggtggcaggcgggtntgggacagtacttcgattctccacctataccaacagactgacctagccgtagaacgtatacgtgtaccgtaacgtttaactacgttggtacctagaccgtagttacttcgggttacccgttcccggtagggtaccggttccggaaccgtaacgggtaccggtacgggtacgggacgtaaccgtacgaaaccggttaacgtgggttacggacttacgaccgaaccgtacgttacgttcggtacctttcctacgtttcccgttacccgtaccgttacttacggttaccgactaacttaccgtagttaccgg

SEQ ID NO: 234625 - DNA, 637 bp, Homo sapiens
  misc_feature: GYAE6OF02H6010.10.26.C04.1.454.CMB.1.raw
  modified_base (197)..(197): a, c, t, g, unknown or other
  misc_feature (197)..(197): n is a, c, g, or t
  modified_base (302)..(302): a, c, t, g, unknown or other
  misc_feature (302)..(302): n is a, c, g, or t
  modified_base (609)..(609): a, c, t, g, unknown or other
  misc_feature (609)..(609): n is a, c, g, or t
tcagcatagtagtgcacgaccggtgctcgatttagtctagcgactttgggtttggggtgctcagttaggacccagagggaaccatggaaagcccagcgcagcttctcttcctcctgctactctggctcccagagacgaccggagagattgtattgacgcagtctccaaccaccctgtctttgtctccgtgggggagngccacctctcctgcgagggccagtcgtaaccttttagtacgttagttatttagccgtggtatcggacaaaaacgtggacaggcctccccgatcctcttcgttggngagctacgaggccacgtggcccacccagacagatcagtggcaggcgggtcgtgggacaggtacttcacttccgtacacactacaacgagtaactcgacacgccgtagaagtattagtttggaccttaaggttttacctacgtgtaccgagctaaaggtttgttccggtttaaccggtcccggttagggtaccgtttccgggaacgtaacgggtaaccgagggtccgaacgtaactaccggaaaccgtaagttcggcggactacggacctacctagttccttacggtcttacgccttccgttacccgnttggtacctgaacctcttacgtatccgg

SEQ ID NO: 234626 - DNA, 529 bp, Homo sapiens
  misc_feature: GYAE6OF01DR89U.21.55.E11.1.454.CMB.1.raw
tcagtcgtcgctcgcacgaccggtgctcgatttagcactcgcacgttgggtttggggagtcagtctcagtcaggacacagcatggacatgagggtcccgctcagctcctggggctcctgctactctggctccgaggtgccagatgtgacatccagatgacccagtctccatcatccctgtctgcatctgtcggagacagaatcaccattatttgccggacaagtcacgacataaacaccttttaaatggtatcagcacaaaccagggaagccccaaagctcctgatcgatgctgcatccaatttagagagtgggtcccatccaggttcagtggcgatggatctgggacaaatttcactctcacatcagcagtctgacaactgaagtattttgctaactttactatttcgtacaacagtagtttaacagttaatttcctttacacttttccggcccttagggacccgtaaaggttccgaattaactacaaaacggtaacctggtggaccttgacctaccattctgttacc

SEQ ID NO: 234627 - DNA, 1052 bp, Homo sapiens
  misc_feature: GYAE6OF01DDNPZ.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcacctccgtctcgtcgactctcgttcggacggaacacgaatactacccaacttattttagtccggaccgaacgtacgacgacgaactaaactaaaccctttttaaactttttaaggtagttactacgacaccaaaaccaacgggaaggggaaccccgaaaccgaacgtccttacccgtagtacgtaccgtaagtcggtcttcggactacttaccctttaaagtttaacggaggtaacggggtttcccggggtacccctaacgttcccggttaacggggtttacctaaggggttcgggaccggtaaggtttacgggtaacgtttaccgggttacggggggtaaaaacctttaaaacgtttttacccgtaaacccgtttaccccgttaaccccgaaacccgtttaacttaccccggaaacgtacccggttaacgggtttaccctttacgggaaaccccctttaaaaccggttaagggttaaacgtttttaaccgttttttttaaccggaaaccctttttaaaacccgtttttaaccgtttttaaaggttttaccgttaaaacccgtaaacccggttaaaagggtttaaacccgtttttaaacccgtttaaacgggttttttaaccccttttttacccccggtttttaacccgtttttaaacccccgggttttcccccggggtttaccccgggtttaaaaccccggggggggttaaacccccgtaaacgggttttacccggttaaaaccgttttaaaaccgttaaaaccccgggttaaaaaacccggtttaaacggtttccgggggttaacggttacccccgggtttaacggaaccccctaaaccccgtttaactttcccggttttacggtttttaaccccc

SEQ ID NO: 234628 - DNA, 525 bp, Homo sapiens
  misc_feature: GYAE6OF01CCL03.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaactaccttttaaatgtatcagcacaaacagggaacgccccaaagctcctgatcgatgctgcatccaatttagagagtcgggtcccatccaggttcagtggcgatggatcgtggactaaatttcactctcaccatcagcagtctgctaacctgaatattttgactaacttactattgtacaactagtattacagttactttcctttactacgtttccggcccgttagggaacccgtaagtccgattaactacaaaacggtactaggtgactcgaccaactacttctgttcc

SEQ ID NO: 234629 - DNA, 541 bp, Homo sapiens
  misc_feature: GYAE6OF01D3E94.21.55.E11.1.454.CMB.1.raw
  modified_base (220)..(220): a, c, t, g, unknown or other
  misc_feature (220)..(220): n is a, c, g, or t
  modified_base (531)..(531): a, c, t, g, unknown or other
  misc_feature (531)..(531): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacatttattgccganaagtcacgacaataactacttttaaatggtatcagcaacaacagggaacgcccaaagctcctgatcgatgctgcatccaatttagagtaggtcgggtaccagtccgtaggttcaggtggacgagtgatcgtagggaactaatttcactctacacctatcagctagtctacgactaacgtagtaacgttatttacgactaacttactattacgtacaagtagtaattacagtttacttacctttctaaccgtttccgaccgtaggaaccgtagtacgtaactataacaaacgtcgtagtgactacgacactnttctgttacc

SEQ ID NO: 234630 - DNA, 503 bp, Homo sapiens
  misc_feature: GYAE6OF01DWMZS.21.55.E11.1.454.CMB.1.raw
  modified_base (388)..(388): a, c, t, g, unknown or other
  misc_feature (388)..(388): n is a, c, g, or t
tcagtcgtcgctcgcacgaccggtgctcgatttagcactcgcacgttgggtttgggggagtcagtctcagtcaggacacagcatggacatgaggtccccgctcagctcctggggctcctgctactctggctccgaggtgccagatgtgacatccagatgacccagtctccatcatccctgtctgcatctgtcggagacagaatcaccattatttgccggacaagtcacgacataaacaccttttaaattggtatcagcacaaaccaggaagccccaaagctcctgatcgatgctgcatccaatttagagagtgggtccatcaggttcagtggcgatggatcgtgggacaaagtttcactctcacatcagcagtctgacaactgaagtnttttgactaactttactattcgtacaacagtagttaacagttactttcctttctactttcggcccttgggaccctagtcgagtactacaaacgtactgtgctgacactatctgtc

SEQ ID NO: 234631 - DNA, 492 bp, Homo sapiens
  misc_feature: GYAE6OF01BZ2RN.21.55.E11.1.454.CMB.1.raw
  modified_base (486)..(486): a, c, t, g, unknown or other
  misc_feature (486)..(486): n is a, c, g, or t
tcagtcgtcgctcgcacgaccggtgctcgatttagcactcgcacgttgggtttgggggagtcagtctcagtcaggacacagcatggacatgagggtcccgctcagctcctggggctcctgctactctggctccgaggtgccagatgtgacatccagatgacccagtctccatcatccctgtctgcatctgtcggagacagaatcaccattatttgccggacaagtcacgacataaacaccttttaaatggtatcagcacaaaccagggaagccccaaagctcctgatcgatgctgcatccaatttagagagtgggtcccatccaggttcagtggcgatggatctgggacaaatttcacttctcaccatcagcagtctgcaacctgaagtattttgactaactttactatttgtacaacagtagttacagttattcctttcactttcggcctgggaccagtcgatatacaaacgactgtgctgcacntctgtc

SEQ ID NO: 234632 - DNA, 486 bp, Homo sapiens
  misc_feature: GYAE6OF01AWTEU.21.55.E11.1.454.CMB.1.raw
  modified_base (480)..(480): a, c, t, g, unknown or other
  misc_feature (480)..(480): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacaccttttaaatggtatcagcacaaaccaggaagccccaaagctcctgatcgatgctgcatccaatttagagagtgggtcccatccaggttcagtgcgatggatctgggacaaatttcactctcacatcagcagtctgcaacctgaagattttgctaacttactattgtacaacagagttacagttattcctttcactttcggccctgggaccgaagtcatatcaaacgactgtgctgcaccntctgtc

SEQ ID NO: 234633 - DNA, 553 bp, Homo sapiens
  misc_feature: GYAE6OF01C87AF.21.55.E11.1.454.CMB.1.raw
  modified_base (343)..(343): a, c, t, g, unknown or other
  misc_feature (343)..(343): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaactaccttttaaattggtatcagcaacaaacaggaagccccaaagctcctgatcgatgctgcatccaatttagagagtgggtccatccagttcagtggcgatggatcngggacaaatttcactctcacatcagcagtctgacaacctgaagtattttgactaactttactattgtacaactagtagttaactagttactttccctttctaaccttttcgggacccttaggggaaccctaaaggttccgaacgttaacttaccaaaaacggtaaccttggttacggcttacggacctaaccgaacttcgttggttaccc

SEQ ID NO: 234634 - DNA, 552 bp, Homo sapiens
  misc_feature: GYAE6OF01CVCPT.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacattattgccggacaagtcacgacataaacacctttttaaatgtatcagcacaaaccaggaacgccccaaagctctgatcgatgctgcatccaatttagagagtcgggtccatccaggttcagtggcgatggatcgtaggactaaatttcactctacaccatcagcagtctagacaactgaagtattttgactaaactttactatttgactaacagtaagtttaacaagttactttccctttactaaccttttcggaccccgttagggaaccctaaggttctaagttaactaccgaaaacggtacttcggtaggaccgtagtccaacccgtattccgtgtttaccc

SEQ ID NO: 234635 - DNA, 567 bp, Homo sapiens
  misc_feature: GYAE6OF01A8JYV.21.55.E11.1.454.CMB.1.raw
  modified_base (222)..(222): a, c, t, g, unknown or other
  misc_feature (222)..(222): n is a, c, g, or t
  modified_base (286)..(286): a, c, t, g, unknown or other
  misc_feature (286)..(286): n is a, c, g, or t
  modified_base (375)..(375): a, c, t, g, unknown or other
  misc_feature (375)..(375): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccgganaagtcacgacataaactaccttttaaatgtatcagcaacaaacaggaacgccccaaagctaccngatcgatgctgcatcctaatttagagtaggtcgggtcccagtccgaggttcaggtggcgagtggatcgtagggactaaatttcacttcncacatcagcagtctgaccaactgaattattttcgactaacgtttatagtttagtacctaatagtaagtttactagttactttcctttacgtaccgtttccgggacccttagggaaccgtaacgttacgaacgttactaaccgaaacgtaacgtaggtcggtacgttacgacctaacctagttcctcgttacc

SEQ ID NO: 234636 - DNA, 549 bp, Homo sapiens
  misc_feature: GYAE6OF01E1A9R.21.55.E11.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgccgganaagtcacgacataaactacctttttaaatggtatcagcaacaaacgagggaacgaccccaaagctcctgatcgatgctgcataccaatttagagtaggtcgggtacccagtccgaggttcaggtggacgagtggatcgtaggactaaattcactctcaccatcagcagtctagacaacgtgaagttattttacgactaactttactattgtacaacgtagtaacttacagtttacctttcctttactaccgtttccggaccttcgggaacctagtacgtaatactacgaaacgtcgtggtcggacctagacctactattcgtgtacc

SEQ ID NO: 234637 - DNA, 565 bp, Homo sapiens
  misc_feature: GYAE6OF01CGCBH.21.55.E11.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccganaagtcacgacataaactacctttttaaatgtatcagcacaaaccaggaacgcccaaagctcctgatcgatgctgcatccaatttagagagtcgggtccagtccgaggttcagtggcgatggatcgtaggactaaatttcactctcacatcagctagtctgacaacctgaatattttgactaacttactattgtacaactagtaagttactagttactttccctttactaaccgtttccggacccgttaggggtaacccgtaagttaccgtaagttaccttaaccgaaaacggtaaccgttggttacggtaccttacgaccctaaccctacttccgttgtttaccc

SEQ ID NO: 234638 - DNA, 560 bp, Homo sapiens
  misc_feature: GYAE6OF01CTQP8.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaactacttttaaatgtatcagcaacaaccagggaagccccaaagctcctgatcgatgctgcatcaatttagagagtcgggtccatccgaggttcagtggcatggatcgtggacaaatttcactctcaccatcagcagtctagacaacctgaagtattttcgactaactttactattcgtacaacgtagtagttactagttactttaccttttactaccgtttccggtacccgttagggtaaccccgtaaagttccgtaaattacgtaacgtaaaccgtaaacgttcggtacggtactacggtacccaacctacgttccttgttccc

SEQ ID NO: 234639 - DNA, 504 bp, Homo sapiens
  misc_feature: GYAE6OF01BGKB3.21.55.E11.1.454.CMB.1.raw
tcagtcgtcgctcgcacgaccggtgctcgatttagcactcgcacgttgggtttggggagtcagtctcagtcaggacacagcatggacatgagggtcccgctcagctcctggggctcctgctactctggctccgaggtgccagatgtgacatccagatgacccagtctccatcatccctgtctgcatctgtcggagacagaatcaccattatttgccggacaagtcacgacataaacaccttttaaattggtatcagcacaaaccagggaaggccccaaagctcctgatcgatgctgcatccaatttagagagtgggtcccatccaggttcagtggcgatggatctgggacaaatttcactctcaccatcagcagtctgcaacctgaagtattttgactaaactttactatttgtacaactagtaatttacagttactttccctttcactttcggccctgggacctaagtcgaatactacaaacgtactgtgctgcacatctgtc

SEQ ID NO: 234640 - DNA, 572 bp, Homo sapiens
  misc_feature: GYAE6OF01B19MT.21.55.E11.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccgganaagtcacgacataaactacttttaaatgtatcagcacaaaccaggaacgccccaaagctcctgatcgatgctgcatccaatttagagagtgggtcccatccaggttcaggtgcgatggatcgtagggactaaagtttcacttctacacatcagcagtctgacaactgaagtattttcgactaaacttactattcgtacaacgtagtaagtttaacagtttacttccttttacgtaccgtttccgggacccgttaggggtaacccgtaaggtaccgtaacgttaacgtaaccgtaaaacggtaacgttggtacggtccttaggaccctaacccgtaacttccgttgttaccc

SEQ ID NO: 234641 - DNA, 554 bp, Homo sapiens
  misc_feature: GYAE6OF01A1DL6.21.55.E11.1.454.CMB.1.raw
  modified_base (368)..(368): a, c, t, g, unknown or other
  misc_feature (368)..(368): n is a, c, g, or t
  modified_base (417)..(417): a, c, t, g, unknown or other
  misc_feature (417)..(417): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaactaccttttaaatgtatcagcacaaacaggaacgccccaaagctctgatcgatgctgcatccaatttagagagtgggtcccagtccaggttcagtggcgatggatgtaggactaaattcactctcacatcancagtctgacaacctagaagtattttgactaactttactattgtactaanagtagttacaagtttactttacctttactaccgttttccggaccttacggggtaaccctacgttaccggaattacgtaaccgtaaaacggtaacttcggtacgtaccgtacgaccctaaccattccgttcgttaccc

SEQ ID NO: 234642 - DNA, 672 bp, Homo sapiens
  misc_feature: GYAE6OF01ARFMO.21.55.E11.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtcctccatcactccctgtctgcatctgtcgganacagaactcacctattattcgccggacaagtcacgacaataaacttaccttttaaatggtatcagcaacaaacgaggaacgaccccaagctcctgactcgatgctgactactacctaatttagaggtacggtcgggtacccagtccgtaggttcaggtggacgtagtggacttcgtagggtaaccttaaagtttcacctctacacctatccaagctagtctacgacctaaccgttaggtaacttacttttacgaacctttaaacctttacgttaactttacgaacctaaacgtaaggttaacgtttaaccttaacgtttaaccttttccctttaaccgttaccggttttaccgggtccccggttaagggtaaccccgtaagttaccggttaacgttaacgtaaccgtaaaaccgtacggttacgtacgggtaccttcgtaacccctaaccgttacgttccgtttcgttacccg

SEQ ID NO: 234643 - DNA, 593 bp, Homo sapiens
  misc_feature: GYAE6OF01CEUO0.21.55.E11.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattgaccganaagtcacgacaataaactacttttaaatggtatcagacaacaaaccgagggaacgacccaaagctcctgatcgatgctgcatacctaatttagagtaggtcgggtacccagtccgaggttcaggtggcgtagtggatcgtaggaactaaagtttcactctacactatcagctagtctacgacaactgaagttctttacgacctaacttactattcgtaacaacgtagtaacgttactaagtttactttcccgtttactaccgtttccggacccgttagggaaccctaaggttacgtaacgttaacgtaaccgaaaaccgtacgttacggtacggtaccttacggaccctaaccgtattccgtcgtttacccg

SEQ ID NO: 234644 - DNA, 579 bp, Homo sapiens
  misc_feature: GYAE6OF01CPGRK.21.55.E11.1.454.CMB.1.raw
  modified_base (196)..(196): a, c, t, g, unknown or other
  misc_feature (196)..(196): n is a, c, g, or t
tcagtcgtcgctcgcacgaccggtgctcgatttagcactcgcacgttgggtttgggggagtcagtctcagtcaggacacagcatggacatgaggtccccgctcagctcctggggctcctgctactctggctccgaggtgccagatgtgacatccagatgacccagtctccatcatccctgtctgcatctgtcgganacagaatcacattattgcgacagtcagacataactacttttaatgtatcagcaacaaacgaggaacggcccaaagctcctgatcgatcgactgacatacctaatttacgagtaggtcggggtacccagtccgtaggttacaggtggcgtaatcggatacgtagggaactaaattccaactctccaacctatcagctagtctcgactaaccgtggaattatttcgaacttaattaactagtttcgtaacaactagtaactttactaaggtttacctttacctttacaccgtttaccggcccgtacgggtaacgaacgttcgtaacgttaactaaccgaaaacgtccttagggtcgctacggacctaaccgtattcgtcgttacc

SEQ ID NO: 234645 - DNA, 677 bp, Homo sapiens
  misc_feature: GYAE6OF01DQZ0U.21.55.E11.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgccgganaagtcacgacataaactaccttttaatggtatcagcaacaacgagggaacgaccccaagctcctgatcgatgctgcatacctaaatttaggagtacggtcgggtacccatccgtaggttcaggtggacgtagtggatcgtagggactaatttcactctcacatcagcagtctacgactaactgtaagtatttcgaccttaaactttacttaagtttcgtaccaaacgtaggttaactttaaccgttaacgtttaccttttacccttttaccgttaaccggtttttccccgggaaccccgtttacgggggtaaacccgttaaacggttcccggtaaaacgtttaaccggttaaaccgtaaaaacccgggttaacggtttcgggttaaccgggtacccgtttaaccggtaacccctaaaccccgtttaacgttttcccgtttccgggttttaacccc

SEQ ID NO: 234646 - DNA, 639 bp, Homo sapiens
  misc_feature: GYAE6OF01CJA13.21.55.E11.1.454.CMB.1.raw
  modified_base (226)..(226): a, c, t, g, unknown or other
  misc_feature (226)..(226): n is a, c, g, or t
tcagtcgtcgctcgcacgaccggtgctcgatttagcactcgcacgttgggtttgggggagtcagtctcagtcaggacacagcatggacagtgagggtccccgctcagctcctggggctcctgctactctggctccgagtgccagatgtgacatccgagatcgacccagtctccatcatccctgtcctgctatctgtcggacacagaatcaccattattcgccgganaagtcacgacataaactaccttttaaatggtatcagacaactaaaccgagggaacgccccaaagcctacctagactcgatcgctcgactactacctaaatttagagtacgtacgggtacccagttacccgaggttaccaggtggacgtagtggacttcgtagggaactaaagtttccactactcaccatacagcacgtcctcgacctaacctagaacgtacttttacgactaacgttacgtaagttcgtaactaacgtagtaacgttacgtaacggtttaactttaccgtttacgtaaccgttttcccggacccgttacggggtaacccgtaaaggttccgtaagttaacgtaccgtaaaacggtacgttcggtacggtacgtacggacctaaccgtacttccgttcgttccg

SEQ ID NO: 234647 - DNA, 590 bp, Homo sapiens
  misc_feature: GYAE6OF01EC4ZA.21.55.E11.1.454.CMB.1.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcacctattatttcgccganaagtcacgacataaactacttttaatgtatcagcacaaacaggaacgccccaaagctactgatcgatgctgcatcctaatttagagtacggtcgggtcccagtcccgtaaggttcgaaggtcggacgtagtggactacgtagggtaactaaaagtttccaacttctacaccataccagctacgttctacgactaaaccgtgtaacgttatttcgaaccttaactttacttattacgtaccaaatagttacttaactagtttaactttcctttactaccgtttccgacccgtagggtaaccgtagttccgtaattacgtaacctaaacgtacttggtccggtctacgacctaccgtatcgttgttacc

SEQ ID NO: 234648 - DNA, 502 bp, Homo sapiens
  misc_feature: GYAE6OF01CBWCE.21.55.E11.1.454.CMB.1.raw
  modified_base (221)..(221): a, c, t, g, unknown or other
  misc_feature (221)..(221): n is a, c, g, or t
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
  modified_base (489)..(489): a, c, t, g, unknown or other
  misc_feature (489)..(489): n is a, c, g, or t
  modified_base (495)..(495): a, c, t, g, unknown or other
  misc_feature (495)..(495): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccgganaagtcacgacataaactaccttttaatgtatcagcacaacaggaacgccccaaagctctgatcgatgctgcataccaatttagagagtcgggtccatccgagttcaggtggcgagtggatcgtggaactaattcactctcaccatcagctagtctgaccaactgaatatttagactaacttatattntacaanagtattacagttacttcctttctaccgtttcggcccgttaggaccgtagtcgtaatactacaaacgtctgtgctnacactntctgtcc

SEQ ID NO: 234649 - DNA, 815 bp, Homo sapiens
  misc_feature: GYAE6OF01A234T.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgccggacagtcacgacataaactacttttaaatgtatcagacaacaaaccgagggaacgccccaaagcctacctagactcgatcgctcgactactacctaaagtttagaggtaacgggttcggggtacccctagtacccgtaagggtttccgaaggttcgggacgtaagttcgggtaattccggttaggggtaaaccttaaaacgttttcccgaactttacccgttaccgtaacccgtaattacccgaaggtacctaacggtttccctaaccggtaaccgtaaacccggtttaggtaaaacgtttacgttttttaacggaaccctttaaaaccttttacgtttaacgttttaccgttaaaccgtaaaacgttaaggtttaaacgttttaacctaaacggtttttaacctttttacccccgtttttacgttaacccggtttttaccccggggacccccggtttaaggggtaaaccccggttaaacggttacccggttaaaacgtttaaaccgttaaccgtaaaaacccggttaccgtttagggttaccgggtaccttaccggtaccctaaacccgttagtttacccgttacggtttacccc

SEQ ID NO: 234650 - DNA, 536 bp, Homo sapiens
  misc_feature: GYAE6OF01DJY59.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaactacctttttaaattggtatcagcaacaaaccaggaagccccaaagctcctgatcgatgctgcatccaatttagagagtcgggtccatccaggttcaggtggcgatggatcgtgggtacaaatttcactctcacctatcagcagtctgacaacctgaagtattttcgactaacttacttattagttaacagtaagttacaagtttactttcctttcacgttttccggcccttagggaccctaagtccgtaatacgttacgaaacgtactgtacgtcttcgcctacctattctgtcttacc

SEQ ID NO: 234651 - DNA, 654 bp, Homo sapiens
  misc_feature: GYAE6OF01DDC9Y.21.55.E11.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtcctccatcatccctgtctgcatctgtcgganacagaatcactattattcgccgacagtcagacaataaactacttttaatggtatcagacacaaacgagggaacgaccccaaagcctcctagactcgatgctgcatacctaaagtttagagtaggtcgggtaccagtaccgtaggttcaggtggacgtagtggatcgtaggtactaaatttcacttctacacctatcgacgtctagttctagactaaccgttgaaacgtttcttttacgaaccttaactttacttacgttacgtaactaaacgtacgttaacgtttactaacgttttacctttccgttttacgttacccggttttcccgggacccggtttaagggtaacccgttaacgggtttaccaaacgtttaacgtaaacccggttaaaacggtccgttagggtaccgtaccgttacgaaccctacccgttaacttccgttcgtttaaccccg

SEQ ID NO: 234652 - DNA, 593 bp, Homo sapiens
  misc_feature: GYAE6OF01EELLD.21.55.E11.1.454.CMB.1.raw
  modified_base (219)..(219): a, c, t, g, unknown or other
  misc_feature (219)..(219): n is a, c, g, or t
  modified_base (582)..(582): a, c, t, g, unknown or other
  misc_feature (582)..(582): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacattattgccganagtcacgacataactactttaatgtatcagacaacaaacgaggaacgaccccaaagcctacctgactcgatcgctgctataccaatttagagtaggtcgggtacccagtccgaggttacgaggtcggacgagtcggatcgtagggtaactaaactttccaccttacctacgaacctatccgaagtcgaacgttctacgacctaaccgttagaacgttatttagaaccttaacttaacttatttacgtacaacgtagtaacgttactagtttactttcctttacgtaccgtttaccggcccgtacgggtaccctaacggtacgtaatactacgaaacgttacgtagtcgctacgacctaacctnttccgtgttcc

SEQ ID NO: 234653 - DNA, 717 bp, Homo sapiens
  misc_feature: GYAE6OF01EE2D9.21.55.E11.1.454.CMB.1.raw
  modified_base (220)..(220): a, c, t, g, unknown or other
  misc_feature (220)..(220): n is a, c, g, or t
  modified_base (266)..(266): a, c, t, g, unknown or other
  misc_feature (266)..(266): n is a, c, g, or t
tcagtcgtcgctcgcacgaccggtgctcgatttagcactcgcacggttgggtttgggggagtcagtctcagtcaggacacagcatggacatgagggtcccgctcagctcctggggctcctgctactctggctccgaggtgccagatgtgacatccagatgacccagtctccatcatccctgtctgcatctgtcggagacagaatcacattattgccgganaagtcacgacaataaactactttttaaatggtatcagcaacaaacngggaacgccccaaagcctcctgactcggatggctgctatacctaatttagacgtaaggttcggggtacccagtacccgtaggttacgaggttcggacgtagtgggacttcggtaggggaactaaacgttttccaaccttctacgaaccctagtaccaaggtctaacggttccctaacggaacctaaacccgttaggtaaacgtttactttttacggaaccctttaaacgtttttaaccgtagttttacggtaaccgtaaaccgttaaggttaacgtttaaccaaggtttttaaccctttaccccgtttttacgtacccgtttttccgggtaccccggtttaggggtaaccccggttaaaggttaccggaacgtttacgtaaacccgaaaacgggttaactcgggttaaccggtcgttacggacccttaacctcgtttccgtcgtttacccg

SEQ ID NO: 234654 - DNA, 568 bp, Homo sapiens
  misc_feature: GYAE6OF01DSK0W.21.55.E11.1.454.CMB.1.raw
  modified_base (359)..(359): a, c, t, g, unknown or other
  misc_feature (359)..(359): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcctccctgtctgcatccataggagacagagtcaccatcacttgtcgggcaagccagagcattaccaacttattgaattggtatctaagtttaaaccgaggaaacgcccctaaactcctagatctatgctgcatcctactttgctaaagtcgggtctcagactaaacttcgattcggcgtggatcgngggacagtatttcactctcaccatcagtctagtttcgactaactgacgttatttcgacctaacttacctactcgtacaacgtacggtcttacggtcgttccctcgtacgtaccgttccggaccgtaacgggtaccgaagggttacggaaactaccgtaaaaccggtatggtacggtcttacgacctactagttaccttgttccgttacc

SEQ ID NO: 234655 - DNA, 625 bp, Homo sapiens
  misc_feature: GYAE6OF01DC341.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgccggacaagtcacgacaataaactacttttaaatgtatcagcaacaaaccagggaacgacccaaagcctacctagatcgatgctgacatacctaatttagagtacggtcgggtacccagtccgtaggttcaggtcggcgtatggatcgtagggaactaatttcaacttcctacacctatacagctagtctagacctaacgtgtaattagttttacgaccttaaactttacttaatttacgtaactaaacgtaagttaacgtttaaccgtagttttacctttccctttaccgttaccgttttccggacccgttacgggtacctaaacggttacgaacgtttaacgtaaccgtaaaacgtacggttacggtacggtacctacggaccctaacctattccgttcggttaccc

SEQ ID NO: 234656 - DNA, 572 bp, Homo sapiens
  misc_feature: GYAE6OF01BPHOZ.21.55.E11.1.454.CMB.1.raw
  modified_base (560)..(560): a, c, t, g, unknown or other
  misc_feature (560)..(560): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccgacagtcacgacataaactacttttaatgtatcagcacaacaggaacgacccaagctcctagatcgatgctgcatcctaattagagtagtcgggtacccagtccgaggttcaggtggacgtagtggtacgtcgtagggaactaaacgtttcaacgttactaccacctatccaagtcctagtctacgacctaaccgtagtaagttattttacgaccttaacgttactattacgtactaacgtagtacttaacagtttacttccttcgtacgtttcggacccgttagggtaaccctaggttactaacgttaacagtaaacgtacgtgtacgacgtcgactacctnttccgtgttacc

SEQ ID NO: 234657 - DNA, 587 bp, Homo sapiens
  misc_feature: GYAE6OF01A1PR3.21.55.E11.1.454.CMB.1.raw
tcagtcgtcgctcgcacgaccggtgctcgatttagcactcgcacgttgggtttgggggagtcagtctcagtcaggacacagcatggacatgaggtccccgctcagctcctggggctcctgctactctggctccgaggtgccagatgtgacatccagatgacccagtctccatcatccctgtctgcatctgtcggagacagaatcaccattattgccgacaagtcacgacataaactaccttttaatgtatcagcaacaaacgaggaacggccccaaagcctcctgatcgatgctgcataccaattagagtagtcgggtcccagtccaggttcagtggacgatggatcgtaggactaaatttcactctacacatcagcagtctagactaactgaacgtattttacgaccttaaacgtttacttacttgtacctaacgtaacgtaagtttaaccagtttaactttcccttttacaaccgttttcccggacccgttacggggtaaccctaaggttcgaacgttaacgtaacctaaaacggtaaccttggtacggtactacgtacctaaccctagtttccgttagttaccc

SEQ ID NO: 234658 - DNA, 601 bp, Homo sapiens
  misc_feature: GYAE6OF01BZGPB.21.55.E11.1.454.CMB.1.raw
  modified_base (448)..(448): a, c, t, g, unknown or other
  misc_feature (448)..(448): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaactaccttttaaattggtatcagacaacaaaccagggaacgaccccaaagcctcctgatcgatgctgcatccaatttagagaggtgggtacccatccaggttcaggtggcgagtggatcgtagggtaactaaagtttcacttctacaccatcagctaacgtctagcctaaactgaacgttattttacgacttaacttacttattcgtacaanagtagttaactagttactttcctttactaccgttttccggacccgttacgggtaaccgttacgtaccgttaaacttaagtaacccgtaaaaacggtacgtttacggtacgggtaccctcggtaacccaacccgttacttacgttcgttacccg

SEQ ID NO: 234659 - DNA, 792 bp, Homo sapiens
  misc_feature: GYAE6OF01AJ7NZ.21.55.E11.1.454.CMB.1.raw
  modified_base (201)..(201): a, c, t, g, unknown or other
  misc_feature (201)..(201): n is a, c, g, or t
  modified_base (588)..(588): a, c, t, g, unknown or other
  misc_feature (588)..(588): n is a, c, g, or t
  modified_base (774)..(774): a, c, t, g, unknown or other
  misc_feature (774)..(774): n is a, c, g, or t
tcagtcgtcgctcgcacgaccggtgctcgatttagcactcgcacgttgggtttgggggtaggtcgagtctcagtcaggacacagcatggacgatgaggtccccggcctcagctcctgggcgtcctgctactctggctccgaggtgccacgatgtgcatccagatgaccagtctccatcatccctgtctgcatctgtcgganacagatacaccattatttgccggtacaacgtactacgaacgtaactaaaaccttaaccctttttaaaagttttggtaacttacgaacgtaccaaacctaaaaaccccggtaaggggaaaaccgggtccccccaaaaaagcccgttacccgtaacggtaactacgggtaacctggtacccttacggacctaaccggttaacccttaaagtttaacggtaaacgggtaacgggttaccggggggttacccccaacgttacccggtaaggggtttacctaaacgggtcggttacggacgtagggtacgttacccgggtggtaaaaccgttaaatttacccggaactttccctaagaaccctcgtaccagcttacgttcactactaaaccngtaaagttcttttgaaccccgtacttttaaacgtctttaggtacaaaacgtgttaacccgttactaaagtttacttttacccttactaagttttcccgggtacccgttagggaaacctttaccggtagtactaacgttacccgaaaaccgtgtttacggtaaggttccctaggaccttaaccccgnggtttcaccccgggttta

SEQ ID NO: 234660 - DNA, 532 bp, Homo sapiens
  misc_feature: GYAE6OF01CIRME.21.55.E11.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccgganaagtcacgacataaactacttttaaatggtatcagcacaacagggaagccccaaagctcctgatcgatgctgcatccaatttagagaggtgggtcccagtccaggttcagtggcgatggatcgtagggactaaatttcactctacaccatcagcagtctgactaactgaagtattttgacctaacttactattcgtacaacgtagtaacgtttacaagttactttacctttctaccgtttcgaccccgttggaacccgtaagtctaagtactacaaacgtactaggtcgctacgaccactactcgtgttcc

SEQ ID NO: 234661 - DNA, 610 bp, Homo sapiens
  misc_feature: GYAE6OF01DVV4K.21.55.E11.1.454.CMB.1.raw
  modified_base (604)..(604): a, c, t, g, unknown or other
  misc_feature (604)..(604): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctatttactttgaccggacaagtcaacgacaataaactaacctttttaaatgtatcagcaacaaaccgaggaacgaccccaaagctctgatcgatgctgcatacctaattacgagaggtcgggtccagtccgtaggttcaggtggacgtagtcggtatcgtaggtaaactaaatttccgaacttcctaccgaacctacgtacgtacgacgtacgttcgtacgacctaaccgtagtaagttacttttacgaccttaactttactattacgtacaagtagtaacgttactacgtttactttcctttacttaccgtttccggacccgttagggaccgtaacgttacgtaagttactaaccgaaacgtacgtcgtaggcttacgacgtaacctcgttcgtnttaccc

SEQ ID NO: 234662 - DNA, 581 bp, Homo sapiens
  misc_feature: GYAE6OF01CHCOE.21.55.E11.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccgganaagtcacgacataaactacctttttaaatggtatcagcaacaaaccagggaacgccccaaagctacctgatcgatgctgcatccaatttagagagtcgggtcccatccaggttcaggtggcgatggatcgtaggactaaattcactctacaccatcagcagtcctgactaaccgtgaacgttatttgactaaactttactattcgtacaaacgtgtaagtttaccagtttactttcccttttactaccgttttaccggccccgttaggggtaacccgtaaacgttccgaattacgttaccgaaaacccgtaacgttcggtacgggtcctacggaccctaaccctattccgttcgttaccc

SEQ ID NO: 234663 - DNA, 663 bp, Homo sapiens
  misc_feature: GYAE6OF01ALTGQ.21.55.E11.1.454.CMB.1.raw
  modified_base (224)..(224): a, c, t, g, unknown or other
  misc_feature (224)..(224): n is a, c, g, or t
  modified_base (255)..(255): a, c, t, g, unknown or other
  misc_feature (255)..(255): n is a, c, g, or t
  modified_base (655)..(655): a, c, t, g, unknown or other
  misc_feature (655)..(655): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtctccatcatccctgtctgcatctgtcggagacagaatcacctattattcgccgganaagtcacgacataaactacttttaaatgtancagacaacaaacgaggaacgccccaaagcctcctagactcgatgctgcaataccaatttaggacgtaggtccgggtacccagttccgaggttacaggtcggagtagtcgggtattacgtagggtaacttaaacgtttcaaccttcctacaacctattaccgaagtctaacgttcgtacgtaaccaaaccgttaggtaaactttacgttttacgaacctttaaaccgttttacttactttaacggtaacctaaacgtaggttaacgtttaactaacgttttaacccttttcccgtttactaccgggtttacccgtaccgggttacggaaccgttaacgtacgtaactaacgttaacgaaacggtaaccttggtacgtacgtacactaaccctatttcccgntttaaccg

SEQ ID NO: 234664 - DNA, 626 bp, Homo sapiens
  misc_feature: GYAE6OF01CJIXX.21.55.E11.1.454.CMB.1.raw
  modified_base (219)..(219): a, c, t, g, unknown or other
  misc_feature (219)..(219): n is a, c, g, or t
  modified_base (278)..(278): a, c, t, g, unknown or other
  misc_feature (278)..(278): n is a, c, g, or t
tcagtcgtcgctcgcacgaccggtgctcgatttagcactcgcacgttgggtttgggggagtcagtctcagtcaggacacagcatggacatgaggtccccgctcagctcctggggctcctgctactctggctccgaggtgccagatgtgacatccagatgacccagtctccatcatccctgtctgcatctgtcggagacagaatcactattattgccganagtcacgacataaactacttttaatggtatcagcaacaacgaggaacgcccaagctccngatcatgctgacatacctaatttagagtacggtcgggtccagtccgagttcagtggcagtgatcgaggtaactaatttcactctacacctactcacgtactagtcccgtagacctaaaccttgtaacgttacttttacgaaccttaactttacttaagttacgtacctaaacgtacgttaagttaccgtaagttttcctttacccgttttactacccggttttacccggacccgttacgggggtacccttaaagtccgttaaagttaacctaaaccggtaaaaccggtacgtttcggtaccggtaccgttacgtaaccctacccgttacttccgttacgtttaccccg

SEQ ID NO: 234665 - DNA, 710 bp, Homo sapiens
  misc_feature: GYAE6OF01B23KO.21.55.E11.1.454.CMB.1.raw
  modified_base (197)..(197): a, c, t, g, unknown or other
  misc_feature (197)..(197): n is a, c, g, or t
  modified_base (690)..(690): a, c, t, g, unknown or other
  misc_feature (690)..(690): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcacctatttattgccggaacaagtcacgacaataaactacttttaaatgtatcagacaacaaacgaggaacgaccccaaagctaccgtgatcgatcgctagcactacctaagtttagacggtaggttcgggtacccagttccgtaaggttccaaggtcggacgtagtaggaacttcggtagggaaacttaaattttccgaactttacctaccaaccctataccgtaacgtctaacggttcctaacgacctaaaccgtaggtaaacgtttattttaacgaacctttaaacttttacttaacgtttacgaacctaaacgtacggttaacgtttaacctaaggttttacctttacccttttaccgtacccggtttttacccgggacccccggtttaaggggtaaacccttaagggtaaccgttaaacgttaccgttaaaccgtaaaccggttaacgttcggtacggtacccttacgaccttaacccgtnttccggttccgtttaacccg

SEQ ID NO: 234666 - DNA, 592 bp, Homo sapiens
  misc_feature: GYAE6OF01A3HMK.21.55.E11.1.454.CMB.1.raw
  modified_base (221)..(221): a, c, t, g, unknown or other
  misc_feature (221)..(221): n is a, c, g, or t
  modified_base (249)..(249): a, c, t, g, unknown or other
  misc_feature (249)..(249): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgccganagtcacgacataactacttttaatgtancagcacaacaggaacgccccaaagctctgactcgatgctgcataccaatttagagtaggtcgggtacccagtccgtaggttcaggttcggcgtatggatcgtagggactaaattcactctcaccatcagcagtctagcctaacgtagaattatttacgaccttaaacgttactaattcgtaacaacgtagtaacgtttaacacgtttactttacccttttacgaccgttttcccgggacccgttaacggggtacccgtaaagttaccggtaacttaacttaacccggaaaaccggtacgttcggtcggtactacggacctaacctacttccgttcgttacccg

SEQ ID NO: 234667 - DNA, 679 bp, Homo sapiens
  misc_feature: GYAE6OF01BV54J.21.55.E11.1.454.CMB.1.raw
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactcgtggctccgaggtgccagatgtgacatccagatcgacccagtctccatcactccctgtctgcatctgtcgganacagaactcacctatttattcgaccggaanaagtccacgtaactaacttaaaaccttaacctttttaaagtgtaactcaacgacaaacgaaaccgagggaaccgaccccaaagcctacctagaacttcgatcgctacgactactacctaaagttggacgtaggtaccgggtcctagtccgaggttacaggtgacgtagtgacgtcggtaggtaacttaaatttccacctactacctacgtataccgaagtctagtcctagacctaacgttagtaacgtttatttaccgaacttttaaccgttattagttaccctaataacgtatacgtttaacttacgtttaccttttacccgtttagttaacccggtttacccggacccggtttaacgggaacccgtttaaacgtaccgtaaactaaccgttaaacggaaacttccgttaggcggtaccttcggaaccctattacttcgttcgtaacc

SEQ ID NO: 234668 - DNA, 612 bp, Homo sapiens
  misc_feature: GYAE6OF01BC87I.21.55.E11.1.454.CMB.1.raw
  modified_base (596)..(596): a, c, t, g, unknown or other
  misc_feature (596)..(596): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgccgacagtcacgacataaactacttttaatgtatcagcacaacaggacgaccccaagctctgatcgatgctgcactcctaatttaggagtacggtcgggtaccctagtccgtaggttacaggtggacgtagtggactcgtagggtaactaaagtttcacttctacctacctatccagtctagtcctagacctaaccgtagtaacgttatttcgaccttaactttacttagttacgtacaaacgtagttacgttaacgtacgtttactttacccttttacgttaccgtttcccggtacccgttacgggtacccgttaacgtacgttaacgttacgtaaccgaaacggtacgttaggtccggtaccgtacgaccctaacctntttaccgttgttaccc

SEQ ID NO: 234669 - DNA, 517 bp, Homo sapiens
  misc_feature: GYAE6OF01BS7KH.21.55.E11.1.454.CMB.1.raw
  modified_base (221)..(221): a, c, t, g, unknown or other
  misc_feature (221)..(221): n is a, c, g, or t
  modified_base (255)..(255): a, c, t, g, unknown or other
  misc_feature (255)..(255): n is a, c, g, or t
  modified_base (509)..(509): a, c, t, g, unknown or other
  misc_feature (509)..(509): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgagacagaatcacctattattcgccganagtcacgacaataaactacttttaaatgtatcancaacaaaccgaggaacgccccaaagctacctgatcgatgctgcatactaatttagagtacggtcgggtacccagtccgaggttcaggtgcgatggatcgtaggactaattcacttcacacatcagcagtctacgactaactagaattactttcgacttaacttatattctacaatagtattactagttacttcttcacgtttcgccgttaggacctagtacgtagtactacaaacggtctgtgtactcaccatntcgtgtcg

SEQ ID NO: 234670 - DNA, 726 bp, Homo sapiens
  misc_feature: GYAE6OF01DG7X9.21.55.E11.1.454.CMB.1.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
  modified_base (521)..(521): a, c, t, g, unknown or other
  misc_feature (521)..(521): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtcctccatcactccctgtctgcatctggtcgganacagaatccactatttattcgaccgganaagtccacgactaattaaccttactttttaagtggtatacgagaccaaccaaaccgagggaaccgaccccaaagtcctaccgtagacgttccggaattcgaccgttagacctaacgttacctaaagtttaggaacggtacggtccggggtaccccagttacccgtaaggttccgtaagggtcggacgtaagtcgggtaacttacgggtaacgggtaaacttaagtttcccaccgttacctaccgacctagtacacgtactacgttctacgaacctaacgtaggtaaactttnttaaccgaaccttaagtttaactagttacgtaaccaacgttacgttaacgttacgttacgtttaccttaccgtttaccgttaccgtttccgggaccccgttaagggtaacccgtagttaccgttaaacgttaccgtaaaccggtaaaccgtgggttacgtaggtacccgttacgaccttaacccttacgttcgttacgttacccc

SEQ ID NO: 234671 - DNA, 538 bp, Homo sapiens
  misc_feature: GYAE6OF01A75ES.21.55.E11.1.454.CMB.1.raw
  modified_base (221)..(221): a, c, t, g, unknown or other
  misc_feature (221)..(221): n is a, c, g, or t
  modified_base (529)..(529): a, c, t, g, unknown or other
  misc_feature (529)..(529): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccgganaagtcacgacaataaactacttttaaatgtatcagcacaaacaggaacgccccaaagctcctgatcgatgctgcatccaatttagagtaggtcgggtcccagtccgaggttcaggtggcgatggatcgtagggaactaaatttcactctcaccatcagcagtctgactaactgaattatttgactaacgtttatatttcgtacaacgtagtaagttactagttactttcctttactaccgtttccggaccgttagggaccgtaagtcgtaagttactacaaacggtacttcggtgtctacgccacctntcgtgttcc

SEQ ID NO: 234672 - DNA, 663 bp, Homo sapiens
  misc_feature: GYAE6OF01EBFNH.21.55.E11.1.454.CMB.1.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
tcagtcgtcgctcgcacgaccggtgctcgatttagcactcgcacgttgggtttgggggagtcagtctcagtcaggacacagcatggacatgaggtcccgctcagctcctggggctcctgctactctggctccgaggtgccagatgtgacatccagatgacccagtcctccatcatccctgtctgcatctgtcgganacagaactcactattattgccganagtcacgacataactacttttaatgtatcagacaacaaaccgagggaacgaccccaaagtcctactagacgtacgatgctgacctactacctaagtttagaggtacggtcgggtacccagttacccgaggttccgaggtcggacgtagtaggtactcgggtaggtaaccttaaacgtttccaccttaccgtactacctataccgtaacgtccgtagttacctacgtaacctaacgttaggtaactttagttttacgacctttaactttacttagtttaactaacaacgtagttaactttacgtaacgtttacctttacctttccgttaccggtttacccgtacccggtacgggtaaccgtaacgttacgtaaagttaaccgtaacgtaaaccggttcgttacggtaccggacgttacaccctaccggtctttcgtcgttaccc

SEQ ID NO: 234673 - DNA, 615 bp, Homo sapiens
  misc_feature: GYAE6OF01CS4QW.21.55.E11.1.454.CMB.1.raw
  modified_base (197)..(197): a, c, t, g, unknown or other
  misc_feature (197)..(197): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagatcacctattattgccgacagtcacgacaataaactacctttttaaatggtatcagcaacaaaccagggaacgccccaaaagctaccgtgaactcgatgctagactactacctaatttaagagaggtcgggtccctatccgaggttcgaggtcggacgtagtggattcgtagggaacttaaacgtttccacgtcctaccgaacctataccagctacggtctacgactaactgaagttatttcgataacctttagtactttacgactaaacgagttaacgttaactacgttacttttccctttacgttacccgttttccggaacccgttagggtaacccgtaagttaccgtaagtaacctacgaaaacggtaacgttcggtacggcttacgaccctacctattccgtgtttaccc

SEQ ID NO: 234674 - DNA, 563 bp, Homo sapiens
  misc_feature: GYAE6OF01APIXK.21.55.E11.1.454.CMB.1.raw
  modified_base (220)..(220): a, c, t, g, unknown or other
  misc_feature (220)..(220): n is a, c, g, or t
  modified_base (401)..(401): a, c, t, g, unknown or other
  misc_feature (401)..(401): n is a, c, g, or t
  modified_base (548)..(548): a, c, t, g, unknown or other
  misc_feature (548)..(548): n is a, c, g, or t
tcagtcgtcgctcgcacgaccggtgctcgatttagcactcgcacgttgggtttgggggagtcagtctcagtcaggacacagcatggacatgaggtccccgctcagctcctggggctcctgctactctggctccgaggtgccagatgtgacatccagatgacccagtctccatcatccctgtctgcatctgtcggagacagaatcaccattattgccgganaagtcacgacataaacaccttttaaatggtatcagcaacaaaccagggaacggccccaaagcctcctgatcgatgctgcatccaatttagagagtgggtacccatccaggttcagtggcgagtggatcgtagggactaaatttcactctcaccatcagcagtctacgcaaaccgtgaagtnttttgacctaactttactattgtacaacgtagtaattactagttactttccctttacaccgtttccggacccgttgggaacccgtaaggttccgtaagttactaccgtaaaacggtaccttgggtacgcctacggtaccaacccttnttccgttagttaccc

SEQ ID NO: 234675 - DNA, 690 bp, Homo sapiens
  misc_feature: GYAE6OF01DPU35.21.55.E11.1.454.CMB.1.raw
  modified_base (197)..(197): a, c, t, g, unknown or other
  misc_feature (197)..(197): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcacctatttattcgaccggacaagtcacgacaataaacttaccttttaaatggtatcagacaacaaacgagggaacgacccaagctacctagatcgatgctgctactacctaagtttaggagtacggtcgggtacccagtccgtaggttcaaggtcggacgtagtggtatacgagggtaactaaagtttccacgttacctcgaacctatacagtacgtacgttctacgacctaaaccgtgtaagtttacttttacgaccttaaacgtttacttaagttacgtaactaacgtaacgtaacgtttaaccttaagtttaccttttacccgttttacgtaacccgttttccgggaaccccggtttacgggaacccgttaaggttaccgtaaacgttaaaccgttaaacccggtaaaacggttccggtttacgggtacggaccccgttaacggtacccctaaccgtttacgttcccgtttaggtttacccc

SEQ ID NO: 234676 - DNA, 809 bp, Homo sapiens
  misc_feature: GYAE6OF01CZAJB.21.55.E11.1.454.CMB.1.raw
tcagtcgtcgctcgcacgaccggtgctcgatttagcactcgcacgttgggtttgggggagtcagtctcagtcaggacacagcatggacatgagggtcccgctcagctcctggggctcctgctactctggctccgaggtgccagatgtgacatccagatcgacccagtctccatcatccctgtctgcatctgtcggagacagaactcacctattagttcggaccggtaacaacgtacaaccgtaactaaacttaaaaccttaccgttttttaaaagttcggttaatacctaagaccaaaccaaaccggaacggggaaacggaccccaaagtccttaccgtgactcgatgctacgactacttactaagttacggacggtacgggtccgggtaccctagttaccgtacggttacagggtcggtacgtaaggtgggtacttacggtacgggaaacttaacgtttaccacttaccgtaccaacccgtactacgaacgtactacggtaccgttacgaaccgttaaacccgttaggttaacggtttaactttttaccggaaacccttttaaacgttttaaccgtttaacgttttaaccggtaaccttaaaccgttaacgggtttaaccgttttaaaccgttaaccgttttacctttttaccccgttttacgtttaaccccgggtttcccgggtaacccggttaacgggggtaaccgtaaaccgggtttacgtaaacgttaacgtaacccgaaaaccggttacgttcgggtacggttacctacggtaccctaccttacgttccgtttacgttacccg

SEQ ID NO: 234677 - DNA, 568 bp, Homo sapiens
  misc_feature: GYAE6OF01API6C.21.55.E11.1.454.CMB.1.raw
  modified_base (549)..(549): a, c, t, g, unknown or other
  misc_feature (549)..(549): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattcgccggacaagtcacgacataaactacctttttaaatggtatcagcacaacaggagccccaaagctctgatcgatgctgcattaccaatttagagagtcgggtacccagtccaggttcagtggacgagtgagtcgtagggaactaagtttaccactctacacctatcagcagtctgaccaactgagtatttgactaacttatattcgactaacgtagtaagtttacagttactttacctttactaccgtttccggacccgttagggtaacccgtagtaccggtaattaacgttaccgaaacggtaccgttggtacgtacgttagacccttaacncgttccgttcggtttaccc

SEQ ID NO: 234678 - DNA, 600 bp, Homo sapiens
  misc_feature: GYAE6OF01BRIOB.21.55.E11.1.454.CMB.1.raw
  modified_base (289)..(289): a, c, t, g, unknown or other
  misc_feature (289)..(289): n is a, c, g, or t
  modified_base (586)..(586): a, c, t, g, unknown or other
  misc_feature (586)..(586): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtctccatcatccctgtctgcatctgtcgagacagaatcactattattcgaccgacagtcacgacaataaactacttttaatggtatcagacaacaaaccgagggaacgacccaaagctaccngactcgatgctcacactacgtaattagagtaggtcggtccatccgagttcaggtcggcagtagactcgtaggtactaattccgactcgtacacctagtacagtactacgtactacgacctaaccgtagtaaacgttgtttacgaaccttaactttacttcttaacggtacctaaaggtcttaacgtttaactcgtttaaccttttccgttacgttaccgttccggacccgtaggtaacccgtagtacgttactaacgtacctaaaacggtcgtagtacggcttaccgactaaccgtntacgttcgttaccg

SEQ ID NO: 234679 - DNA, 719 bp, Homo sapiens
  misc_feature: GYAE6OF01DKCFX.21.55.E11.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccggaggtgccagatgtgacatccagatgacccagtctccatcactccctgtctgcatctgtcggagacagaatcactattattgccganagtcacacaataaactacttttaaatggtatcagcaacaaacaggaacgacccaaagctacctgatcgaatgacctgctatacctaaagtttaagaggtaacggtcggggtacccaagttccgtaacggttctaggtcggtacgtaagtagggtactacggtaggggtaaacttaaaacgtttcaccgtttactaccgtaacctaacttaccgaagtccgaaagtttccgtacggtaacctaaaccgttggtaaacgttactttttaacgaaccttaaacttttacttaacgtttacgtaacgtaaaacgtaacgttaaggtttaaacccgtaagtttaccgttttaccctttacgttacccggttttacccgggaccccgtttaacggggtaaacccgaaaggtttacccaaagttaaccgttaaccctaaaaggttaaccgtaacgttcgggactttaacggacctaacccggtactttcgttacgtttaacccg

SEQ ID NO: 234680 - DNA, 633 bp, Homo sapiens
  misc_feature: GYAE6OF01ER30O.21.55.E11.1.454.CMB.1.raw
  modified_base (190)..(190): a, c, t, g, unknown or other
  misc_feature (190)..(190): n is a, c, g, or t
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (231)..(231): a, c, t, g, unknown or other
  misc_feature (231)..(231): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatcngtcgganacagatcacctattattgccgganaagtcacganaataaactaccttttaaatgtatcagacaacaaacgaggaacgccccaaagctacctgatcgatcgctagcataccaagtttagagtaggtcgggtacccagtccgtaggttcaggtggcgtagtggatcgtacggaactaaagttcacttctaccacgatcgagtcagtctagaccaaccttagaacgtttatttacaacgtaaactttaactagtttacgaacctaaacgtagtaaccgtttaagtagtttaacctttccctttacgttaaccgtttacccggtaccccggttaaggggtaacccgtaagttaaccgacgttaaacgttaacccgaaacgttaacgtcggttaccgggtaccctacgacccgtaaccccgtattcccgttcggtttaccc

SEQ ID NO: 234681 - DNA, 640 bp, Homo sapiens
  misc_feature: GYAE6OF01BG8ZB.21.55.E11.1.454.CMB.1.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctcctaggtgccagatgtgacatccagatgacccagtctccatcatccctgtctgcatctgtcgganacagaactcacctattattcgccgganagtcacgacataactacttttaatgtatcagacaacaaacgaggaacgcccaaagctcctagactcgagtgctgcatacctaattagagaggtcgggtacccagtccgtaggttcgaggttcggacgtagtgggtactacggtagggaaaccttaaactttcgaaccttccgtaccacctagtaccagcctagtctacggaacctaacgtagtaagttactttcgaaccttaactttattacgttctaactaacgtaacgtaagtttacctacgttttactttacccgtttacgtacccggttttaccggacccggttacgggtaaccgtacggttacgtaacgttaacgtaaccgtaaacggtaccgttcggtacgtcgttacgaccctaaccttacgttcccgttagtttaccc

SEQ ID NO: 234682 - DNA, 612 bp, Homo sapiens
  misc_feature: GYAE6OF01EKUF4.21.55.E11.1.454.CMB.1.raw
  modified_base (445)..(445): a, c, t, g, unknown or other
  misc_feature (445)..(445): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaactaccttttaaatgtatcagcaacaaacaggaacgccccaaagctcctgactcgatgctgactatacctaattagagtaggtcgggtcccagtaccgaggttacagtggcgtagtggactcgtagggaactaaactttcaactctacaacctatcagcagtcctagacctaactgtaatagttttgacctaactttactattacgtanaactagtacgtttacagtttactttaccctttacgtacgtttacccgggtacccgtcggggtaaacccgtaggttaccggtaattaacgttaacccgaaaacggttaaaccggttagggtacggtaccgttacggacctaaccccgtagtttcccgtcgtttaaccc

SEQ ID NO: 234683 - DNA, 909 bp, Homo sapiens
  misc_feature: GYAE6OF01AQWZC.21.55.E11.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagcactcgcacgttgggtttgggggagtcagtctcagtcaggacacagcatggacatgaggtcccgctcagctcctgggctcctgctactctggctccgaggtgccagatgtgacatccagatcgacccagtctccatcactccctgtctgactactcgtgtacgganacagaactcaacctagtttacgttcggaccggtaactaacgtaccaacgtaactaaacgttaaaaccttaacctttttaaagttggtaactacgaacgtaaccgaaaccgaaaaccggtaacggggaacccggtacccccgtaaaaacggtcccgttaacccgtacggtaacgttaccggaacgttcggaccgttacggtaccttaaccttaacccgtttaaagtttaacggggaacggttaccggggttaccggggtacccctacggttacccggttaacgggttaccgtacgggttaccggtaacggttacggttacgggtaacgttaccgggttaaacgggtaaacctttaaaacgtttcccgtaaccttacccgttaaccccgtaaccgttacgttaaccggtaacggtacccgttaacggttacccgtaccgtaaacccgttaaccggttaacgtaacgttttaaccgtttttacgaaacccgttttaaacgtttaaccgtttaacgttacggtaaaccgttaaacggtaacgtttaaccggtttaccgttaaccgttttacccgttttacccgtttaaccgtttcccggttacccggtacccgggttacgggtaacccgttaagtaccgtacttaaacgtaacgtaaccggtcgttcggtacggtctaaccgtacctaaccgttagttcgtaccgtttaccg

SEQ ID NO: 234684 - DNA, 590 bp, Homo sapiens
  misc_feature: GYAE6OF01BYNAO.21.55.E11.1.454.CMB.1.raw
  modified_base (197)..(197): a, c, t, g, unknown or other
  misc_feature (197)..(197): n is a, c, g, or t
  modified_base (201)..(201): a, c, t, g, unknown or other
  misc_feature (201)..(201): n is a, c, g, or t
  modified_base (256)..(256): a, c, t, g, unknown or other
  misc_feature (256)..(256): n is a, c, g, or t
  modified_base (412)..(412): a, c, t, g, unknown or other
  misc_feature (412)..(412): n is a, c, g, or t
tcagtcgtcgctcgcacgaccggtgctcgatttagcactcgcacgttgggtttgggggagtcagtctcagtcaggacacagcatggacatgagggtccccgctcagctcctgggctcctgctactctggctccgaggtgccagatgtgacatccagatcgacccagtctccatcatccctgtctgcatctgtcgganacanaatcaccattattcgccggacagtcacgacataactaccttttaattggtatcanacacaaaccgaggacgaccccaaagctcctgatcgatcgctgctatacctaagttagagtaggtcgggtacccagtccgtaggttcaggtcggacgtagtgtatcgtaggaataacttcactctacacatacagtctacgtctacgacctaacgtnaacgttactttacgactaactttactatttacgactaactagtaacttacgtagttacctttccgtttacttaccgttaccggccgttacgggtaccgtaacgttaccggaattacgtaaccgtaaacgtaacgttggtacgttaccgtacgtacctaacgtctcgttcggtttaccc

SEQ ID NO: 234685 - DNA, 666 bp, Homo sapiens
  misc_feature: GYAE6OF01DQKE9.21.55.E11.1.454.CMB.1.raw
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
  modified_base (267)..(267): a, c, t, g, unknown or other
  misc_feature (267)..(267): n is a, c, g, or t
  modified_base (640)..(640): a, c, t, g, unknown or other
  misc_feature (640)..(640): n is a, c, g, or t
tcagtcgtcgctcgcacgaccggtgctcgatttagcactcgcacgttggggtttggggggagtcagtctcagtcaggacacagcatggacatgagggtccccgctcagctcctggggcctcctgctactctggctccggaggtgccagatgtgacatccagatcgacccagtcctccatccatccctgtctgctatctggcggagacagaatccacctattattcgaccgganagtcacganaataaactacttttaaatgtatcanacaacaaacgagggaacgacccaagcctcctagactcgatcgctcgactattacctaaagtttaggaggtacggtcgggtacctacgtccgtaggttcgaggtcggacgtaggtggtacgttacggtacgggtaaacttaaactttccgtaacccttacgtacccaacctactaccgtaacgtctaacgttccctaaggaacccttaaaccgtaggttaacgtttacgtttacaaccttaacttaccgttactacgtacgaacgtacggttccgtaccggtttcgtcccttacgttaccgtaccggttaccggaacgtaaccgggaacgtaaaggtaaggaaactaacgaaacggtcgtagggtccacgtacnccgtaaactctacttcgttctacccg

SEQ ID NO: 234686 - DNA, 655 bp, Homo sapiens
  misc_feature: GYAE6OF01BQZMM.21.55.E11.1.454.CMB.1.raw
  modified_base (186)..(186): a, c, t, g, unknown or other
  misc_feature (186)..(186): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcactccctgtctncatctgtcggagacagaactcacctattattcgaccgacaagtcacgacataaactacttttaatgtatcagcaacaaacgaggaacgcccaaagctactagactcgatcgctgctatacctaatttacgagtacggtcgggtcccagtcgaggttcaggtcggacgtagtggatacgtaggtaactaatttccactctacctacactacgacgactagtaccgtgaacctaaccgtagtaacgttacttttacgaccttaaacctttacgtactttacgaacctaaacgtacggttaacgtttaacgtacggtttaccttttacccgttttaccgtacccggttttccggtaaccccggttagggtaacccgttaaccgttaccgttaaacgtaaccgttaaccgaaaaccgttaccgttaggttaccgtacgtacgtaccctaaccgtacttccgttcgttaacccc

SEQ ID NO: 234687 - DNA, 663 bp, Homo sapiens
  misc_feature: GYAE6OF01AWBUD.21.55.E11.1.454.CMB.1.raw
  modified_base (196)..(196): a, c, t, g, unknown or other
  misc_feature (196)..(196): n is a, c, g, or t
  modified_base (288)..(288): a, c, t, g, unknown or other
  misc_feature (288)..(288): n is a, c, g, or t
tcagtcgtcgctcgcacgaccggtgctcgatttagcactcgcacgttgggtttgggggtaggtcagtctcagtcaggacacagcatggacatgaggtcccgctcagctcctgggctcctgctactctggctcgaggtgccagatgtgacatccagatcgacccagtctccatcatccctgtctgcatctgtcgganacagaatcacctattattgccgactagtcacgacataaactacttttaatggtatcagcacaaacgaggacgacccaagctctgatcgatgntgctatccaattagagtcggtggtcccatacctaggttacaggtggacgagtggatcgtagggaactaattcgactacgtacacctagtccagtactacgtactacgaacctaaccgtaggtaaccgtttagtttaccgaaccttaaacgtttactaacgttttgaaccctaaacgtaacggttaacgtttacgtaacgttttaccttttaccccgtttacgttaacccggtttacccgggaaccccgtttaggggtaaacccgttaaaccgtttacgggtaaacctttacgttaaaccccgtaaaaggttaaacccgtcgggttagttaaacccgtcgtaaaccttaaccgaccgtttcgttcggtttaacccc

SEQ ID NO: 234688 - DNA, 592 bp, Homo sapiens
  misc_feature: GYAE6OF01B7CT8.21.55.E11.1.454.CMB.1.raw
  modified_base (343)..(343): a, c, t, g, unknown or other
  misc_feature (343)..(343): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgagacagaatcacctattatttgcggacagtcacgacataaactaccttttaaatggtatcagcaacaaaccagggaacgccccaaagctcctgatcgatgctgcatccaatttagagtgtcgggtccatcgtaggttcagtggactagnggtatcgtaggactaaatttcactcacaccatcagctagtctacgacaacctagaatatttcgacttaaacttacttattacgtaccaaacgtagtaacgtttaacgtaacgtttacttccgttttacaccgttttcccggaccccggttagggtaacccgtaagttacggtaacttaaccgttaccgaaaaaccggtaccgttgggtaccggttactacgtaccctaacctcgttcccttggttaccc

SEQ ID NO: 234689 - DNA, 637 bp, Homo sapiens
  misc_feature: GYAE6OF01DQSO0.21.55.E11.1.454.CMB.1.raw
  modified_base (224)..(224): a, c, t, g, unknown or other
  misc_feature (224)..(224): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtcctccatcatccctgtctgcatctgtcggagacagaatcacctatttattgccgganaagtcacgacaataaactactttttaatgtatcagacaacaaacgaggacgacccaaagctcctgactcgatgctgctatacctaatttagagtaggtcgggtaccagtccgaggttcaggtggcgagtggagtcgtaggtaactaaattcactctacaccatcgtacgctagtactacgacctaacgttagaagtttacttttacgaacctttaaacgtttaacttaacgtttacgtaacctaaacgtaaggttaacgtttaacctaagttttaaccttttcccttttacgttacccgtttaccggaccccggttacgggtaacccgtaagttaccgtaacttaaccgtaaccgtaaaacggttcgttcggtacggtccttacgaccctaaccttacgttcgttccgttacc

SEQ ID NO: 234690 - DNA, 680 bp, Homo sapiens
  misc_feature: GYAE6OF01AHMTE.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtctccatcactccctgtctgcatcgtgtcggagacagatcacctattattcgaccgacacgtcaacgactaacttaaaccttacctttttaagtgtatacagaccaacgaaaccgagggaaccgaccccaaagtcctaccgtagactcgactcgctacgactactactaagttacggagtacggtccggtacctacgtaccgtaggtcgaggtcggacgtagtggtacgtcgtaacgggtaactaacgtttcctacctactaccgactatcacgtacgtacgtcgtacgtacctaacgtagtacgttagtttacgaccttaactttacgtacttacgaactaacgtagtaacgttacttacgtttacctttaccgtttaccgttaccggttccgtaacccgggttacggaaccgttaacgtaccgtaacgttaaccgtaaacgtaaaccggttcgttaccggtacgtaccgttaccgaacccttaaccgtacgtttccgttaccgtttacccg

SEQ ID NO: 234691 - DNA, 649 bp, Homo sapiens
  misc_feature: GYAE6OF01BIZ0V.21.55.E11.1.454.CMB.1.raw
  modified_base (228)..(228): a, c, t, g, unknown or other
  misc_feature (228)..(228): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtctccatcactccctgtctgcatctgtacgaagacagaactccaactattattcgaccganagtcacgactataaactacttttaaagtgtactcatacaacaaaccgaggaacgtaccccaaagcctacctgactcgatcgactcgactactactaaagtttaggacggtacggttccgggtaccctacgtaccgtaggttacgaggtcggacgtgtaggtactcggtaacgggaacttaaacgttccacttacctaccgactatacccagtacctagttactacgtactaaccgtaggtaactttagtttacgaacctttaacttacttagttacgaacgtaacgtagttaacgttaacgttacgtttactttcccgtttacgtaccgttaccgggtaccgtacgggtaccctagttaccgtactaaccgtaacctaacggtacgtcggtgacctcgtacctactagttccgtgttaccc

SEQ ID NO: 234692 - DNA, 729 bp, Homo sapiens
  misc_feature: GYAE6OF01CVW9Y.21.55.E11.1.454.CMB.1.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
  modified_base (300)..(300): a, c, t, g, unknown or other
  misc_feature (300)..(300): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtctccatcactccctgtcagcatcgtgtcgganacagaactcacctattattcggccgaanaagtcacgacaataaacttaaccttttaaatggtatcagacaacaacgagggaacgaccccaagctctaganacgatcgctagctacgtacctaaagtttagagtagggtcgggtacccaagttcccgtaagggttcagggtcggtacgtagttcgggaagttacgagggtaaactaaactttccaacgttacctaccaacctaagtaccgtacgtaccgtacgttactacgacgtaaacccgtagtaacgtttacgttttacgtaaccttaacgtttaacttagttacgtaaccgaacgtaagttaacgtttaaccttaacgtttacttttaccctttaccgttaacccgggtttccggtaaccccggttaacgggtaaaccccggttaaggtaccgttaacgttaaaccgttaaccggaaaacccgtttaaacggttccggtttaaccggggaccttaccggaacccttactaaaccgttttcccgttagttttacccc

SEQ ID NO: 234693 - DNA, 579 bp, Homo sapiens
  misc_feature: GYAE6OF01C42L5.21.55.E11.1.454.CMB.1.raw
tcagtcgtcgctcgcacgaccggtgctcgatttagcactcgcacgttgggtttgggggagtcagtctcagtcaggacacagcatggacatgagggtcccgctcagctcctggggctcctgctactctggctccgaggtgccagatgtgacatccagatgacccagtctcatcatccctgtctgcatctgtcgagacagatcacattattcgccgacagtcagacataaactacttttaatggtatcagcaacaaacaggaacgaccccaaagctacctgatcgatcgactgactatacctaagtttagaggtaggttcggggtacctactccgtaggttcaggtcgggcgattcggagttacgagggtaactaagttctactctcactatacgagctagtctgacctaactgaagttatttacgactaacttacgtattatacgaactagtacgttactagttactttacctttcttaccgtttcggcccgtttacgggaccgtaacgttcgtaaacgtactaacgtaaaccggtaacgttcggtacggtacctacggtactacctactcttgttaccc

SEQ ID NO: 234694 - DNA, 960 bp, Homo sapiens
  misc_feature: GYAE6OF01DWOEJ.21.55.E11.1.454.CMB.1.raw
  modified_base (935)..(935): a, c, t, g, unknown or other
  misc_feature (935)..(935): n is a, c, g, or t
tcagtcgtcgctcgcacgaccggtgctcgatttagcactcgcacgttgggtttgggggagtcagtctcagtcaggacacagcatggacatggacggtccccgctcagctccgtggggctcctgctactcgtggctccgaggtgccagatgtagacatccagactacgacccagtcctccatccacttcccgtgtctgctacttcgtggacggagaacaagtaactcctaaccttatttacgttccggaccggtaaactaacgtaccgaaaccgtaactaaaactttaaaacctttaaaccgtttttaaagtcggtactacaacgtaaccaaaccgaaaaccgggaacgggaaacccgaccccgtaaagtccctaccggttagtaacgtcgtaacgtcgtaccgtactaaccgtaaccgtttaaccgttaaaaggttaaccgggtaacgggggttaccgggtttacccgggtaaccctaaccgggttaacccggttacgggttaacgggtacggggtacgggtaacggtaggttaacgggttaacgttacggggtaaacgttaaaaccgttttaaccgtttaccctaaccgttaccctaacccgtaaccttacgtaaccggtaacgtccgttaacgttacccgtaaacgtaacccggttaagtaacgttaagttttactttacgttaaccgtttaactttacgtttaactttaaccgtaacgttaaacggttagtttaaacccggttaacttttacccggttttaacccttttttcccggttaaaccggttttaccccccggttacggggtaaccccggttaaccgggttaaacccgttaaaggttaaacccggttaaacttaaacccgtaaaccggtttaaaccggcgggtttacggtaccggttactacccgggttaaacccttaaccggtttntttaaccccgttggttttaaccccc

SEQ ID NO: 234695 - DNA, 531 bp, Homo sapiens
  misc_feature: GYAE6OF01AORA3.21.55.E11.1.454.CMB.1.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (406)..(406): a, c, t, g, unknown or other
  misc_feature (406)..(406): n is a, c, g, or t
  modified_base (505)..(505): a, c, t, g, unknown or other
  misc_feature (505)..(505): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcacctattattcgccgganaagtcacgacataaactacttttaaatgtatcagcacaaacgaggaacgaccccaaagctctgatcgatgctgcatacctaatttagagtacggtcgggtacccagtccgtaggttcaggtggcgagtggatcgtaggactaaagttcactctacacatacagcagtctgacaactgaagttntttacgactaacttactagttacacaatagtacttaactagtttacttccttactaccgttccggaccgtaggaccgtagtacgatactacgaaacgtntagtagctacgacactctcgtgtacc

SEQ ID NO: 234696 - DNA, 799 bp, Homo sapiens
  misc_feature: GYAE6OF01DAUAI.21.55.E11.1.454.CMB.1.raw
tcagtcgtcgctcgcacgaccggtgctcgatttagcactcgcacgttgggtttgggggagtcagtctcagtcaggacacagcatggacatgagggtcccgctcagctcctggggctcctgctactctggctccggaggtgccagatgtgacatccagatcgacccagtctcatcactccctgtctcgcatctggtacggagacagaactacacctatttacgttcggaccgacaacgtacacgaactaattaaaacctttaacctttttaaaagttcggtaacttacgaacgaaccaaaccgaaaaccggaacggggaaaccggaccccaaaacgtccgttacccgtagtaacgtaccgtagttacggacctacgtactaacttaacccgttaaagtttaaggacgggttaacggggttaccggggtaccctaaggttcccgtaaggttacgaagggttcggacgtaagtgggtacgtacggttaagggtaaaccctttaaacgtttccctaaccttccgtaaccctaacctaacgtaccgtaacgtacgtaacggttacccgtacgtaacccgttaaaccgtaggttaaacgttttacttttaacggaacctttaaacctttaacgtttaagtttacctaacgtaaaggttaacgttaagtttaacgtttacgtttaacctttaccctttacgttaccgtttaccggtccgtaaccgggtaaccgtacgtactaacgtaacgtaacgtaaacggtcgttacggtagtacgtactacgacttactcgttccgttaaccc

SEQ ID NO: 234697 - DNA, 769 bp, Homo sapiens
  misc_feature: GYAE6OF01BC7TK.21.55.E11.1.454.CMB.1.raw
tcagtcgtcgctcgcacgaccggtgctcgatttagcactcgcacgttgggtttgggggagtcagtctcagtcaggacacagcatggacatgaggtccccgctcagctcctggggctcctgctactctggctccgaggtgccagatgtgacatccagatgacccagtctccatcatccctgtctgctatctgtcggaagacagaactcaacctatttacgttacggaccggactaagtccaaccgaactaacgtaaaacttaaccgtttttaaaagtggttaactacaacggtaccaaccgtaaaccgaaggggaaccgaacccctaaaggcctaccgtaggacttacggtatacggtctcggacctacttaccgtaaattttaaggagtaaccgggttgggtacccctagttacccgaggtttccgaggttaggacgtagttggacttccggaagggtaaacttaacgttcgaacttaccgtacaacccattacgaaccgtacgtacgttacgtaccgtacgtaaccgttagaacgtttactttacgaaaccgttaacgttttaacctagtttacggtaaactacgtaaggttaaacttacgttaaacggttttcctttaacgtttcccgtttaccggtttacccggtaaccgttaccgggtaaacccggttaaagtaccggtttaataaccggttaaacgtaaacccggtcgttagggttaccgtacgttaccggacctaaccttaccggtttaccgttggttacccg

SEQ ID NO: 234698 - DNA, 780 bp, Homo sapiens
  misc_feature: GYAE6OF01CQD8I.21.55.E11.1.454.CMB.1.raw
  modified_base (234)..(234): a, c, t, g, unknown or other
  misc_feature (234)..(234): n is a, c, g, or t
tcagtcgtcgctcgcacgaccggtgctcgatttagcactcgcacgttggggtttgggggagtcagtctcagtcaggacacagcatggacatgagggtccccgctcagctcctggggctcctgctactctggctccggaggtgccagatgtgacatccagatcgacccagtcctccatctatccctgtctgcatcgtgtcggagaccagaactcacctagtttattcgaccgganaagtcacgacaataaacttaccttttaaatggtactcagacaacgaaccgaagggaacgaccccaaaggcctacctagtaactcgaagttcgcgtagtaccacttaccgtaaagtttaacggacgtagggtaccgggtccctaacgtcgtaacggttcgaggtcggacgtacgtaggtacgtacggtacgggtaaactaacttttaccgaccgttacttacccaactacgttaccgagtacctagttaccgtacgtacgaaaccgttacgtaagtttacgttttacggtaacttaaccggtttacttaacggtttacgtaaccttaaacggttcgttaaacgtttaccgttaaacgtttaccgttttaacccgtttacccgtttaccgtttttacccgggaccccgtttaacggggaccccgttttaaacgggaccgtttaaaccggtaacgtttaaacccggaaaccggtttaaccgttacggttaaccggttaacccgttacggtaccgtaaaccgtttaccgttcgttttaaccgttaacccg

SEQ ID NO: 234699 - DNA, 681 bp, Homo sapiens
  misc_feature: GYAE6OF01CSIMJ.21.55.E11.1.454.CMB.1.raw
  modified_base (280)..(280): a, c, t, g, unknown or other
  misc_feature (280)..(280): n is a, c, g, or t
tcagtcgtcgctcgcacgaccggtgctcgatttagcactcgcacgttgggtttgggggagtcagtctcagtcaggacacagcatggacatgaggtcccgctcagctcctggggctcctgctactctggctccgaggtgccagatgtgacatccagatcgacccagtctccatcactccctgtctgcatctgtacgaagacagatcactattattcgaccgacagtcacgacaataaacttaacttttaatgtatcagacaacaacgaggaacgaccaaanctactgatcgatcgctcgactactaccgtaagttagaggtacggtacgggtaccctacgtacgtacggttacgacggtacggcgtaagtcggtacgttacgtacgggtaaacttaaacgttactacctacctaccactaacgtcacgtactacgtacgtacgaacctaacgtagttaacgttacgtttacgtaaccttaaactttagtaacgttacgtaactaaacgtacggtaaactttaccgtacgttttacctttaccgttttaccttaacccggtttccggtacccggtacgggtaaccgttaaacgttacgtaaaccgttaacgtaaacccgtaaacggtaccgttcggttacggtaccttacggaccctaactttacgtccgttacgtttaaccc

SEQ ID NO: 234700 - DNA, 712 bp, Homo sapiens
  misc_feature: GYAE6OF01A9UJN.21.55.E11.1.454.CMB.1.raw
  modified_base (225)..(225): a, c, t, g, unknown or other
  misc_feature (225)..(225): n is a, c, g, or t
tcagtcgtcgctcgcacgaccggtgctcgatttagcactcgcacgttgggtttgggggagtcagtctcagtcaggacacagcatggacatgaggtcccgctcagctcctgggctcctgctactctggctccgaggtgccagatggtgacatccagatcgacccagtcctccatctactcccgtgtctgcatcgtgtacggagacagatcactattagtcgacganagtcagtacaataacttacttttaagtgtatacagacaacaaacgaggaaccgaccgaatccgtacagtactcgatcgactcgactactactaagttacggagtacggtccggacctacgtaccggtaggttaccgaggtacggtacgtaacgtaggtacgtacgtaacgggaaacctttaacttaccgtaccttacctaaccaaccgtactacgaacgtactaacgtaccgttacggaaccctaaaggttactaaacgtttacgtttacgtaacttaaccgtttactacggtttaataaccgtaaacgtacgttaaacggttaccttaacgtttaccttttacccgttacgttacccggtttaccggaacccgggttaacggtaaccgtaaccgttaaacggttaagtaaccctaacgtaaaccggttaaacgcgggttacaccgttacggaccctaaccgtttacgtacccgtttggttaaaccc

SEQ ID NO: 234701 - DNA, 671 bp, Homo sapiens
  misc_feature: GYAE6OF01DG5MC.21.55.E11.1.454.CMB.1.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtctccatcatccctgtctgcatctgtcganacagaactcactattattcgaccgganaagtcagacaattaaactactttttaaatgtatcagacaacaaacgaggaacgacccaagctacgtagatcgatgctgactactacgtaagttagacgtaggtcggtccagtccgtaggtcgaggtgacgtagtggtacgttacggtacggtaacttaactttcgtacttactacctaacctactacgacgtacgtagtacctacgaacctaaacgttagtaacgtttacgtttaaccgaacctttaaactttactttaacgttacgtaaccgtaaagttaacgttaacgtttaacttaacgtttaccttttacccgtttaccgttacccgtttacccgggtacccggttaacgggtaaccgttaccgtaacgtaacgttaacgtaaacccgtaaacgtcgttacggtgtacccgtagtaaccctaccgtacttccgttcgttaccg

SEQ ID NO: 234702 - DNA, 722 bp, Homo sapiens
  misc_feature: GYAE6OF01CK51N.21.55.E11.1.454.CMB.1.raw
tcagtcgtcgctcgcacgaccggtgctcgatttagcactcgcacgttgggtttgggggagtcagtctcagtcaggacacagcatggacatgaggtccccgctcagctcctggggctcctgctactcgtggctccggaggtgccagatgtgacatccagatcgacccagtcctccatcactccctgtctgcatcgtgcgagacagatcactatttacgttcgaccggaacaagtccaacgaactaaacttaaaaccttaaccttttttaaaagttggtaactacgaagaccaaaccgaaaaccggaaggggaaacccgacccctaaaagcccgttaccgtagactcgtatcgtctacgtactaacttaactaacgtttaggaacggtacggttccgggtaccctacggtaccgtaggttacgaggtcggacgtagtcggactcggtaacggtaaactttaacgttccacttacgtaccaaccgtatccgacgacctagtaccgacgtaaccgtaaacgtagtaacgtttagtttaacgaacccttaaacgtttacttaacgttagtaacctaaacgttaagtaacgtttacgtacgttttaacctttacccgtttacgttacccggttccgaaccggttacggaaccggtaacgttacgtagtaaacctaaccgtaaacgtccggttagtccgtataccgacctacgtatccgttcgtttacc

SEQ ID NO: 234703 - DNA, 715 bp, Homo sapiens
  misc_feature: GYAE6OF01BKUJ3.21.55.E11.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagcactcgcacgttggggtttgggggagtcagtctcagtcaggacacagcatggacatggacgggtcccgctcagctccgtggggctcctgctactcgtggctccggaggtgccagatgtcgacatccagtactacgaccatctacatcacttccgtgtcgtgctactctggacgagaacganaactcactatttacgtcgaccggaactagtcaacgtaactaacgtaaacctttaacttttaagtcgtaatacgaacacaaacgaaacggacgggaaaccgaacccctaagtcctacgtacggattaccgagttcgacctagtacctaactacgttaaagttaggagtacgggttaccggtaccctagaccgttagtcgacggtggactagtaggtactacgggtaacgtaactaactttcacttacacctaactactacggtacacgtactaccgtaactacggtaaaccgtagtttaaacgttgttaaacctaacctttaaacgttacgtaacgtttacaaaccttaaggtaacggtttaactttaacctacgttttaacccgttttcctttaccggttaaccgttaccggtacccggtaacgggtaactacgtaacggtactaaaccgtaacgaaaggtctacggtcaacgtcccaatacccgtacttcgtagtacc

SEQ ID NO: 234704 - DNA, 744 bp, Homo sapiens
  misc_feature: GYAE6OF01BBLRE.21.55.E11.1.454.CMB.1.raw
tcagtcgtcgctcgcacgaccggtgctcgatttagcactcgcacgttgggtttgggggagtcagtctcagtcaggacacagcatggacagtgacgggtccccgctcagctccgtggggctcctgctactcgtggctccgaggtgccagatgtcgacactccagactcgacccagtctccatcactcctgtctgctatcgtggtcggagaacagaactcgaaccttagtttacgttacggaccggaatacggtaccaacgtactaacttaaaccttaacttttaaagtcggtactacgacgacaacgtaaacgacgggtaacgaccccgtaaagtccgtaccgtagactacgtacgtcgtcgtacgtactacttaacttaacgttaaggacggtaccgggttaccgggtaccctacggttaccgtaaggttacgtagggtcggtacgtacggtaggttactacgggtaaggtaaccttaaacgtttccaacgttcaacgtaacctagacgtaacgtctaaggtaccttacgaacccttaaggtagtaacgtttgttaaccagttaacgtttacaacttagaaacgtacgtacgtaacgttacttacgttaccttaccgtttacgtacccggttaccggccggtaaggtacccttacgtaaccggttaataacccggtaacgttaacgtacgggttcgtaaggtcccgtaaccggtaacacggttaaccttcccgttgttaacccc

SEQ ID NO: 234705 - DNA, 697 bp, Homo sapiens
  misc_feature: GYAE6OF01AXO5T.21.55.E11.1.454.CMB.1.raw
  modified_base (266)..(266): a, c, t, g, unknown or other
  misc_feature (266)..(266): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccggaggtgccagatgtgacatccagatcgacccagtctccatcactccctgtctgccatcgtggtcggagacagtactcactattagttcgaccggacagtcacgataactaaactacttttaatgtatacanacaacgaaacgacgggaaccggacccaagcctccgagctacgatgtctcgactaactacctaagtttaggaacggtacggttccggggtaccctacgttaccggttaggttacgtagggtcggtacggtagttcgggtagtacccggtaggggtaaaccttaagttttacccaccgttacctaaccctacgtacgtacgacgtactacgtacgtacctaacgtaaccgttagtaacgttaacgttttactaacccgtttaactttaacgtttaactttaccggtaactaacgttaacgttaacgttaacctaggttttaaccttttcctttacgtttacccggttccgtaccggtacggtacgtacgtcgtaactacgtaacgtaacgtacgtacgtcgacgtacgaccgtaactcttcgttcgttacccg

SEQ ID NO: 234706 - DNA, 844 bp, Homo sapiens
  misc_feature: GYAE6OF01A66M5.21.55.E11.1.454.CMB.1.raw
tcagtcgtcgctcgcacgaccggtgctcgatttagcactcgcacgttgggtttgggggagtcagtctcagtcaggacacagcatggacatggagggtccccgctcagctcctggggctcctgctactctggctccgaggtgccagatgtgacatccagatgactcagtctccatctactccctgtctgcatcgtgtcgagaacagataccaacctattacgttcggaccggactaagtacacggaactaacgtaaaaccttactttttaaagttacggtatacaacgacctaaaccgaaaccgacggggtaaaccggaacccctaaacgccttaccgtagtactccgagtacgctcgtactaataccttaaagtttacggacggttacgggtccgggtacccctagttacccgtaagggttaccgaaggttcggacgttaaggtacggatttccggtaaacggggttaaacctaaaacttttaccgtaaccttacccgtaccgtaaccctaacttccgaacgtacgtacgttacccgtacgtaaccgtaaacccgttagggtaaacgtttacgtttaaccgtaccgtttaaaacttttccgttaaagtttcccgtaaacgaaaccgttaacgggttaaccgtttaaccggttaacttttaacccggttttaccccttttacgggttaccccgtttttaacccgggaaccccgggtttaacgggaaaccccggttttaaacggttacccgttaaaaggttaaaccctaaaccggtaaaaacctacggtttaaacgggtaacggtccgttaaccgtaacccgttaacctacggttacccgtttacg

SEQ ID NO: 234707 - DNA, 728 bp, Homo sapiens
  misc_feature: GYAE6OF01ELA92.21.55.E11.1.454.CMB.1.raw
  modified_base (324)..(324): a, c, t, g, unknown or other
  misc_feature (324)..(324): n is a, c, g, or t
  modified_base (342)..(342): a, c, t, g, unknown or other
  misc_feature (342)..(342): n is a, c, g, or t
tcagtcgtcgctcgcacgaccggtgctcgatttagcactcgcacgttgggtttgggggagtcagtctcagtcaggacacagcatggacatgacgggtcccgctcagctccgtggggctcctgctactcgtggctccgaggtgccagatgtcgacatccagatcgacccagtctccatcagtcctgtctgctatctgtaggagacaagatcacctattattcgaccgacaacgtcaacgactaataaacttaacgtttttaatggtactcacgtacaacgaaaccggagggaaccgacccaaagtcctacgagactgatcgactnactactactaagttaggngtacggtacggtaccctagttacgtacgtacgaggtcggacgtaagtggtacttacggtaaggtaacttaaacgttccaacttaccgacctacctagtaccgacggtactacgtacaacgtaactaacggttataacgtttaacgtttacacgtttaaacctttttaacgacgtttacgtaacctaaacgttcgtttaaacgggttaacccttacgtttttaactttaaccccttttacccggttaaaccgtttcccgggtaacccggttacgggtaaacccgggttaattaaaccgtaccgttaaaactacccggtaaaacgttacggacggtttaccggaaaccgttccgtaaaccttaccgttacttacgtttccgttacccg

SEQ ID NO: 234708 - DNA, 667 bp, Homo sapiens
  misc_feature: GYAE6OF01BQDK8.21.55.E11.1.454.CMB.1.raw
tcagtcgtcgctcgcacgaccggtgctcgatttagcactcgcacgttggggtttgggggagtcagtctcagtcaggacacagcatggacatgagggtccccactcagctcctggggctcctgctactctggctccgaggtgccagatgtgacatccagactcgacccagtcctccatcactccctgtctgcatcgtgtcggagacagactcacctattagttcgaccgacagtccacgactaataaaccttaacttttaagtagtactacgacacaacgaaccgaacgggaaccgacccaagtcctactagactacgagtcgcgtacgactactacgtaacgtagaggtacggtacggtcctaacgtcgtacggttacgtacgggtggtcgtaacgtcggtacgtacggtaaggtaaaccttaagtttaccacctactacctacacgtcgaagtcgtagttacctaccgtacctaaggttataacgttactttacgaacctttaactttacgttacttaacgtaaccgtaagttacgttaacgtttaactacgttttaccttccctttacgttaaccggttcccgaacggtaacgggtaccgttaagtacgtaactacggttaacaacggtcgttgtaacgtctacgacgtacctattccgtattcc

SEQ ID NO: 234709 - DNA, 678 bp, Homo sapiens
  misc_feature: GYAE6OF01EQ8YI.21.55.E11.1.454.CMB.1.raw
tcagtcgtcgctcgcacgaccggtgctcgatttagcactcgcacgttgggtttgggggagtcagtctcagtcaggacacagcatggacatgacgggtccccgctcagctcctggggcctcctgctactctggctccgaggtgccagatgtgacatccagatcgacccagtctccatcactccctgtctgcatctgtcggagacagaactcaacctattattcgccggaactagtcaacgactaataaacttactttttaaatgtatcagacaacaaacgaggaacgaccaatctcagatcgtatgtctacgctacttactaagttagaggtacggtcggtaccctagtaccgtagttacgtaggtcggacgtagtaggtacgttacgggtaacggtaacttaaacgtttacctaccttaccgtactacccaagtcctaagcctagtcctacgtaaccctacttaaggttaactttagtttacctaacctttaacttacgtacgttacgtacaacgttaagttaacgtttacttaacgttacccttttacgttttacccaccgggttttacccgacccggttaaccggtaccgttaacgttaccttaacgtaaccgttaacgaaacgttcgtaccgggttactacccgtagaacccttacgacgttttcgtccttaccg

SEQ ID NO: 234710 - DNA, 732 bp, Homo sapiens
  misc_feature: GYAE6OF01D1QKM.21.55.E11.1.454.CMB.1.raw
  modified_base (121)..(121): a, c, t, g, unknown or other
  misc_feature (121)..(121): n is a, c, g, or t
  modified_base (374)..(374): a, c, t, g, unknown or other
  misc_feature (374)..(374): n is a, c, g, or t
tcagtcgtcgctcgcacgaccggtgctcgatttagcactcgcacgttgggtttggggggagtcagtctcagtcaggacacagcatggacatgagggtccccgctcagctcctggggctccngctactctggctccgaggtgccagatgtgacatccagatcgacccagtctccatacactccctgtctgcatcgtagtggaagacaagaataccaacctaatttacgttacggaccgaacaacgtaccaaccgaaactaaacttaaaacctttaacctttttaaaagttaggtaacttacaacgtaccaaaccaaaaccggaacgggaaacccggtaacccccaaacgtcctaccgtacgtacgtacgtagtcncgtacacacttaaccttaaagttaacggaggtaacggtcgggtaccctaacgtccgtaaggttctaggtacggtcgtagtacggtagtacggtacgggtaataaacgtttccacgtacctactaccgtatcgaagtcgtacgtcgtagacctaaacgtacgtaatttacgtttacgtaaccgttactttaacgttattaacgtaaccgtaaacgttaacgtaatttaaccgtaagttttaccttttaccctttacgtacccggttaccggtcccgtaacgggtaaccgtacggtacctaagttaaacctaacgtaaacgtacgttggtacactcgtaccgaaccttgtccttcgtacc

SEQ ID NO: 234711 - DNA, 671 bp, Homo sapiens
  misc_feature: GYAE6OF01A6K1N.21.55.E11.1.454.CMB.1.raw
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (279)..(279): a, c, t, g, unknown or other
  misc_feature (279)..(279): n is a, c, g, or t
  modified_base (289)..(289): a, c, t, g, unknown or other
  misc_feature (289)..(289): n is a, c, g, or t
tcagtcgtcgctcgcacgaccggtgctcgatttagcactcgcacgtttgggtttggggagtcagtctcagtcaggacacagcatggacatgaggtccccgctcagctcctggggctcctgctactctggctccgaggtgcagatgtgacatccagatgacccagtctccatcatccctgtctgcatctgtcggagacagaatcacnttattgccganagtcacgacataacacttttaatggtatcagtcacaaaccgaggaacgaccccaaagcctcngactgatcgntgcctatccaatttggagtacggtcgggtcccaagtccgtaggttacgaggtggacgtagtcggaagtcgtagggaaacctaaagtttcccactttacgtactaccacttaccgacgtactacgttactacgaccgtaaaccgtcggaaacgttagtttttaccggaactttaaaccgttacttacgttaacggtacctaaaccggtacgtaaggtttaaccagggtttttaacttaccccttttaccgtacgttttaccccggaccgttacggggtacccgttaaacggttcggtaaaccgttaaccgaccttaaaacggtaacccttcgggtcgttaaccgtccgtaacccgtacccgtaacgttccgtacggtttaccc

SEQ ID NO: 234712 - DNA, 768 bp, Homo sapiens
  misc_feature: GYAE6OF01BGJF9.21.55.E11.1.454.CMB.1.raw
  modified_base (217)..(217): a, c, t, g, unknown or other
  misc_feature (217)..(217): n is a, c, g, or t
  modified_base (726)..(726): a, c, t, g, unknown or other
  misc_feature (726)..(726): n is a, c, g, or t
  modified_base (739)..(739): a, c, t, g, unknown or other
  misc_feature (739)..(739): n is a, c, g, or t
  modified_base (761)..(761): a, c, t, g, unknown or other
  misc_feature (761)..(761): n is a, c, g, or t
tcagtcgtcgctcgcacgaccggtgctcgatttagcactcgcacgttgggtttgggggagtcagtctcagtcaggacacagcatggacatgacggtcccgctcagctccgtggggctcctgctactctcggctccggaggtcgaccgagatgtacgacactccgagatcgacccagtcctccatcactccctgtctgctatcgtggacggagacaanaactcaactattacgttacggaccgtaacaagtacaaccgtaaactaaacgttaaaaccttaaccgttttttaaagttggttaacaccgttaacgtaaccgaaaccgtaaaaccgggaaacgggtaaacccggtaacccccgaaaaggtcccttaccgtaacggtacgtaccgtagtccggtactaacggtaccaaacgtttaacccgtaaagttttaaacggacggttaaccggggttaccggggtaaccctaacggtttaccgtaacgggttacgtaacggggttaccggacggtacgtagggtaacgtacggtaaacggggtaaaccttaaacgtttaccaacttactaacccacgtaacttaccgagtacgtacgtacgtaacgtaacctaaacgtacgtaacgttacgttacgtaacgtaactttatacgtataaccgtaagtacgttaacttacgtacgttacctttcgttacctaccgttcgtaccggagtacgagtactanaacgtacaacgtngtacgactagaccctatcgttntcgtacc

SEQ ID NO: 234713 - DNA, 774 bp, Homo sapiens
  misc_feature: GYAE6OF01EBZC3.21.55.E11.1.454.CMB.1.raw
  modified_base (140)..(140): a, c, t, g, unknown or other
  misc_feature (140)..(140): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtnccagatgtgacatccagatcgacccagtcctccatcactccctgtctgctatcgtggtacggagaacagaactaccacctatttagttcgaccggaacaacgtccaacgaactaaattaaaaccttaactttttaaattggtaactcgaacgaccaaaccgaaaccggaacgggaaccgaccccaaagtcctaccgtacgtactaccgatcgctcgtacctacttaacctaagtttaggacggtacgggttccgggtaccctacgttaccggtaggttacgagggtggtacggtagtacggtacgttacggtagggtaaaccttaacttccgtaccttaccgttaccaaccttacgtaccacggtactaccggtttcgtaaccggaacctaaacggttaggttaaacgttttacgtttttaaccgacttttaacgttaacgtttacgtttacgaaacctaaggtaacggtttaacgtttacgttacgtttaacctttttcccgttaccgttaccggtttcccgggtaacccgttaacggggtaaccttaagtaccgttaacgttaaccgtaaacggtaaccgtttacggcggttacgtccttaaacgtccctacgttacgttccttcgttaccg

SEQ ID NO: 234714 - DNA, 650 bp, Homo sapiens
  misc_feature: GYAE6OF01B3W1I.21.55.E11.1.454.CMB.1.raw
  modified_base (221)..(221): a, c, t, g, unknown or other
  misc_feature (221)..(221): n is a, c, g, or t
  modified_base (347)..(347): a, c, t, g, unknown or other
  misc_feature (347)..(347): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtcctccatcatccctgtctgcatctgtcggagacagaatcactattattgccganaagtcacgacataaactacttttaatgtatcagcaacaacgagggaccgacccaagcctactgacgtcgatgctagctactacctaagttagacggtaggtcgggtacccagtccgtaggttacgnggtggacgtaggtaggtactcggtaggtaaaccttaatttccgactctaccaacctagtacagacctagttacacgtacctaaccgtagtaacgtttactttagaacctttaacttagttaactttacgaaactaacggtaagttaaccgttacggttacttttactttcccgtttacgttacccgttccgggtaacccggtacgggtaaccgtaacggttacgtaaacttaaccgtaacgtaaaccgttaacgttcgggtcggtaccgttcggtaacccctatacgtttccgttcgttaccc

SEQ ID NO: 234715 - DNA, 680 bp, Homo sapiens
  misc_feature: GYAE6OF01AWBPM.21.55.E11.1.454.CMB.1.raw
  modified_base (203)..(203): a, c, t, g, unknown or other
  misc_feature (203)..(203): n is a, c, g, or t
  modified_base (207)..(207): a, c, t, g, unknown or other
  misc_feature (207)..(207): n is a, c, g, or t
  modified_base (335)..(335): a, c, t, g, unknown or other
  misc_feature (335)..(335): n is a, c, g, or t
  modified_base (595)..(595): a, c, t, g, unknown or other
  misc_feature (595)..(595): n is a, c, g, or t
  modified_base (666)..(666): a, c, t, g, unknown or other
  misc_feature (666)..(666): n is a, c, g, or t
tcagtcgtcgctcgcacgaccggtgctcgatttagcactcgcacggttgggtttgggggagtcagtctcagtcaggacacagcatggacatgacgggtcccgctcagctccgtggggctcctgctactctgggctccggaggtgccagatgtgacatcgagatcgaccagtctcatcactcctgtctgactgtcgtgacgganaacngtactcactagtttacgtcggaccaataagcaacgaactaaacttaacttaactttaagttagactacgagtaccaacgaccggaaggaacccgaacctaacgtcctacgtacgtagtaccgagttcncgtatcctaactacgtaaagttaaggacggtacgggtaccggtaccgaccgttacgtacggtaacggtcggcggtacgtgaacggtctacggttaggtaaacctacttacgcttacgtacctactacgactcgtacgtactcgtaacgtactacgtaacgttagttacgttagtaccgttaacttacgttactacgtaacgtacgtaacgttaacgtacttagttacttttccttacgttcgttaccgtcgggttaaccnccggttaaactacttaccgtaaacgtaacgtaaacggttcgttgacccggtccttaacggaccttaaccgngttccgtttacgac

SEQ ID NO: 234716 - DNA, 647 bp, Homo sapiens
  misc_feature: GYAE6OF01BC2CD.21.55.E11.1.454.CMB.1.raw
  modified_base (99)..(99): a, c, t, g, unknown or other
  misc_feature (99)..(99): n is a, c, g, or t
  modified_base (170)..(170): a, c, t, g, unknown or other
  misc_feature (170)..(170): n is a, c, g, or t
  modified_base (213)..(213): a, c, t, g, unknown or other
  misc_feature (213)..(213): n is a, c, g, or t
  modified_base (598)..(598): a, c, t, g, unknown or other
  misc_feature (598)..(598): n is a, c, g, or t
tcagtcgtcgctcgcacgaccggtgctcgatttagcactcgcacgttgggtttggggagtcagtctcagtcaggacacagcatggacatgaggtcccgntcagctcctgggctcctgctactctggcctccgaggtcgccagacttgtcgacactccgagactcgacccngtctccatcactccctgtcctgactatcgtggtagtcgaaccngtcgtactaccatcctacgttcggccggtaccaaggttccaaggttatacgtttacggtacgtcgtttacgggttcggtaccgttaggtataccgtaagaccgtaaacggaaaaccgtacgggtaaacgtccccttaaagtccgttacctagtaacgtcgtaacgtacggtaccgttacgttaaggttaacgtaaggtacgtccgtaccaaggtcgaacggttcggcgtaacgtggacggtactcgtacgggtactagtacttcgacgttcacactacgcagcacgctgcagtcagtgtctaatcgacttatacgtcacgactacgtaagttattaacgttgttaccgtacgtactccgggaactacggaccgtaagtccgtaanacgttaaccgagtaacgtgggtaccctacgtaccgacttcgtctttacg

SEQ ID NO: 234717 - DNA, 801 bp, Homo sapiens
  misc_feature: GYAE6OF01EVP6O.21.55.E11.1.454.CMB.1.raw
  modified_base (164)..(164): a, c, t, g, unknown or other
  misc_feature (164)..(164): n is a, c, g, or t
  modified_base (236)..(236): a, c, t, g, unknown or other
  misc_feature (236)..(236): n is a, c, g, or t
tcagtcgtcgctcgcacgaccggtgctcgatttagcactcgcacgttgggtttgggggagtcagtctcagtcaggacacagcatggacatgaggtcccgctcagctccgtggggctcctgctactctggctccgaggtgccagatgtgacatccagatcgaccngtcctccatctactcctgtctgctatcgtggtacggagactagactccacgttatttacttcggaccgtaanacgtcaaccgactaacgttaaacttaactttttaagtgtatcgagaccaacaaaccggaacgggaaccgaccccgaaactccgttacctacggactacggtacgtcgctagcctaagttaacctaagtttaacggaggttaacgggtccggttaccacgtccggtacggttaacgtggtaccggtagtaggttaaggacgttacgtagggttaacctttaaaccgtttacgtacccttacccgttaacctacccgttaaccgttaccgaaccggttacccgttccggttacccttaaccgaacccggtttaaaaccggttaacggttaacgttttaaccggtttaccgtaaacccttttaactttaaccgttttaacgtttacgttaaacccgaagttaaccggttaactttaaccggttaaccgttttacctttacccgtttttccgtaacccggtttcccccgttaaccgggtagggttaacccgtaaggttacttacgttaaccgtaaagtaaccgttacgttacgtccgtagtcctactaccgtaacttcgtcctttaccg

SEQ ID NO: 234718 - DNA, 860 bp, Homo sapiens
  misc_feature: GYAE6OF01A1QYJ.21.55.E11.1.454.CMB.1.raw
  modified_base (101)..(101): a, c, t, g, unknown or other
  misc_feature (101)..(101): n is a, c, g, or t
  modified_base (202)..(202): a, c, t, g, unknown or other
  misc_feature (202)..(202): n is a, c, g, or t
tcagtcgtcgctcgcacgaccggtgctcgatttagcactcgcacgttgggtttgggggagtcagtctcagtcaggacacagcatggacatgaggtccccgntcagctcctggggctcctgctactctggcctccgaggtcgccagatgtgacatccagatcgacccagtctaccatcactccctgtctgcatcgtgtcgganacagactcacctattattcggccggacaggtcacgaactaataaaccttaacctttttaaagttggtaactcgactaccaaacctaaaccggaacgggaaccggaccccaaacgtcctacctagactacgatgctgactactacctaagttacgaagtacggtcggtacctacgtaccgtagttcgtaggtcggacggtaggtcggtacgttacggtaacgggtaaacctttaacgtttacctacccttaccgttacccaaccgtaccgttaaccaacggttacccgttacgttaccgttacgtaacccggttaaccgttaaacgttaacgtttaaccgttttacgtaacccgtttaaaccttttaaccgttacgttttaacccgtaaccgtaaacgttaacggttaaaccggtttaaccgtttaaaccggttttaacccgtttttacccgtttttaacccgtttaaccccgggttttaccccggggtaccccgggtttaaacccggggttaacccggttaaaccccgttaaccggggttaaaccgttaaccggttaaacccggtttaaaacccggtaccgtttaacggggtacccggttaaccggttaccgtaaccccgaacccgtttacgtttacccgggtttcctttaaccccgg

SEQ ID NO: 234719 - DNA, 684 bp, Homo sapiens
  misc_feature: GYAE6OF01DNQMS.21.55.E11.1.454.CMB.1.raw
  modified_base (208)..(208): a, c, t, g, unknown or other
  misc_feature (208)..(208): n is a, c, g, or t
tcagtcgtcgctcgcacgaccggtgctcgatttagcactcgcacgttgggtttgggggagtcagtctcagtcaggacacagcatggacatgagggtcccgctcagctcctggggctcctgctactctggctccgagtgccagatgtgacatccagatcgacccagtcctaccatcactcccgtgtcctagctagtcgtcggtacgganaacgtagaaacttccaaccgtatttactttcggaccggtaacaacggttcaacgtacctaattaaaaccgttaaccttttttaaagttcggtattacgaagacctaaaccgaaacgtacggaacggaccccaaagtcctacctgaactcgatgctaacacgtacctaatttaggacgtacggtgggtacccctagtccgtaggtacgtagtggacgtagtaggctacgtaggtactaaaacttcacgtcctacgtaactacgtactaggcctaggtcctacggtaacctacgtagtaaagtttactttacggaccttaaactttactattacgttaacgaccttaagtaagttctaacgtttcttaacccttcgtaccttccggcgtaacggtaacgttaggacctaataacgtaaaccgtaaggtaattcggtaccgatacccggtacacctttagtaccggttctactttaccg

SEQ ID NO: 234720 - DNA, 671 bp, Homo sapiens
  misc_feature: GYAE6OF01AXMMX.21.55.E11.1.454.CMB.1.raw
  modified_base (201)..(201): a, c, t, g, unknown or other
  misc_feature (201)..(201): n is a, c, g, or t
  modified_base (650)..(650): a, c, t, g, unknown or other
  misc_feature (650)..(650): n is a, c, g, or t
  modified_base (659)..(659): a, c, t, g, unknown or other
  misc_feature (659)..(659): n is a, c, g, or t
tcagtcgtcgctcgcacgaccggtgctcgatttagcactcgcacgttggggtttgggggagtcagtctcagtcaggacacagcatggacatgagggtccccgctcagctcctggggctcctgctactctggctccgaggtgccagatgtgacatccagatgacccagtctccatcactccctgtctgcatcgtgtacgganacagaactcacctattagttcgccggacagtcacgaactaataaaaccttacctttttaaatggtatcgagacaaccaaaccgagggaacgaccccaaagcctacctgaatcgaatcggctgacctacttacctaaatttaggaggtacggtcgggtacccagttaccgaggttcagggtcggagagtcggagttccggtaggtaaacttaactttccacttaccacctacctagtaccacgtactagttactacgacccttaaacgttaggtaattacgttttacaacctttaaactttagttaacttacgaaacctaacggtaacgttaactttacgttaagtttaccctttacccgtttaccttaccggtttccccgggacccgttacggggtaaccttaacgggtactaacgtaccgtaactaaacggtacgtgtacgcgtaccncgtaacctntccgttcgtacc

SEQ ID NO: 234721 - DNA, 794 bp, Homo sapiens
  misc_feature: GYAE6OF01E0EHL.21.55.E11.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagcactcgcacggttggggtttgggggagtcagtctcagtcaggacacagcatgggacatgagggtcccgctcagctccgtggggcctcctgctactcgtggctccgaggtcgccagatgtagtacatccagatcgtacccagtcctcatcatcctgtcctgactntctgcggagacagactcactattagttcgaccgacaacgcaaccgaactaacgttaaaacctttaccgtttttaaaagttggtaactcgtaacgactaaacgaaaccggacgggaaccgacccgtaaacgtccgttacgtacgacgttacgacgttctaccgtacggccttacgtaacgttaaggtttacggaaggttacggttacgggtccctaggtcccgtagggttacgcggtacggacggttaggtaggttacggttaggggtaaacctttaaacgttccggttacctacttaccccacgtactaaccgtacgttccgtaacctacgtacgaaacccggttactaaggttaaacgtttacgtttaccttaaccgtttaactttaacgttcggttttaacaaccgtaagtaacgttaacggtttaactaccgttttaacgttttacccgttacgtttaacccggtttcccggtaccgggtacgtaaaaccgggtacgggtttacgaaaccctttaacggtaaccgtaacggggttactcggggtactaccggaacctccgttaccctaacgtttcggtaaccttcggtaccc

SEQ ID NO: 234722 - DNA, 498 bp, Homo sapiens
  misc_feature: GYAE6OF02HSGEK.21.55.E11.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcactcgcacgttgggtttgggggagtcagtctcagtcaggacacagcatggacatgagggtcccgctcagctcctggggctcctgctactctggctccgaggtgccagatgtgacatccagatgacccagtctccatcatccctgtctgcatctgtcggagacagaatcaccattattgccgganaagtcacgacataaacaccttttaaatggtatcagcacaaaccaggaaggccccaaagctcctgatcgatgctgcatccaatttagagagtgggtccatccagttcagtgcgatggatctggacaaattcactctcaccatcagcagtctgacaacctgaagtattttcgactaacttactattgtacaacagtagttacagttacttcctttactactttcgacccgtggaccgtagttcgaatatacaaacgtactgtgactgacctacatctgtc

SEQ ID NO: 234723 - DNA, 492 bp, Homo sapiens
  misc_feature: GYAE6OF02GQIX0.21.55.E11.1.454.CMB.1.raw
  modified_base (437)..(437): a, c, t, g, unknown or other
  misc_feature (437)..(437): n is a, c, g, or t
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacaccttttaaatggtatcagcacaaaccaggaagccccaaagctcctgatcgatgctgcatccaatttagagagtgggtccatccaggttcagtggcgatggatctgggacaaatttcactctcaccatcagcagtctgcaacctgaagtattttgactaaactttactattgtacaacagtagttacagttattcctttnactttcgccctgggacctagtcgatatacaaacgaactgtggctgcacatctgtc

SEQ ID NO: 234724 - DNA, 501 bp, Homo sapiens
  misc_feature: GYAE6OF02F5GZU.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacaccttttaaatggtatcagcacaaaccagggaagccccaaagctcctgatcgatgctgcatccaatttagagagtgggtcccatccaggttcagtggcgatggatctgggacaaatttcactctcaccatcagcagtctgacaacctgaagtattttgactaacttactattgtacaacagtagttacagttactttcctttctactttcggcccttgggaccgtagtcgatactacaaacgtactgtgctcgcacatctgtc

SEQ ID NO: 234725 - DNA, 495 bp, Homo sapiens
  misc_feature: GYAE6OF02GGTTS.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacaccttttaaatggtatcagcacaaaccagggaaggccccaaagctcctgatcgatgctgcatccaatttagagagtgggtcccatccaggttcagtggcgatggatcgtgggacaaatttcactctcaccatcagcagtctgcaacctgaatattttgactaactttactattgtcaacagtagttacagttattcctttcactttcggcctgggacctagtcgatatacaacgaactgtgctgacaccatctgtcc

SEQ ID NO: 234726 - DNA, 505 bp, Homo sapiens
  misc_feature: GYAE6OF02FY8JN.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacaccttttaaatggtatcagcacaaacaggaaggccccaaagctcctgatcgatgctgcatccaatttagagagtggggtcccatccaggttcagtggcgatggatcgtgggacaaatttcactctcaccatcagcagtctgcaacctgaagtattttgactaacttactattgtacaacagtacgttacagttactttcctttacactttcggcccttagggacctagtcgatatacaaacgactgtagctgaccaccatctgttcc

SEQ ID NO: 234727 - DNA, 508 bp, Homo sapiens
  misc_feature: GYAE6OF02JWF5C.21.55.E11.1.454.CMB.1.raw
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (291)..(291): a, c, t, g, unknown or other
  misc_feature (291)..(291): n is a, c, g, or t
  modified_base (373)..(373): a, c, t, g, unknown or other
  misc_feature (373)..(373): n is a, c, g, or t
  modified_base (382)..(382): a, c, t, g, unknown or other
  misc_feature (382)..(382): n is a, c, g, or t
  modified_base (388)..(389): a, c, t, g, unknown or other
  misc_feature (388)..(389): n is a, c, g, or t
  modified_base (396)..(396): a, c, t, g, unknown or other
  misc_feature (396)..(396): n is a, c, g, or t
  modified_base (470)..(470): a, c, t, g, unknown or other
  misc_feature (470)..(470): n is a, c, g, or t
  modified_base (488)..(488): a, c, t, g, unknown or other
  misc_feature (488)..(488): n is a, c, g, or t
tcagtcgtcgctcgcacgaccggtgctcgatttagcactcgcacgttgggtttgggggagtcagtctccagtcacggacacagcattgggacatgagggtccccgctcagctcctggggctcctgctactctggctccgagtgccagtatgtgacattccagatgacccagtctccatcatccctgtctgcgatcctgtccggagaccnggaactcacctnttatttgccggacaagtcacgacataaaaccaccttttaaattggtatcagcacaaccaggagccccaanctcctgatcgatgctgcatccaatttagagagtgggtcccatccaggttcagtggcatggatctgggacaaatttcgactcncaccatcancagtcnncaacctnaagatttgctaactctattgtcaacagagtttacagttaattcctttcactttcgccgttggaccgtagtacgntaagtcaaaacgaactgnggactggccacatcgtgtcc

SEQ ID NO: 234728 - DNA, 591 bp, Homo sapiens
  misc_feature: GYAE6OF02JIBJM.21.55.E11.1.454.CMB.1.raw
  modified_base (458)..(458): a, c, t, g, unknown or other
  misc_feature (458)..(458): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgccggacaagtcacgacataaactaccttttaaatggtatcagcaacaaaccagggaacgccccaaagcctacctgatcgatgctgacatacctaatttagagtaggtcgggtcccagtccgaggttcaggtggacgtagtggatcgtagggtaacctaaagtttcactctacacctatacagctaagtctagactaacctgtaaatattttacgaccttaaactttactattcgacctaaangtaacgttacagtttactttccgtttactaccgttttacggacccgttagggaaccctagttacgtaatacgttaacctaaaacggtaccgttagtacggaccgttacgacctaacctacgttcgtcgttacc

SEQ ID NO: 234729 - DNA, 566 bp, Homo sapiens
  misc_feature: GYAE6OF02I5F7Z.21.55.E11.1.454.CMB.1.raw
  modified_base (265)..(265): a, c, t, g, unknown or other
  misc_feature (265)..(265): n is a, c, g, or t
  modified_base (371)..(371): a, c, t, g, unknown or other
  misc_feature (371)..(371): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaactaccttttaaatgtatcagcacaaaccngggaacgccccaaagctcctgatcgatgctgcatccaattagagaggtgggtccatccaggttcagtggcgatggatcgtagggactaaattcaactctacaccancagcagtctgacaacctgaagtattttgacttaacttacttattgtaccaaacgtagtacgtttaactagttacttttaccctttactaaccgttttccggccccgttacggggaacccgtaggttaccgtagttaacgtacgaaaaccgtaattcggttacggaccttggaccctacctacttcgttagttccc

SEQ ID NO: 234730 - DNA, 560 bp, Homo sapiens
  misc_feature: GYAE6OF02G10HF.21.55.E11.1.454.CMB.1.raw
  modified_base (220)..(220): a, c, t, g, unknown or other
  misc_feature (220)..(220): n is a, c, g, or t
  modified_base (337)..(337): a, c, t, g, unknown or other
  misc_feature (337)..(337): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacattattgccgganagtcacgacataaactaccttttaaatggtatcagcaacaaaccgaggaaggaccccaaagcctcctgatcgatgctgcatccaattagagagtcgggtccatccgaggtcagtggngatggatcgtagggactaaatttcactctacacatcagctagtctgacaacctgtaagtacttttagacctaacttacttattcgtacaactagtaagtttacagtttactttcccgtttactaccgtttcggacccgttagggacccgtagttacgtaacttaacgtaaccgaaacgtaacgttggtacggtctacgtacctacctacttacgtcgttaccc

SEQ ID NO: 234731 - DNA, 554 bp, Homo sapiens
  misc_feature: GYAE6OF02IKIJB.21.55.E11.1.454.CMB.1.raw
  modified_base (256)..(256): a, c, t, g, unknown or other
  misc_feature (256)..(256): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacaataaactaccttttaaatggtatnagcaacaaaccagggaacgcccaaagctcctgatcgatgctgcatcaatttagagagtgggtaccatccgaggttcagtggcgagtggatcgtgggaactaaattacactctaccacatacagcagtctagacaacctgtaaatagtttcgacctaaattacttatttagaccaactaagtattaactaagttactttcctttactaaccgttcgaccccgttagggaaccgtagtacgtaacgttaacaacgtaaacgtaacgttggtagcttacgacctaccgtattcctgttacc

SEQ ID NO: 234732 - DNA, 577 bp, Homo sapiens
  misc_feature: GYAE6OF02GLT6Q.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaacaccttttaaatggtatcagcacaaaccagggaagccccaaagctacctgatcgatgctgcatccaatttagagtaggtcggggtccatccaggttcagtggcgatggatcgtagggactaaatttcactctcaccatcagcagtctgacaacctgaagtattttgactaacttactattcgtacaactagtaacgttacagtttactttcccttttactaccgttttccggcccgttacggggtaacccgtaaggttaccgtaacttaacgtaacctaaaacggtaaccgttaggtacggtaccttacggtaccctaacccacgtttacctagtttaccc

SEQ ID NO: 234733 - DNA, 668 bp, Homo sapiens
  misc_feature: GYAE6OF02JBAKY.21.55.E11.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcactccctgtctgcatctgtcggagacagatcactattattgccganagtcacgacataaactacttttaatgtatcagcaacaacgaggaacgacccaaagctctagatcgatgctgcactacctaatttagagtacggtcgggtaccctagtcccgtaggttccgaggtcggacgtagtggacttcggtagggtaaacttaaatttccacgttctaccgaacctatcaagctaaggttcctaggtaacctaaccgtagtaaagtttacgttttcgaaccttaaactttacttaagtttacgaacctaaaacgaggttaacttacgtaagttttaacctttacccgttttaccgtaacccggttttacccggacccggttaacggggtaaacccgttagggttaccctaagttaaccgttaaaccgtaaacggtaaccgttacggtacgggtacctacggtacccctaaccgttaagtttccttacggttaccc

SEQ ID NO: 234734 - DNA, 547 bp, Homo sapiens
  misc_feature: GYAE6OF02I1CGS.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaacaccttttaaattggtatcagcacaaaccagggaagccccaaagctcctgatcgatgctgcatccaatttagagagtcggggtcccagtccaggttcagtggcgatggatcgtagggactaaatttcgacttcctacgtacccatcaagcagtctgaccaactgaagtatttgactaacttactattgtcaacagtagttactagttactttccgtttacttaccgtttccggtacctcgggtaacctaggttacacgttactaaccaaacggtaactggtacggctcgaccaccgtattccgtagttacc

SEQ ID NO: 234735 - DNA, 511 bp, Homo sapiens
  misc_feature: GYAE6OF02IZB4K.21.55.E11.1.454.CMB.1.raw
  modified_base (508)..(508): a, c, t, g, unknown or other
  misc_feature (508)..(508): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaacacctttttaaatggtatcagcacaaaccaggaagccccaaagctcctgatcgatgctgcatccaatttagagagtgggtccatccaggttcagtggacgagtggatctagggactaaatttcactctacaccatcagcagtcctgaccaacctagaagtattttgacctaacttactattcgtacaacagtagttacagttactttcctttctacgtttcgaccctgggacctagtcgaatatacaaacgtactgtagctgaccacatctntcc

SEQ ID NO: 234736 - DNA, 521 bp, Homo sapiens
  misc_feature: GYAE6OF02GSQ5W.21.55.E11.1.454.CMB.1.raw
  modified_base (287)..(287): a, c, t, g, unknown or other
  misc_feature (287)..(287): n is a, c, g, or t
  modified_base (505)..(505): a, c, t, g, unknown or other
  misc_feature (505)..(505): n is a, c, g, or t
  modified_base (514)..(514): a, c, t, g, unknown or other
  misc_feature (514)..(514): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacaataaacacctttttaaatggtatcagcacaaaccagggaagccccaaagctccngatcgatgctgcatccaaatttagagtaggtcggggtccagtccaggttcaggtggcgatggatcgtagggaactaaatttcacttctacacatcagcagtctgacaactgaatatttgactaaactttactatttgtacaaacgagtaacgtttacagttactttcctttactacgtttccggcctgggaccgtagtcgtatactacaaacgattgngctgccacnttctgtc

SEQ ID NO: 234737 - DNA, 576 bp, Homo sapiens
  misc_feature: GYAE6OF02HQ31O.21.55.E11.1.454.CMB.1.raw
  modified_base (298)..(298): a, c, t, g, unknown or other
  misc_feature (298)..(298): n is a, c, g, or t
  modified_base (301)..(301): a, c, t, g, unknown or other
  misc_feature (301)..(301): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgagacagaatcactattattgccggacaagtcacgacaataaactacctttttaaattggtatcagcacaaaccaggaaggacccaaagctacctgactcgaatnctncgggactcctaattagagacgtggggtaccatccaggttacagtgcgatggatcgtggactaaatttcactctacacatactagctagtctacgacaaccgtgtaaagtatttacgactaactttaactattgtactaactaagtaacgttaacagttactttaccttttacctacctttccggcccgttacgggtaccgtaacgtaccgtaataactaacctaacgtaaacttgtacggtactacggtacaacccgtattaccgtatttacccg

SEQ ID NO: 234738 - DNA, 576 bp, Homo sapiens
  misc_feature: GYAE6OF02HKYV2.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacacctttttaaattgtatcagcaacaaacaggaaggaccccaaagctacctgatcgatgctgcataccaatttagagaggtcgggtccctagtccgtaggttccgaggtcggacgtatgggtaactcgtaggggaactaaagtttccaacgttcctcgaacctataccagactagtctagctaaaccgtgaaagtattttcgactaaactttacttattcgtacaactagtaatttacgattactttcctttactaccgtttcgtacccgtagggtacctagtacgtactaactaccgtaaacgtaactagtcggactcgacctacctatctagttacc

SEQ ID NO: 234739 - DNA, 536 bp, Homo sapiens
  misc_feature: GYAE6OF02HAWQH.21.55.E11.1.454.CMB.1.raw
  modified_base (400)..(400): a, c, t, g, unknown or other
  misc_feature (400)..(400): n is a, c, g, or t
  modified_base (528)..(528): a, c, t, g, unknown or other
  misc_feature (528)..(528): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagatcaccattattgccggacagtcacgacataactacttttaatgtatcagcacaaccaggaacgccccaagctctgatcgatgctgcatccaatttagagagtcgggtccatccgaggttcaggtcggacgagtggatcgtaggaactaaactttcacttctaccaccatcgagctagtctgacctaacctgtaagttntttacgactaactttactattacgtacaacgtagtaacttacagtttactttccctttactaccgtttccggccctagggacctagttacagtactacgaaacgtacgtgttacgctagacctacgtntcttcgtc

SEQ ID NO: 234740 - DNA, 582 bp, Homo sapiens
  misc_feature: GYAE6OF02HJ5IG.21.55.E11.1.454.CMB.1.raw
  modified_base (404)..(404): a, c, t, g, unknown or other
  misc_feature (404)..(404): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacagtcacgacataaacactttttaaatggtatcagcaacaaaccagggaagccccaaagctacctgatcgatgctgcataccaatttagagtagtgggtccagtccaggttcaggtggacgagtggatcgtagggactaaatttcacttctacaccatcagctagtctgactaactgtaaagtnttttagaccttaaactttactagttacgtactaaacgagtaacgtttacagtttactttaccctttactaaccgtttccggtacccttagggtaacccgtagttccgtaacgtaacgtaaccgaaacgtaacgttggtacggtacgttacgacctaacccgtattccgtactttaccg

SEQ ID NO: 234741 - DNA, 528 bp, Homo sapiens
  misc_feature: GYAE6OF02I1CSN.21.55.E11.1.454.CMB.1.raw
  modified_base (401)..(401): a, c, t, g, unknown or other
  misc_feature (401)..(401): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaactaccttttaaatggtatcagcaacaaaccagggaacggccccaaagcctctgatcgatgctgcatccaatttagagagtgggtcccagtccaggtcagtggcgatggatcgtagggaactaaatttcactctcaccatcagcagtctacgacaacgtgaagttntttagactaaccttatacttgtacaacagtacttactagttacttcctttactaccgtttcggccttagggacctagtccgtatactaccgaaacgtactgtcgtactgaccactacttctgttacc

SEQ ID NO: 234742 - DNA, 582 bp, Homo sapiens
  misc_feature: GYAE6OF02JAI3G.21.55.E11.1.454.CMB.1.raw
  modified_base (197)..(197): a, c, t, g, unknown or other
  misc_feature (197)..(197): n is a, c, g, or t
  modified_base (389)..(389): a, c, t, g, unknown or other
  misc_feature (389)..(389): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcacattattgccgacaagtcacgacataaactaccttttaaatgtatcagcacaaacgagggaacgaccccaaagctcctgactcgatgctgcatccaatttagagtagtcgggtacccatccgagttcaggtggacgagtggatcgaggaactaaactttcactctacacctatcagctagtcngacaacctgaacgttatttcgacttaacttatagttactacaactagtaacgtttacgagtttactttacctttacgtaccgtttacccggaccgttacggggtaacccgtagttcgtaacgtttaacgtaaccgtaaaccgtaacgttcgtacggtaccgtacggaccctaccgtaacttccgttagttccc

SEQ ID NO: 234743 - DNA, 698 bp, Homo sapiens
  misc_feature: GYAE6OF02ICYTC.21.55.E11.1.454.CMB.1.raw
  modified_base (225)..(225): a, c, t, g, unknown or other
  misc_feature (225)..(225): n is a, c, g, or t
tcagtcgtcgctcgcacgaccggtgctcgatttagcactcgcacgttgggtttgggggagtcgagtctcagtcaggacacagcatggacatgagggtcccgctcagctcctggggctcctgctactctggctccgaggtgccagatgtgacatccagatgacccagtctccatcatccctgtctgcatctgtcggagacagtaatcacctattagttgccggaanaagtcacgacataaacacctttttaaatgtatcagcaacaaacaggaacgcccaaaagtctacctgatcgatgctgcatccaaagtttagagaggtcggggtaccctaatacccgaggttacaggtcggcgaagttggaattcgtggggaaacctaaaattttccaactttcctacaaaccattaccaacggtactagttctcgaacctaaaaccgtgtaaaagtacgtttttagacctaaaacttttaacctaagttttgaaccttaaaaccgaagggtaacgtttaaactaacggtttaacttttcccctttttacgtaacccgtttttaccgggccccctttagggggaaacccccgttaaagggttcccgtaaattaacttaacccgtaaaaaccggtaaaccgtttcggttacgggggtcctaaccggggtaccttaacccccgtaatttacctcgggtttttaaccc

SEQ ID NO: 234744 - DNA, 571 bp, Homo sapiens
  misc_feature: GYAE6OF02JVC4R.21.55.E11.1.454.CMB.1.raw
  modified_base (198)..(198): a, c, t, g, unknown or other
  misc_feature (198)..(198): n is a, c, g, or t
  modified_base (406)..(406): a, c, t, g, unknown or other
  misc_feature (406)..(406): n is a, c, g, or t
  modified_base (411)..(411): a, c, t, g, unknown or other
  misc_feature (411)..(411): n is a, c, g, or t
tcagtcgtcgctcgcacgaccggtgctcgatttagcactcgcacgttgggtttgggggaggtcagtctcagtcaggacacagcatggacatgagggtccccgctcagctcctggggctcctgctactctggctccgaggtgccagatgtgacatccagatgacccagtctccatcatccctgtctgcatctgtcgganacagaatcaccattatttgccggtaacaagtcacgacataaacacttttaaatgtatcagcacaaaccaggaagcccaaagctacctgatcgatgctagcataccaaatttagacgtaggtcgggtcccatccaggttcagtggcgatggatcgtaggactaaatttcactctacgacactcagtacagtctcgacaaacctgaaatntttancctaaacttactattgtacaactaagtattaacgagttactttccttttacaccgttttaccgggccctagggggtaaccccgtaagtcgttaactacgttaaccaaaaggtaaccctggtaccgtacgttcgaacctaacctacgtaccttggttaccc

SEQ ID NO: 234745 - DNA, 507 bp, Homo sapiens
  misc_feature: GYAE6OF02FVDJK.21.55.E11.1.454.CMB.1.raw
  modified_base (393)..(393): a, c, t, g, unknown or other
  misc_feature (393)..(393): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaacaccttttaaatggtatcagcacaaaccagggaacgccccaaagctcctgatcgatgctgcatccaatttagagagtgggtcccatccaggttcagtggcgatggatcgtaggactaaagtttcactctcacatcagctagtctgcaacctgaagtntttagacttaacttactattgacaacgtagtagttacagttacttctttacactttcggcctgggacctagtcgatactacaaacgtactgtgctcgtaccactattctgttac

SEQ ID NO: 234746 - DNA, 625 bp, Homo sapiens
  misc_feature: GYAE6OF02JRQHA.21.55.E11.1.454.CMB.1.raw
  modified_base (194)..(194): a, c, t, g, unknown or other
  misc_feature (194)..(194): n is a, c, g, or t
  modified_base (368)..(368): a, c, t, g, unknown or other
  misc_feature (368)..(368): n is a, c, g, or t
  modified_base (514)..(514): a, c, t, g, unknown or other
  misc_feature (514)..(514): n is a, c, g, or t
tcagtcgtcgctcgcacgaccggtgctcgatttagcactcgcacgttgggtttgggggagtcagtctcagtcaggacacagcatggacatgaggtcccgctcagctcctgggctcctgctactctggctccggagtgccagatgtgacatccagatgacccagtctccatcatccctgtctgcatctgtcgganacagaatcacgattattgccggacaagtcacgacaataactaccttttaaatggtaatcgtagcaacaaaccgagggaacgaccccaaaagcctaccgtagacttacgattcggcttgactataccgtaaatttagacggtaaggtcgggtccaatccgaggttccaggtcggnagttacggattcggaggaacctaaatttccactctacacctactagacgcctaagtcgttcgaacaaccgttagaagttattttcgaccttaatacctagtttacgtaccaaagaagtagttaccgagtttaacttccgtttaccngttttacccggaccctttaggggtaacccgaggtacctacggttaaacctggtaaaaaccgtcctttgggaacgttttccgacggccaaaccgtagttccttaggttaccc

SEQ ID NO: 234747 - DNA, 549 bp, Homo sapiens
  misc_feature: GYAE6OF02HFJV3.21.55.E11.1.454.CMB.1.raw
  modified_base (337)..(337): a, c, t, g, unknown or other
  misc_feature (337)..(337): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagcctcctgatctataaggcgtctagttagaaagtgaggtcccatcaaggttcggnggcagtggatcgtgggacagaattcactctcacatcagcagcctgcagcctgatgtattttgacctaactttattactgacctaaactagtaataatttagttttaccgtagggtaccgttccggaccgtaaacggggacctaaagggtacggaactaacgtaacgaaaaccgtaacgttaggtacggtctacggaccaacctactcgttcg

SEQ ID NO: 234748 - DNA, 548 bp, Homo sapiens
  misc_feature: GYAE6OF02GT3A2.21.55.E11.1.454.CMB.1.raw
  modified_base (380)..(380): a, c, t, g, unknown or other
  misc_feature (380)..(380): n is a, c, g, or t
  modified_base (533)..(533): a, c, t, g, unknown or other
  misc_feature (533)..(533): n is a, c, g, or t
  modified_base (541)..(541): a, c, t, g, unknown or other
  misc_feature (541)..(541): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaacaccttttaaattggtatcagcacaaaccagggaagccccaaagctcctgatcgatgctgcatccaatttagagtagtcggggtccatccaggttcagtggcgatggatcgtgggactaaatttcactctcacatcagcagtcngcaacctgaagtattttgactaaacttactattacggtacaaactagtagttaacagtttaactttccctttctacctttccggcccttagggacccgtaagtcgaattaactacctaaaacgtacgttagttacggacttcggacctaaccnttaccgtnttacccg

SEQ ID NO: 234749 - DNA, 584 bp, Homo sapiens
  misc_feature: GYAE6OF02HICA8.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgccggacaagtcacgacataaactaccttttaaatgtatcagcacaacaggaacgacccaaagctcctgatcgatgctgcatacaatttagagagtcgggtcccatccaggttcaggtggcgtatggatcgtaggaactaattcactcacacatcaagctagtctgacaactgaatatttagacttaaactttactattcgaactaaacgtagtaatttaccgtagtttactttcccttttacgtaccgttttccgggaccccttagggtaacccgtaagttaccgtaacttaacgtaaccgtaaaaccggtaccgttagggtacggtaccttacggacccctaaccgtaacttccgttacgtttaccc

SEQ ID NO: 234750 - DNA, 518 bp, Homo sapiens
  misc_feature: GYAE6OF02H3FTT.21.55.E11.1.454.CMB.1.raw
  modified_base (491)..(491): a, c, t, g, unknown or other
  misc_feature (491)..(491): n is a, c, g, or t
  modified_base (514)..(514): a, c, t, g, unknown or other
  misc_feature (514)..(514): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaacaccttttaatggtatcagcacaacagggacgcccaaagctcctgatcgatgctgcatcctaatttagagaggtcgggtccagtccaggttcagtggcgatggatcgtagggaactaaatttcactctacacatcagcagtctgacctaactgaagttatttgactaacttactattgacaagtagagttaacagttacttcctttacaccgtttcggccctagggacctagtcgatactaacaacgtaacttgnggtacttagcctaacattccgtnttcc

SEQ ID NO: 234751 - DNA, 710 bp, Homo sapiens
  misc_feature: GYAE6OF02JKSI4.21.55.E11.1.454.CMB.1.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
tcagtcgtcgctcgcacgaccggtgctcgatttagcactcgcacgttgggtttgggggagtcagtctcagtcaggacacagcatggacatgagggtccccgctcagctcctgggctcctgctactctggctccgaggtgccagatgtgacatccagatgacccagtctccatcatccctgtctgcatctgtcganacagaatcacctattattgccgganaagtcacgacaataactacttttaaatgtatcagcaacaacgaggaacgacccaaagcctctagatcgatgctgcatcctaatttagagtaggtcggtcccagtccgtaggttccgagtcggtacgtagtcggtacgttcgtacggggtaaactaaacttttcccgactttaccgtactaacccgtaaattccgaacgtaccgtaacgttcctacggaacccgttaaaccgttaggtaaagtttaacgttttcgaaaccctttaaaccgtttacttaacgtttaccgtaactaaacccgttagttaaccgtttaacgttaacccggttaacttttttaccccgttttaccttacccgttttacccgggtacccgttaccggggtaaacccgtttaagtcccggtttaaatacccgttaacggtaaaccccgtaacgtttgggaccgttacccttcggaacccttacggtaactttccgttacgtttaccg

SEQ ID NO: 234752 - DNA, 597 bp, Homo sapiens
  misc_feature: GYAE6OF02GWTPB.21.55.E11.1.454.CMB.1.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (256)..(256): a, c, t, g, unknown or other
  misc_feature (256)..(256): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtctccatcatccctgtctgcatctgtcgganacagatcacctattattcgaccganaagtcacgacaataaactaccttttaaatgtancagacaacaaaccgagggaacgaccccaaagcctacctgactcgatgctgacatacctaaagtttagaggtacggtcgggtaccagtccgtaggttcgaggtggacgtagtcggatcgtaggtaactaatttcactctacacatcagctagtctagacctaacctaggaatttactttcgaaccttaactttacttagttacctaacaaacgtagtaactttaacgtacgtttacttttcctttacgtaaccgtttcccggacccgttagggaccttacgcgtaattactaaccgaaacggtcgtaggttacggcttacgcctaacctattccgtattacc

SEQ ID NO: 234753 - DNA, 525 bp, Homo sapiens
  misc_feature: GYAE6OF02G9ZDJ.21.55.E11.1.454.CMB.1.raw
  modified_base (397)..(397): a, c, t, g, unknown or other
  misc_feature (397)..(397): n is a, c, g, or t
  modified_base (514)..(514): a, c, t, g, unknown or other
  misc_feature (514)..(514): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaacaccttttaaatggtatcagcacaaaccagggaacggccccaaagctcctgatcgatgctgcatccaatttagagagtggggtcccatccaggttcagtggcgatggatcgtagggactaaatttcactctcaccatcagcagtctgacaacctgaaagtnttttagactaacttactattgtacaactagtagttacagttactttcctttctaccgtttcggcccgtgggacctaggtcgtatatacctaaacgtaactgtaggcttaggccaacncttctgttccc

SEQ ID NO: 234754 - DNA, 515 bp, Homo sapiens
  misc_feature: GYAE6OF02FHWP3.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgcggacaagtcacgacataaacaccttttaaatggtatcagcacaaacagggaagccccaaagctcctgatcgatgctgcatccaatttagagtagtgggtcccatccaggttcagtgcgatggatcgtgggactaaatttcactctcaccatcagcagtctgacaacctgaagtatttgactaacttactattgtactaacagtattacagttattcctttacacctttcggccttgggacctagtcgaattactaccaaacgtacttggtacgtctacgaccacctattacctgttacc

SEQ ID NO: 234755 - DNA, 545 bp, Homo sapiens
  misc_feature: GYAE6OF02FIZJ1.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaacaccttttaaatgtatcagcacaaacagggaagccccaagctcctgatcgatgctgcatccaatttagagagtcgggtccatccaggttcagtggcgatggatcgtgggactaaatttcactctacacatcagcagtctagctaacctgaagttatttcgacctaactttactaatttcgtactaacgtagtaacgtttacagtttactttaccttttacctacgttttccggacccgttagggtaacccgtagtcgtaataactacaaaccgtacgttgtacggctacgaccaccgtatctagttacc

SEQ ID NO: 234756 - DNA, 613 bp, Homo sapiens
  misc_feature: GYAE6OF02HYQG2.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacattattcgccggacaagtcacgacaataaactaccttttaaatgtatcagcaacaaaccgagggaacgaccccaaagcctcctgactcgatcgctgctactacctaagtttaggaggtacggtcggggtaccccagtcccgtagggttcaggtcggacgtaagtgggactcgtagggtaactaaacgtttccacttcctacacctactcgagtctagtctagacctaaccgtggtaaacgttattttacgaccttaaactttacttattacgtaactaacgtaggtaacgtttacgtaagtttactttcctttactccgtttccggacccgttagggaaccctagttcgaatactaaccgaaacgtcgttaggtcggtactcgacctaaccgtattccgtgttacc

SEQ ID NO: 234757 - DNA, 595 bp, Homo sapiens
  misc_feature: GYAE6OF02F9U5P.21.55.E11.1.454.CMB.1.raw
tcagtcgtcgctcgcacgaccggtgctcgatttagcactcgcacgttgggtttgggggagtcagtctcagtcagaacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaacaccttttaaatggtatcagcaacaaaccagggaacgccccaaagctacctgatcgatgctgcatccaatttagagagtgggtccatccaggttcagtggcgatggatcgtagggaactaaatttcactctcaccatcagcagtctgacaactgaagtatttagactaaacttactattacgtacaaacgtagtaacgtttacaacgtttaactttcccgttttactaaccgttttcccgggacccgttacgggggaacccgtaacgttccgtaaagtttacgttaacctaaaaccggttaacgttacgggttaggacccttggaacccgtaaccctaacgtttccttacggtttaccc

SEQ ID NO: 234758 - DNA, 537 bp, Homo sapiens
  misc_feature: GYAE6OF02IK6GY.21.55.E11.1.454.CMB.1.raw
  modified_base (341)..(341): a, c, t, g, unknown or other
  misc_feature (341)..(341): n is a, c, g, or t
  modified_base (532)..(532): a, c, t, g, unknown or other
  misc_feature (532)..(532): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgagacagaatcacctattatttgccggacaagtcacgacaataaactacttttaaatgtatcagcaacaaccgaggaacgaccccaaagctcctgatcgatgctgcatccaatttagagtagtcgggtccatccgtaggtcagtcggngatggatcgtagggaactaaatttcactctacacctatacagtcagtctacgacaacgtagtaagttatttgacttaactttactattgtacaacgtagtattactagttactttcttactactttccggccgttaggaccgtagtctagtactaaccaaagtacgtgtacgtctagtaccactacttctnttacc

SEQ ID NO: 234759 - DNA, 582 bp, Homo sapiens
  misc_feature: GYAE6OF02HZVBT.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcactccctgtctgcatctgtcggagacagaatcacattattcgccgacaagtcacgacataaactaccttttaatgtatcagcaacaaaccaggaacggcccaaagctactgactcgatgctgacactacctaatttagagtacgtgggtacccagttccgaggttcaggtggacgagtggactcgtagggtaactaaagtttcaactctacactactcagctagtctgaccaacctgaatagtttcgacttaactttactattgtaacaacgtagtattaacgtagtttacctttcctttaacctaccgtttccggacccgttagggaacccgttagtaccgtacttaacgacctaaaccggagtttacggacggttctacgacctaacccgatttacctcgttaccc

SEQ ID NO: 234760 - DNA, 620 bp, Homo sapiens
  misc_feature: GYAE6OF02GELYI.21.55.E11.1.454.CMB.1.raw
  modified_base (601)..(601): a, c, t, g, unknown or other
  misc_feature (601)..(601): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtctccatcactccctgtctgcatctgtcggagacagaatcacctattattgaccggacaagtcacgacaataaactaccttttaaatgtatcagcaacaaaccgagggaacgaccccaaagcctcctagactcgatgctgcatacctaatttagagtaggtcgggtccagtccgaggttcaggtcggacgtagtggatcgtagggtaactaaatttcacttctacacctatcagcctagtctagacctaactagtaagttatttacgacttaactttactatttacgtaacctaacgtagttaacgttacttagttaccttttccgtttaccttaaccgtttccggacccgttacgggtaaccgtagtaccgtaacttaaccgtaaccgtaaaccggtaacgttcggtacggtacctacgtaccctaacccgtntttaccgttcgtttaaccc

SEQ ID NO: 234761 - DNA, 542 bp, Homo sapiens
  misc_feature: GYAE6OF02HTCYB.21.55.E11.1.454.CMB.1.raw
  modified_base (218)..(218): a, c, t, g, unknown or other
  misc_feature (218)..(218): n is a, c, g, or t
  modified_base (227)..(227): a, c, t, g, unknown or other
  misc_feature (227)..(227): n is a, c, g, or t
  modified_base (250)..(250): a, c, t, g, unknown or other
  misc_feature (250)..(250): n is a, c, g, or t
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
  modified_base (411)..(411): a, c, t, g, unknown or other
  misc_feature (411)..(411): n is a, c, g, or t
  modified_base (440)..(440): a, c, t, g, unknown or other
  misc_feature (440)..(440): n is a, c, g, or t
  modified_base (532)..(532): a, c, t, g, unknown or other
  misc_feature (532)..(532): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgagacagaatcacattattgccganagtcacganaataactacttttaatgtatcancacaacaggagacccaanctcngatcgatcgctgcactacctaagtttagaggtaggttcgggtcccagttccgaggttacgaggtggacgtagtggattcgtagggtaactaaagtttcactcctacactatcagctagtctagacctacgtagaagttntttacgactaactttatattcgtaacaanagtacttacgtagttacctttacttactacgttcgcccgttagggacctagtcgtatacgtacaaacgtactggtcgtactcgacctacctnttctcgttcc

SEQ ID NO: 234762 - DNA, 583 bp, Homo sapiens
  misc_feature: GYAE6OF02FKB2Z.21.55.E11.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccgganaagtcacgacataaacaccttttaaatgtatcagcaacaaaccaggaacggccccaaagctcctgatcgatgctgcatccaatttagagagtgggtacccatccaggttcagtggcgatggatcgtagggactaaatttcgactctcaccatcagcagttcagtaccaacctgaaacgttattttacgacttaactttactaatttcgtaccaacgtaagtagtttaacacgttttactttacccgttttactacccgtttttcccggcccgttacggggtaaccccgttaggtcccgaagttaacaaccgtaaaacggtaacttcggtcggtactcggacctaccctacttcgtacgttcc

SEQ ID NO: 234763 - DNA, 563 bp, Homo sapiens
  misc_feature: GYAE6OF02HMKRN.21.55.E11.1.454.CMB.1.raw
  modified_base (197)..(197): a, c, t, g, unknown or other
  misc_feature (197)..(197): n is a, c, g, or t
  modified_base (413)..(413): a, c, t, g, unknown or other
  misc_feature (413)..(413): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcaccattattcgccggacaagtcacgacataaactaccttttaaatggtatcagcaacaaacgaggaacgcccaaagctacctgatcgatgctgcataccaatttagagtaggtcgggtcccagtcccgtaggttcaggtcggcgagtggatcgtaggaactaaatttcacttcacacatcagctagtctacgactaacctagaacttnttttacgaccttaactttactattacgtaacaacgtagtaacgttaacagtttacctttcctttactaccgtttccggcccgttagggacctagttcgtaataactacgaaacgtcttggactacgtcgacctacctatccgttgttacc

SEQ ID NO: 234764 - DNA, 687 bp, Homo sapiens
  misc_feature: GYAE6OF02I0EKN.21.55.E11.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (257)..(257): a, c, t, g, unknown or other
  misc_feature (257)..(257): n is a, c, g, or t
tcagtcgtcgctcgcacgaccggtgctcgatttagcactcgcacgttgggtttgggggagtcagtctcagtcaggacacagcatggacatgagggtccccgctcagctcctgggctcctgctactctggctccgaggtgccagatgtgacatccagatgacccagtctccatcatccctgtctgcatctgtcggagacagatcactattattgcggacaagtcacganaataaactacttttaaatggtatnacganaacaaacgaggaacgacccaaagctactgatcgatgctgctatacctaagtttagaggaaggttcgggtaccctattaccgtaaggttccaggtcggacggtagtggaactcgtaaggtaactaaatttccacgttcctacaacctataccagtccgtaagttcctacgaccttaaaccgtggtaaacgttacgtttacgaacccttaaactttaactagttttacgaaccaaagttacggtaacgtttaaaccgtacggtttaactttttaccccggtttcttaacccgttttacccggacccggtttaagggggtaaaccccgttaaggttacgtaaacgttcggttaaaacccgaaagggttaaacccgtgggttacccgtactttacggaacccgttaaccctaggtttacccttaggtttaaccc

SEQ ID NO: 234765 - DNA, 598 bp, Homo sapiens
  misc_feature: GYAE6OF02IJN9Z.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttcgaccggacaagtcacgacaataaactaccttttaaatgtatcagcaacaaacgagggaacgaccccaaagtctcctgactcgatgctgcatcctaatttagagtagtcgggtccagtccgtaggttcaggtggacgtagtggatcgtagggaactaaatttcacttctacacctatacagcagtctagaccaaccgtgaagttactttacgactaactttactattcgtaccaaatagtaagtttacaacgtttacttcccttttactaaccggttttcccggacccgttaggggtaacccgtaagttacggtaattaacgtaaccgtaaacgtacgttggtcggaccttacggacctaacctacgttccgttacgttaccc

SEQ ID NO: 234766 - DNA, 532 bp, Homo sapiens
  misc_feature: GYAE6OF02G98NE.21.55.E11.1.454.CMB.1.raw
  modified_base (398)..(398): a, c, t, g, unknown or other
  misc_feature (398)..(398): n is a, c, g, or t
  modified_base (521)..(521): a, c, t, g, unknown or other
  misc_feature (521)..(521): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaacacctttttaaatggtatcagcacaaaccagggaagccccaaagctcctgatcgatgctgcatccaatttagagtaggtcggggtcccagttccaggttcaggtggcgagtggatcgtgggactaaatttcactctcacatcagcagtctgcaactgaagtntttagactaacttactattcgacaacagtaacttactagttacttcctttactactttccggcccgtagggacctagttcgaattactaccgtaaacgtacgtggttagccttgacctacctnttcctgttacc

SEQ ID NO: 234767 - DNA, 633 bp, Homo sapiens
  misc_feature: GYAE6OF02F1XFU.21.55.E11.1.454.CMB.1.raw
  modified_base (291)..(291): a, c, t, g, unknown or other
  misc_feature (291)..(291): n is a, c, g, or t
  modified_base (421)..(421): a, c, t, g, unknown or other
  misc_feature (421)..(421): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaacctattattcgccggacaagtcacgacaataaactacttttaaatgtatcagcaacaaaccagggaacgccccaaagcctaccngatcgatgctgactactacctaagtttaggaggtacggtcgggtaccccagtaccgtaggttcaggttggacgtagtggatacggtagggaactaaagtttcactactaccaaccatcgagctacgttcncgactaaccgtagaacgttatttacgaccttaaatttccttaattcgtaaccaagtaagtaacgtttactaagtttactttcccgtttactaccggttttaccggacccggttacgggaacccgttaggttaccgtaattaaccgtaaacctaaacgggttaacttcggtaacggtactacgtaaccgtacctacgtttccgtacgtttacc

SEQ ID NO: 234768 - DNA, 581 bp, Homo sapiens
  misc_feature: GYAE6OF02FUHKU.21.55.E11.1.454.CMB.1.raw
  modified_base (221)..(221): a, c, t, g, unknown or other
  misc_feature (221)..(221): n is a, c, g, or t
  modified_base (290)..(290): a, c, t, g, unknown or other
  misc_feature (290)..(290): n is a, c, g, or t
  modified_base (411)..(411): a, c, t, g, unknown or other
  misc_feature (411)..(411): n is a, c, g, or t
  modified_base (432)..(432): a, c, t, g, unknown or other
  misc_feature (432)..(432): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctggtcggagacagaatcaccattattgccganaagtcacgacaataaactaccttttaaatggtatcaagcaacaaaccgagggaacgccccaaagctccngatcgatcgctcgactactacctaagtttagaggtacggtcgggtaccacgtccgtaggttccaggtacggcgtagtggacttcggtagggtaactaaagtttcaccttctacacactcancgtatcagacactagaagttnttacaccttaacgttattagtctaacaataggtacttactagttactttccctttacgtactttcccggacgttcgggaaccttaggtcaattacgtaacgtaacgtacttcggacgttcgtactaccctacgtacttcgtacgttacc

SEQ ID NO: 234769 - DNA, 598 bp, Homo sapiens
  misc_feature: GYAE6OF02IPTCZ.21.55.E11.1.454.CMB.1.raw
  modified_base (321)..(321): a, c, t, g, unknown or other
  misc_feature (321)..(321): n is a, c, g, or t
  modified_base (590)..(590): a, c, t, g, unknown or other
  misc_feature (590)..(590): n is a, c, g, or t
tcagtcgtcgctcgcacgaccggtgctcgatttagcactcgcacgttggggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgccggacaagtcacgacaataaactacctttttaaatggtatcagcaacaaaccgagggaacgccccaaagcctcctagatcgatgctgcatccaaatttagagnggtgggtcccatccgaggttcaggtggcgatggatcgtagggaactaaatttcacttctacaccatacagacagtctgaccaacctgaaacttatttcgacttaaacctttattattagactaaacgtagtaactttaacgagtttactttaccctttactaccgtttccggaccccgttaggggaaccctaaggttccgtaattaaccgtaaccgaaaaccggtaacgttcggtacggtcttacggaccctaaccctaagtttccgtntttacccg

SEQ ID NO: 234770 - DNA, 533 bp, Homo sapiens
  misc_feature: GYAE6OF02G6JZE.21.55.E11.1.454.CMB.1.raw
  modified_base (397)..(397): a, c, t, g, unknown or other
  misc_feature (397)..(397): n is a, c, g, or t
  modified_base (524)..(524): a, c, t, g, unknown or other
  misc_feature (524)..(524): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaacaccttttaaatggtatcagcacaaaccagggaagccccaaagctcctgatcgatgctgcatccaatttagagagtcgggtcccatccgaggttcaggtggcgagtggatcgtagggaactaaatttcactctcacatcagcagtctgacaacctgaagtntttacgactaacttactattgtacaaacgtagtagttactagttactttccgtttacctacgtttccggacccgttagggaccgagttccgtataactactaaacgtacgtgtagtctcgactaccntccgtgtcc

SEQ ID NO: 234771 - DNA, 610 bp, Homo sapiens
  misc_feature: GYAE6OF02GYVQO.21.55.E11.1.454.CMB.1.raw
  modified_base (221)..(221): a, c, t, g, unknown or other
  misc_feature (221)..(221): n is a, c, g, or t
  modified_base (227)..(227): a, c, t, g, unknown or other
  misc_feature (227)..(227): n is a, c, g, or t
  modified_base (253)..(253): a, c, t, g, unknown or other
  misc_feature (253)..(253): n is a, c, g, or t
  modified_base (285)..(285): a, c, t, g, unknown or other
  misc_feature (285)..(285): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagatcacctattattgccgganagtcanacataaactacttttaatggtatcanacaacaaacgagggaacgacccaaagcctccngatcgatgctgcactacctaagtttagagtaggtcgggtccagtccgaggttcaggtcggacggtagtggtaacgttcgtaagggtaacttaaacgtttcacttcctacacctataccgagacctacgtctacgaccgaacctagtagttaacgtttacgacttaaactttacttattatacaacgttagtaacgttaactagtttacttttaccgttacttaccggtttaccgacccggtaggtaaccgtaggttaaccctaagttaactaaccgaaaacgtacgttaggcgtacgtacacctaaccgtattccttacgttacc

SEQ ID NO: 234772 - DNA, 532 bp, Homo sapiens
  misc_feature: GYAE6OF02HL9CM.21.55.E11.1.454.CMB.1.raw
  modified_base (425)..(425): a, c, t, g, unknown or other
  misc_feature (425)..(425): n is a, c, g, or t
  modified_base (482)..(482): a, c, t, g, unknown or other
  misc_feature (482)..(482): n is a, c, g, or t
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattcgccgacaagtcacgacataaactacctttttaaatgtatcagcaacaaacgagggaacgaccccaaaagctcctgatcgatgctgcatccaatttagagtagtgggtccatccgagttcagtgcgagtggatacgtggaacaaatttcaactctcacatcagctagtcctgaccaactagaattactttagactaacttactattgacaanagtattaacagttacttcctttacacctttcggcctacgggacaaggttcaacgtanaaccgtaaacgtaacttggtcgacttcgacctacgtcttaccttgttacc

SEQ ID NO: 234773 - DNA, 552 bp, Homo sapiens
  misc_feature: GYAE6OF02HOV4A.21.55.E11.1.454.CMB.1.raw
  modified_base (439)..(439): a, c, t, g, unknown or other
  misc_feature (439)..(439): n is a, c, g, or t
  modified_base (542)..(542): a, c, t, g, unknown or other
  misc_feature (542)..(542): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaactcacctattatttgaccggacaagtcacgacataaactaccttttaatgtatcagcaacaaacgagggaacgccccaaagctacctgactcgatcgctgctactacctaagtttagagtaggtcgggtcccataccgaggttacaggtggacgtagtggatcgtagggaactaaatttcgactctaccaactatcagtcagtctgacctaactagaatatttcgactaactttanattagacaagtagtattaacagtttacttctttactaccgtttcggaccgttcggacctagtcgtaataactacaaacgtactgtacggctacgacctacctnttctgttacc

SEQ ID NO: 234774 - DNA, 557 bp, Homo sapiens
  misc_feature: GYAE6OF02GDUPX.21.55.E11.1.454.CMB.1.raw
  modified_base (123)..(123): a, c, t, g, unknown or other
  misc_feature (123)..(123): n is a, c, g, or t
  modified_base (166)..(166): a, c, t, g, unknown or other
  misc_feature (166)..(166): n is a, c, g, or t
  modified_base (187)..(187): a, c, t, g, unknown or other
  misc_feature (187)..(187): n is a, c, g, or t
  modified_base (216)..(216): a, c, t, g, unknown or other
  misc_feature (216)..(216): n is a, c, g, or t
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (389)..(389): a, c, t, g, unknown or other
  misc_feature (389)..(389): n is a, c, g, or t
  modified_base (417)..(417): a, c, t, g, unknown or other
  misc_feature (417)..(417): n is a, c, g, or t
  modified_base (435)..(435): a, c, t, g, unknown or other
  misc_feature (435)..(435): n is a, c, g, or t
  modified_base (532)..(532): a, c, t, g, unknown or other
  misc_feature (532)..(532): n is a, c, g, or t
tcagtcgtcgctcgcacgaccggtgctcgatttagcactcgcacgttgggtttgggggagtcagtctcagtcaggacacagcatgacatgaggtcccgctcagctcctgggctcctgctactntggctccgaggtgccagatgtgacatccagatgacccagttcnccatcgactcccttgcctgantctgtcggaacagtaatccaccattattnccggaacaagtcaacgacaataaacacttttaaactgtatctaagcaacaactaaggaacggccaaagctacngtancgtatgactgactactacaaatttgaacgtaggtagggtcccctaatccgtaaggtccaagttccggagaacgtgatccgtagggactaaacgttntacctcgacacctatcaaagcgatcgtnaacctcaagattacgttntaacacttataactgttccaaagacgtattagacttagtaccctttcaactttcggaacctcggacgtataggtactaactaccgaactatggtttnacgcgtaccaatactcttagttccc

SEQ ID NO: 234775 - DNA, 539 bp, Homo sapiens
  misc_feature: GYAE6OF02HL5CK.21.55.E11.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccgganaagtcacgacataactaccttttaaatgtatcagcaacaaccagggaacgccccaaagctcctagactcgatgctgcataccaatttagagtagtcgggtaccagtccaggttcagtggacgagtggatcgtaggactaaattcactctcactatcagcagtctgctaacgtgaatatttcgactaacttactattcgtacaagtagtattactagttactttcctttctaccgtttcgcccgttagggacctagttccgtaattactaccaaacggtactggtcgtactacggacctaaccgtattccgtgttaccc

SEQ ID NO: 234776 - DNA, 609 bp, Homo sapiens
  misc_feature: GYAE6OF02JAQUT.21.55.E11.1.454.CMB.1.raw
  modified_base (344)..(344): a, c, t, g, unknown or other
  misc_feature (344)..(344): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaactacttttaaatgtatcagcacaaccagggaacgccccaaagctcctgactcgatgctgctatcctaatttagagagtcgggtccagtccgtaggttcagtcggacgngtggatcgtagggaactaaactttcacttctcacctatccagcctagttcctacgacctaaccgtagtaaacgttacgttttacgacttaaacgtttacttattcgtaactaaacgtagtacgtttaactagtttacctttacctttacgttaaccgtttccggtacccgttagggtaaccgtacgttacgtaacttaacgtaacccgtaaaacggtaacttcggtagtaccgtgtacccctaacgtacgttacgttcgttaccc

SEQ ID NO: 234777 - DNA, 732 bp, Homo sapiens
  misc_feature: GYAE6OF02HX995.21.55.E11.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagcactcgcacgttgggtttgggggagtcagtctcagtcaggacacagcatggacatgagggtcccgctcagctcctggggctcctgctactctggctccgaggtgccagatgtgacatccagatgacccagtctccatcatccctgtctgcatctgtcggagacagatcacctattattcgaccggtanaagtcacgacataaactaccttttaatgtatcagacacaaacgagggaaccgacccgaaagcctaccgtagactacgatgctgactactacctaagtttacgaggtaggtcgggtacccctagttaccgtaaggtttcgtaacggttcggacgtagtacggtacgtacggtaacgggtaaacttaaacgtttacctaaccttaccgtaccaacgtaacgtaccgacgacgtacgttactacgtaaacccgaaccgttaggtaaacgtttacgttttaccgaccttaaaccgtttaaccgtttaagttaccgtaaccgtaacgttaaacgggttaactttaaccggtaaccgttttaacttacccgtttttaccgtaaccgttttccggtacccggttaacgggtaacccgttaacgttacggaacgttccttaaaccggaaaccgttaacgttcggttaccggtaacgttccggaaccttaaccgttctttacggttacgtttaacccg

SEQ ID NO: 234778 - DNA, 698 bp, Homo sapiens
  misc_feature: GYAE6OF02GL5U6.21.55.E11.1.454.CMB.1.raw
  modified_base (230)..(230): a, c, t, g, unknown or other
  misc_feature (230)..(230): n is a, c, g, or t
tcagtcgtcgctcgcacgaccggtgctcgatttagcactcgcacgttgggtttgggggagtcagtctcagtcaggacacagcatggacatgagggtccccgctcagctccgtgggctcctgctactctggctccgaggtgccagatgtgacatccagatcgacccagtcctccatcatccctgtctgcatctgtcggagacagactcacctagttacgttcgaccggaanaagtccaacgactaattaaacctacttttaatgtactcagacaacaacgaggaacgacccaaagcctaccgtagactcgatcgctcgactacgtacctaagtttaggaggtacggtaccgggtaccctacgttccgtaacgggttacgaggttcggtacgtagtacggtactacgtagggtaacttaacgtttcccgaacttctacgtaaccgtacttccgaacgtcctacggtacctacgacctaaacgtacggtaaacgttacgttttacgaacctttaacgttacttacgtacgtaacgtaacgtacgtaacgtttactacgtttactttcccgtttaacgtcccggtttcggacccgttaacgggtaccgtaacgtaccgtaacgttaacctaaccggtaaaccgttacgttaggttaccggtactacgtacccgttaaccgtcgttaccgttcggtttaaccg

SEQ ID NO: 234779 - DNA, 626 bp, Homo sapiens
  misc_feature: GYAE6OF02IYR4K.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagatcacattattgccgacaagtcacgacataaactacttttaaatgtatcagcacaaaccgaggaacgcccaaagctcctgatcgatcgctgcactacctaatttagaggtagtcggggtcccagtccgaaggttcaaggtcggacgtagtggacttcgtagggtaactaaagtttcaacttcgtaccaacctaatccaagcctacgttctacgaccgtaaccttaggaaacgttcgttttagaccttaaactttacttagtttacgtaacaaactaggtaactttaacgtaagtttaccgtttacttttacctaccgttttaccggtacccgttaggggaacccgtagttacgtaacgttaactaaccgtaaaacgtaccgttaggttacggacttacggacctaccgtacttccgttcgttacc

SEQ ID NO: 234780 - DNA, 702 bp, Homo sapiens
  misc_feature: GYAE6OF02JFU8F.21.55.E11.1.454.CMB.1.raw
  modified_base (198)..(198): a, c, t, g, unknown or other
  misc_feature (198)..(198): n is a, c, g, or t
  modified_base (220)..(220): a, c, t, g, unknown or other
  misc_feature (220)..(220): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtcctccatcatccctgtcctgcatctgtcganacagatcacattattcgccganaagtcacgacataaactacttttaatgtatcagacaacaacgaggaacgaccaaacgtctacctagatacgatcgctgactactactaagtttagagtacggtccggggtacctacgtaccgtacggttaccgtaggttcgggaccgtaaggtacgggtagtaccggtaaggggtaaaccttaaacgtttccgtaaccttaccgttaccaacctacgtaccgaagtaaccgtacgtaccgttacgacccgttaaacgtaggtaaagttacgtttaaccggtaacttaaacctttactttaacgttacgtaactaaacgtaacgttaacgtttaacctaacgtttacttttaccgtttaccgttaaccgttcccggttaccgtacgggtaacccgttaggttacgtaagttaacctaacgttaaacggtaacgttcggtacggtaccgttacgaccctaaccggactttacgtccggttaacc

SEQ ID NO: 234781 - DNA, 604 bp, Homo sapiens
  misc_feature: GYAE6OF02JX03Z.21.55.E11.1.454.CMB.1.raw
  modified_base (276)..(276): a, c, t, g, unknown or other
  misc_feature (276)..(276): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacattattgccgacagtcacgacataactacttttaatgtatcagcacaaccgaggaacgacccaagctcngatcgatgctgacatactaagtttagagtaggtcgggtccagtccgaggttcaggtgcgagtggatcgtaggtactaattcactctacactatcagcagtcacgactaaccgtgtaagttatttacgacttaacttacgttaactttcgtaaccctaaagtaacgtaacgtttaactacgtttaactttaccctttttaacgacccgtttttccgggaaccccgtttaggggtaacccgtaaggttaccgtaacgttaaacgttaccgaaaaccgttaacgttacggtaggtccgttagaccctaacctacgttaccgttatttaccg

SEQ ID NO: 234782 - DNA, 620 bp, Homo sapiens
  misc_feature: GYAE6OF02H115U.21.55.E11.1.454.CMB.1.raw
  modified_base (223)..(223): a, c, t, g, unknown or other
  misc_feature (223)..(223): n is a, c, g, or t
  modified_base (254)..(254): a, c, t, g, unknown or other
  misc_feature (254)..(254): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaactcacctattattgccgganaagtcacgacataaactaccttttaatgtancagcaacaacaggaacgcccaaagctcctgatcgatgctgcatcctaagttagagtagtcgggtccagtccgaggttcaggtggcgtatggatcgtaggactaattcactctacacatcagctagtctagaccaaccgtgtaagttatttacgacttaaccttaattacttacgtaacctaaacgtacgttaacgttaacgtaacgtttacctttacccgtttacttaaccggtttcccggtacccggttacggggtaacccgttaacggttaccgtaaacgttaccgtaaaccgtaaaccggtaacgttcggttacgggtaccgttacggaccctaacccgtacgtttccgttacgtttaccccg

SEQ ID NO: 234783 - DNA, 579 bp, Homo sapiens
  misc_feature: GYAE6OF02FJ11H.21.55.E11.1.454.CMB.1.raw
  modified_base (276)..(276): a, c, t, g, unknown or other
  misc_feature (276)..(276): n is a, c, g, or t
tcagtcgtcgctcgcacgaccggtgctcgatttagcactcgcacgttgggtttgggggagtcagtctcagtcaggacacagcatggacatgagggtccccgctcagctcctgggctcctgctactctggctccgaggtgccagatgtgacatccagatgacccagtctccatcatccctgtctgcatctgtcggagacagatcaccattattgccgacagtcacgacataactaccttttaaatgtatcagcacaacaggaacgcccaagctcgtnatcgatcgctgacactacctaaagtttagagtaggttcggggtaccctagtcctaggttcaggtggacgagtggatcgtagggaactaattcactctacaccatcagctagtctcgacctaacctgaacgttatttcgacttaaacgttacttaagtttgtaccaaactagttaacggtttactacgtttaaccttttcctttaccgttaccttttaccggcccgttagggaacccgttagttaccggattaacgtacctaaaaccgtacgtcgtggactacgacctacccattcgtcgttac

SEQ ID NO: 234784 - DNA, 615 bp, Homo sapiens
  misc_feature: GYAE6OF02HUB84.21.55.E11.1.454.CMB.1.raw
  modified_base (263)..(263): a, c, t, g, unknown or other
  misc_feature (263)..(263): n is a, c, g, or t
  modified_base (302)..(302): a, c, t, g, unknown or other
  misc_feature (302)..(302): n is a, c, g, or t
tcagtcgtcgctcgcacgaccggtgctcgatttagcactcgcacgttgggtttgggggagtcagtctcagtcaggacacagcatggacatgacgggtccccgctcagctcctggggctcttgctactctggctccgaggtcgccagatgtgacatccgagatacgacccagtcctccatcactccctgtctgcatcgtggcggagacgaatcacctattattgacgacagtcacaactattaaacttacttttaatgtatcanacaacaaccgagggaaccgacccaagtcctctgatacgngtgctacgcatacgtaagttagaggtaggtcggtacctagtccgttagtccgaggtcggcggagtaggtacgtacggtacggtaacttaaacttcctacctcaccgtacctatccgagtactacgtcacgaacctaacgtagtaacgttcttacgaacctttaacttacttaatcgtaaacaaccgtgtaaagttctaacgtttcctttacgttcttaccgttcggaccgtaggtaaccgtagtacgtacttaaccgtacgtaaacctggtacgtcgcttacgctaaccgttgttccgttacgtaccgtttac

SEQ ID NO: 234785 - DNA, 667 bp, Homo sapiens
  misc_feature: GYAE6OF02GVO4A.21.55.E11.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagatcactattattgccganaagtcacgacaataaactaccttttaaatgtatcagacaacaaaccgagggaacgaccccaaagtcctaccctagactacgatcgctgctatacctaagtttagagtaggtcggtaccagtccgtaaggttcaggtcggacgtaagtcggtactcggtaagggtaaccttaaagtttccaaccttctaccacctagtccgacgactacgtactacgacctaaccgtaggtaagttaacgtttttacgaacctttaaaccgtttacttaacgttacgtaactaaaccgtaagttaaccgtttaactagtttaccttttccgtttaccttaccgttttccggacccgttaggggtaacccgtagttaccgtaagttaaccttaacggaaacccgttaacgtcggttacggtacttccggaaccctaaccgtagtttcccgttagttaccc

SEQ ID NO: 234786 - DNA, 574 bp, Homo sapiens
  misc_feature: GYAE6OF02IWQVE.21.55.E11.1.454.CMB.1.raw
  modified_base (223)..(223): a, c, t, g, unknown or other
  misc_feature (223)..(223): n is a, c, g, or t
  modified_base (256)..(256): a, c, t, g, unknown or other
  misc_feature (256)..(256): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattcgccgganaagtcacgacataaactacttttaatgtatcancacaacgaggacgacccaagctctgatcgatgctgctactcctaagtttagagtacggtagggtacccagtccgtaggttcgaggtggcgagtggatcgtaggtaactaattcacttcctacacctatcagtctacgtctacgacctaaccgtagtaagttatttacgaccttaaactttacttattacgactaacgtagttaacttacgtattactttcctttactaccgttttccgacccgttagggacctacgtacgtaacgtactaccgaaacgtacgttggtacgtctcgacctaccgtatccgttagttccc

SEQ ID NO: 234787 - DNA, 768 bp, Homo sapiens
  misc_feature: GYAE6OF02JFRXU.21.55.E11.1.454.CMB.1.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
  modified_base (235)..(235): a, c, t, g, unknown or other
  misc_feature (235)..(235): n is a, c, g, or t
  modified_base (392)..(392): a, c, t, g, unknown or other
  misc_feature (392)..(392): n is a, c, g, or t
  modified_base (578)..(578): a, c, t, g, unknown or other
  misc_feature (578)..(578): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtctccatcatccctgtctgcatctgtcgganacagaatcactattattcgaccgganaagtcaacganaactaaactaccttttaaatggtatactagactaacaaaccgaggaacgacccaaacgtctacctagactacgtatacgcgtacgactacgtaaccttaatttaaggacgtaagggtcggggtaccctaacggtccgtaaggttccgtaggtacggngtaagtacggtacgttagtaacgggtaaactaaactttaccgtaacctacgttaccaacctacttaacgacggtaacctaacgggtcttaaccggtaaccgaaaccctttaaggtaaaccgtttaacgttttacggtaaacccttaaacgttttaaaccgttacgtttacgtaacgttaaaaccgnggttaaaaccgtttaacgttaaaccggtttaacttttaacccgttttaccgttaaacccgggttttcccgtaacccgggtttaaccgggtaaccgttaaccgggttacgtaaccgttaaaacggttaaccgtaaaacgttaaccgttacgtacggtacgtcggtacctaacgacttccgttaacgttccg

SEQ ID NO: 234788 - DNA, 714 bp, Homo sapiens
  misc_feature: GYAE6OF02HH6SF.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaactcacctattagttcgaccggacagtcacgactaataaactacttttaaatggtatcagcaacaaaccgagggaacgaccccaagcctacctgatacgatgctgctactacctaatttagagtacggtcgggtacccagtccgtaggttacaggtcggacgtagtagggtacttcggtacgggtaaacttaagtttccgtaccttacctacctaaccctacgtacgaacggtactaacggttcctacggaacctaaccgtaagttaaacgttacgtttttacgaacctttaaaccgtttacgttaacgtttaccgtaactaaacgttacggttaaacgtttaacgtaagttttaacccttttacccgttttaacccgtttaccggttttacccgggtccccgttaaccggggttaaccgtaccggttaacgttaacgttaactaaaccggtaaaaccggtacgtttacggtaggtccgttacgaccgtacctacgtttacgttgttacccg

SEQ ID NO: 234789 - DNA, 667 bp, Homo sapiens
  misc_feature: GYAE6OF02HFR59.21.55.E11.1.454.CMB.1.raw
  modified_base (223)..(223): a, c, t, g, unknown or other
  misc_feature (223)..(223): n is a, c, g, or t
  modified_base (251)..(251): a, c, t, g, unknown or other
  misc_feature (251)..(251): n is a, c, g, or t
  modified_base (278)..(278): a, c, t, g, unknown or other
  misc_feature (278)..(278): n is a, c, g, or t
  modified_base (280)..(280): a, c, t, g, unknown or other
  misc_feature (280)..(280): n is a, c, g, or t
  modified_base (338)..(338): a, c, t, g, unknown or other
  misc_feature (338)..(338): n is a, c, g, or t
  modified_base (417)..(417): a, c, t, g, unknown or other
  misc_feature (417)..(417): n is a, c, g, or t
  modified_base (651)..(651): a, c, t, g, unknown or other
  misc_feature (651)..(651): n is a, c, g, or t
  modified_base (662)..(662): a, c, t, g, unknown or other
  misc_feature (662)..(662): n is a, c, g, or t
tcagtcgtcgctcgcacgaccggtgctcgatttagcactcgcacgttgggtttgggggaggtcagtctcagtcaggacacagcatggacatgagggtcccgctcagctcctggggctcctgctactctggctccgaggtgccagatgtgacatccagatcgacccagtctccatcatccctgtctgacatctggtcgagacagaatcactattattcgcgaanagtcagacaataactactttaatgtatnagacacaacgaggacgaccaagctcananacgatgctagctatacgtaatttagacggtaggtcgggtacctagtaccgtaggttanacggtgacgtagtaggtacgtacgtaggtaactaaacgtttcaactttccgtaacactactacgatacgtataccgtanaccgtaacttaagtaatttacgtttaacggacttaactttaaccgttatacggtaaccaagtaaacggttacgtaagtttaaccgttaccttttaccgtttaaccgtccggttttaacccggcccgggttaacgggtaaacccggttacgtttaacgtaaaccggtaacttaaacccggaaccggtttaaaccgttgggtaacccggtttcgtaaccggactaaaccccgtttnttacccggttntaccc

SEQ ID NO: 234790 - DNA, 676 bp, Homo sapiens
  misc_feature: GYAE6OF02GMDU6.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacaagaactcacctattattcgccggacaagtcacgacataaactacttttaaatgtatcagcaacaaacgagggaacgaccccaaaagcctaccgtagactacgatgctgacatacctaaatttagaggtaggtcgggtaccataccgtaggtacaggtggacgagtggatcgtaggaactaattcacttacactacatacacgtcacgtctacgacctaaccgtagtaaacgttactttacgaacctttaaacgtttactaacgtttacggaacctaaaccggttaagttaaccgtttaacgttaacgtttaccttttacccgttttacgttaacccgtttttcccgggaacccgttacgggtaaacccggttaacggtaccgttaaagttaaccgttaaaccgtaaaacccgggttaacgttaggtaccggttactacggtacccgttaacctaacgtttacgttaccgttacccg

SEQ ID NO: 234791 - DNA, 707 bp, Homo sapiens
  misc_feature: GYAE6OF02IE26R.21.55.E11.1.454.CMB.1.raw
  modified_base (139)..(139): a, c, t, g, unknown or other
  misc_feature (139)..(139): n is a, c, g, or t
tcagtcgtcgctcgcacgaccggtgctcgatttagcactcgcacgttgggtttgggggagtcagtctcagtcaggacacagcatggacatgagggtccccgctcagctcctgggctcctgctactctggctccgaggtnccagatgtgacatccagatcgacccagtcctccatcactccctgtctgctagtcgtggtacggagaacagtactcacctatttacgttcgaccggactaagtcaccgaataacttaaaaccttaacctttttaaattggtaacttcgaacgacaaaccgaaacgaacgggaacggaccccaaaagtccctaccgtagacgtaccgtagtacgtccgttagaccgtaaccttaccgttaaagtttaggtaaacgggtacggttaccgggggtaccctacgttaccggtaaggttaccgaggtgggacgtagtaggtacgtacgtacggaacttaacttcgtactccgtacaacctacgtacctaagtaccgtacgtagtaccgtaccgtaacgtacgttaagtttaacgttttactaccgttaaactttctaacgtttaacgaacttaacgaagtttactaacttagtttaccttaccgttttctaccgtttcgaccggttacgaccgtatacggtataacgtaacgtacgtagtggtacgtctcgtaccaccgtagttcctacgttcc

SEQ ID NO: 234792 - DNA, 713 bp, Homo sapiens
  misc_feature: GYAE6OF02IO1TX.21.55.E11.1.454.CMB.1.raw
tcagtcgtcgctcgcacgaccggtgctcgatttagcactcgcacgttgggtttgggggagtcagtctcagtcaggacacagcatggacatgagggtcccgctcagctcctggggctcctgctactctggctccgaggtgccagatgtgacatccagatgacccagtctccatcatccctgtctgcatctgtcgagacagaatccactattattcgaccggacaagtcacgacaataaactacttttaaatgtatcagcaacaaccgagggaacgaccccaaagtctccgtagatcgatggctgacaataccaatttagagtaggtcgggtacccagtccgtaggttcgagtcggacgtagtcggactcgtagggaaactaaacgtttccaaccgttctaccgaacctagtaccgagtacgtacgttactacgaccgtaaactaggtaaacgtttacgtttttacgaacctttaaaccgttttactaacgttttaccgtaaaccgtaaactaaggtttaacgtttaaccgttaaacgttttaccctttttacccgttttacccgtttaaacccggttttcccggggtaaaccccgtttaacggggggtaacccttaaacggttaccgtaaacggtttaactaaacccggtaaaacggttacttacgggttcgtaccgttaccgaccttaaccggtactttccgttacgttaccc

SEQ ID NO: 234793 - DNA, 661 bp, Homo sapiens
  misc_feature: GYAE6OF02H4B4F.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaactcacctattattcgaccggacaacgtcacgacaataaacttacctttttaaatgtatcagacaacaaaccgagggaacgaccccaaagtcctacctagatcgatgctgacctactacctaaagtttacggaggtacggtccggggtacctacgttaccgtaagggttcagggtacggacgtaaggttcggaacgtttacgtaacggggtaacttaaacttttccaaccgtttcctaccaactacgtaccacgtactacgttacctacgtaccaaaccgttagtaaacgtttacttttacgacctaaacgtttactacttgtaaccaagtaggtaattactaagtttcttacctttacgaccgtttcccggaccgttagggtaacctagttccgaattacgtaacctaaacgtccgttggtaccgacttccgacctaccgttactacgttccgttacc

SEQ ID NO: 234794 - DNA, 672 bp, Homo sapiens
  misc_feature: GYAE6OF02JZGHQ.21.55.E11.1.454.CMB.1.raw
  modified_base (356)..(356): a, c, t, g, unknown or other
  misc_feature (356)..(356): n is a, c, g, or t
tcagtcgtcgctcgcacgaccggtgctcgatttagcactcgcacgttggggtttgggggagtcagtctcagtcaggacacagcatggacatgagggtcccgctcagctcctggggctcctgctactctggctccgaggtcgccagatgtagacatccagatgacccagtctccatcactcctgtctgacatcgtggtcggagacagaactcactattcgttcgaccgaataacgtcaacgactaacttaacctacttttaatggtaactcagactaacgaaacgtagggaaccgtaccctaagccttacgtagaactcggaatggtactcgactacgttacctaaagtttaacggnggtacggtcgggttaccagtaccggtagggttacagggcggtacgaaggttggtaactcggtaacggtaactaattccgacttcctacgtaaccagttccgaagttaccgtacgttccgtagaccttaaacgtaggtaaactttgtttcgaaaccttaagtttccattacgaacgtaagaacttacggtactacgtttaaccttccgtttaaacttcggttcccggaacgttacggtaactacgtacgtaactaccgtaaccgtaacgttaacgtcgaacggttccttacgaccgttaataccgttgtacgttacc

SEQ ID NO: 234795 - DNA, 721 bp, Homo sapiens
  misc_feature: GYAE6OF02JW7VW.21.55.E11.1.454.CMB.1.raw
  modified_base (212)..(212): a, c, t, g, unknown or other
  misc_feature (212)..(212): n is a, c, g, or t
  modified_base (227)..(227): a, c, t, g, unknown or other
  misc_feature (227)..(227): n is a, c, g, or t
  modified_base (714)..(714): a, c, t, g, unknown or other
  misc_feature (714)..(714): n is a, c, g, or t
tcagtcgtcgctcgcacgaccggtgctcgatttagcactcgcacgttgggtttgggggacgtcagtctcagtcaggacacgagcgatggacagtcgaggggtccccgctcagctcctggggctcctgcctactctggctccgaggtcgccagtatcgtagaccatccgagatcgaccctgtcctccatcatccctgtctgacatctgtcganacagtactcaacgtnttacgtcgaccgtaacaggtcaacgactaagttaacttaccttttaaatcggtatacagtaccaacaaaccggacgggaaccggtacccaaagtccgtaccgtagacgtacgtagtcgtcgtacggacctaacgttacctaaagtttagacggtacgggtaccgggttacccaagttcccgtaaggttaccgaggttcggacgtacgtcggtaacgttacgtacgggtaactaactttccgaactcgtacccgaactaacgtcgaacggctacgtaccgttacgaccgttaaccgacgttaagttaaccgttttcggaaacctttaacgttaccttaagttaccgaacgtaactaggttaacgttacgtacgttcctttaccgtttacgtaccgttccggaccgttacgggaaccgttagttaccgaacgttacttaaccggaacgtacccgtggtccgtactacggtaccctaacggtcttccgtntttaccc

SEQ ID NO: 234796 - DNA, 907 bp, Homo sapiens
  misc_feature: GYAE6OF02GZZQB.21.55.E11.1.454.CMB.1.raw
tcagtcgtcgctcgcacgaccggtgctcgatttagcactcgcacgttgggtttgggggagtcagtctcagtcaggacacagcatggacatgagggtcccgctcagctcctggggctcctgctactctggctccgaggtgccagatgtgacatccagatgacccagtctccatcatccctgtctgcatctgtcggagacagaatcaacctattagttcgaccggacaagtcacgaacaataaacttaaccttttaaatggtatacagacaacaaacgaggaacgacccaagcctacctagactacgactcgcgtacgctactacctaagttagacggtacggtaccggggtaccctacgtaccgtacggttacgtagggtcggacgtagtacggtacttacgtaagggtaaactaaacgtttaccgtaccgtttacctacccgtaacctaacgttacaacgtacgttacgttaccgttaacgtaaccccgttaaacggtaacgttaaaacggtttaaccgtttttaaccggtaaaccctttaaaccgttttaaaccgtttaaacgttttaaccgttaaacccgtaaacgttaaccggtttaaaaccgttttaaaccgttaaaccggttttttacccgtttttttaaaccccgttttacccgggttttaaaccccgtttttaaccccggggtaaccccggttttaacccggggggtaaaacccggtttaacccgggttaaacccggtttaaaacggtttaaaaccccggtttaaaaccccgggttaaaaaccgggtttaaaccccgggtttaacgggggtttaacccggtttaacccggttcccggttaaaccccggttaaaccccgtttaaacccggtttccgggtttttaaccccgttttaaccccg

SEQ ID NO: 234797 - DNA, 653 bp, Homo sapiens
  misc_feature: GYAE6OF02GIFHU.21.55.E11.1.454.CMB.1.raw
  modified_base (195)..(195): a, c, t, g, unknown or other
  misc_feature (195)..(195): n is a, c, g, or t
  modified_base (265)..(265): a, c, t, g, unknown or other
  misc_feature (265)..(265): n is a, c, g, or t
tcagtcgtcgctcgcacgaccggtgctcgatttagcactcgcacgttgggtttgggggagtcagtctcagtcaggacacagcatggacatgagggtcccgctcagctcctgggctcctgctactctggctccgaggtgccagatgtgacatccagatgacccagtctccatcatccctgtctgcatctgtcgganacagaatcactattattgccgacaagtcacgacataaactacctttttaaatgtatcagtcaacaaacgngggaacgccccaaagcctacctgactcgatgctgcatccaattagagaggtcgggtccagtccaggttccagtcggacgtagtggtactacgtcgggaacttaaagtttccaactccgtacaacccattaccaaggtccacgtcttacgacccttaacgttagaaacggttattttacgaccttaaacgttttacctaagtttactacctaaaacgtacgtaagtttacgaaacgttttactttaccccgttttagttaacccgttttcccgggaacccggttttacggggaacccgttaagttccgttaaagttaacccttaaaccggtaaacgttaccgttggttacgaccgttcgtaccgtaccgtacgtttcgaccggtttacc

SEQ ID NO: 234798 - DNA, 729 bp, Homo sapiens
  misc_feature: GYAE6OF02IRPHN.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctggtcgagacagactcacctattattcgaccggacagtcacgacaataactacttttaatgtatcagacaacgaaccgagggaacgacccaaagccttacgtgactacgatcgctgactactacctaagtttaggaggtacggtccgggtacctagtcgtaggttacgaggtcggacgaggtcggtactacggtagggtaacttaagtttccaccgttcctacctaaccgtacgtaccgacgtaccgtagttaccgtacgtaacctaacgttaaggtaacgtttaacgttttacggtaaccttaacgtttaacttactttaccgtaacgtaaacgtacggtttaactttaccgtaacgtttttaaccttttacccgttttaccttaacccggggtttcccggtaaccccgggttaacggggtaaccgttacggtaaccgttagttaaaccgttaaacccgttaaaaccggtacggttacgggtaaccggttaccgtaccggacctttaaacccgtcgtttaccggttaaccgtttacccg

SEQ ID NO: 234799 - DNA, 689 bp, Homo sapiens
  misc_feature: GYAE6OF02H0PJJ.21.55.E11.1.454.CMB.1.raw
  modified_base (153)..(153): a, c, t, g, unknown or other
  misc_feature (153)..(153): n is a, c, g, or t
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccggaggtgccagatgtgacntccagatcgacccagtctccatcactccctagtctgcatcgtgtcgganacagactcactattacgttcgaccganacgtcaacgaactaactaaacttaacttttaagtgtactcacacaacgaaccgagggaaccgtacccaaagtcctacctagtactgactcgactacgaccttactacgttaagttacgaggacggttccgggtaccacttaccggaggttctagggtggtacgagttacggtacgtaaggtaccggtaaactttaacgtttaccactttacctacctaccgtataccgacgtacgtacgttccgtaacgtaccgtaacgttaggtaacttacgttaaccgtacttaaccttaacgttataccgaactaagtacgttaacgttaaccgtttacgtttaaccctttaacgttcccgttacgttcccggaaccggtacggtaaccgtcgtaacgtacgtaaactaccggtaacgacggttagtcgtacccgtcgtaccgaccgttagttccgtacgtttaccc

SEQ ID NO: 234800 - DNA, 664 bp, Homo sapiens
  misc_feature: GYAE6OF02FPE5T.21.55.E11.1.454.CMB.1.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagactcacctattattcggccgganaagtcacgacaataaactacttttaaatgtatcagcaacaaccgaggaacgccccaaagcctacctgactcgatcgctgactatacctaaagttttagagtacggtcgggtacctatccgtaaggttcaggtggcagtggtatcggtaagggttaaaaactttccgaacttccgtacctaacctacgttacaacgacctaacggtcgtacgacctaaaccgttggaaacgttacgttttagaaccctaacttttacgttattacgtactaaacgtagtaacgtttaactagtttaccttttaccgttaccgttacgtttcccggtacccggttagggtaacccgtagttaccgtagttaacttaaccggaaaacgttaccggtagttaccggtacgttacgacccgttaacctacgttcccggttacgttacccttaccg

SEQ ID NO: 234801 - DNA, 1041 bp, Homo sapiens
  misc_feature: GYAE6OF02GKU49.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccggaggtgccagatgtgacatccagatcgacccagtctccatcactccctgtctgcatcgtggtcggagacagtaactccacctagtttacgttcgaccggaataacgtccaacgactaacttaaaaccttaacctttttaaagtcggttaactaccgacgtaccaaaccgtaaaaccggtaggggaaaccggtacccccgaaaagtccctttaccgtacggtaaccgttaccggaacgttccggtaccgttacggtaacctaaaccgtttacccgttaaaaggtttttaacgggaacgggttacgggggtttacccgggggttaacccccttaacgtttacccgggttaacgggttttaccgaacggggttacggggtaaccgttaaggtttaacgggtaaaccgtttaccggggttaaaccgggggttaaaacccttttaaaaccgttttacccggtaaacccgtttaccccgtttaaaccctaaaccccgttaacgtaacccgaaccggttaaccgttaaccggtttcccgtaacgaaccccggttaaaccgttaaggtaaacgttttacgttttaaccgtaaacccttttaaacccgttttaacgtttaaccgttttaacccgtaaacctaaaacggttaaccggttaaaccggttttaaaccttaaaccgggtttttaaccctttttaccccgggttttttaaacccgttaaacccccgggtttttacccgggaaccccgggtttaacggggttaaccccggtttaacggttaaccggttaaccgtttaaacccggtaaaacccggttaaaacccggttaccggttacgggttaacccggtaaccggttcccgtaaacccggttaaacccgtacggtttttacccgttaccgggtttaacccc

SEQ ID NO: 234802 - DNA, 740 bp, Homo sapiens
  misc_feature: GYAE6OF02JLVJT.21.55.E11.1.454.CMB.1.raw
  modified_base (193)..(193): a, c, t, g, unknown or other
  misc_feature (193)..(193): n is a, c, g, or t
  modified_base (253)..(253): a, c, t, g, unknown or other
  misc_feature (253)..(253): n is a, c, g, or t
  modified_base (726)..(726): a, c, t, g, unknown or other
  misc_feature (726)..(726): n is a, c, g, or t
tcagtcgtcgctcgcacgaccggtgctcgatttagcactcgcacgttgggtttggggagtcagtctcagtcaggacacagcatggacatgaggtcccgctcagctcctgggctcctgctactctgctccgagtgccagatgtgacatccagatgacccagtcgtccatcatcccgtgtctgcatctgtcgganacagatcaccattattcgaccggacacggtcacgacactaaactaccttttaatcggtancagacacaacgaggaacgtcccaaagcctcagtactcgtactggctacgtactactacctaaagtttagacggtacggttacggggtaccctagtacccgttaacgggttactaacgggtacgggtaccgtaagtacgggttaacgttaccggttaacgggggaaacctttaaaacggtttcccgaaacgttttacccgaccgtaaacccgtaccgtttacgaacggttaccccgtacgggttaccgtaccggtaacgtaacccgttacggaaacggttttacgtttaaccgtacgtttaaaacccgttacgttaacgttacggttaaccgtaaccgtaaggttaaccgttaccgttaaagttccctttaccgtttacgttaaccgttcggtacccgtgggtaaccttacgtaccgtaacgttaaccgacgttaaacggaccgttaggtcgaccgtttcgacctaaccgttcncgtttacctacccg

SEQ ID NO: 234803 - DNA, 728 bp, Homo sapiens
  misc_feature: GYAE6OF02IDWUW.21.55.E11.1.454.CMB.1.raw
tcagtcgtcgctcgcacgaccggtgctcgatttagcactcgcacgttgggtttgggggagtcagtctcagtcaggacacagcatggacatgagggtcccgctcagctcctggggctcctgctactctggctccgaggtgccagatgtgacatccagatgacccagtcctccatcactccctgtcctgctatcgtgtcggagacagaatcactattattcgcggacagtcacgaactaactaacttaaccttttaatcggtactacgacacaacgaaccgagggaaccgacccgtaaagtcctaccgtagaacgtcgtagtcgtctacgtacctaagttacctaaagtttacgagggtacggtccgggtacccaacgttaccgtaggttaccgtaggtacggtcgtagtacggacgttacggtaacgggtaaacttaacgtttcaactttccgtaacctacctactacgaacgtacgtcggtaccgtacgaccgtaaaccgttacggtaacgtttacgttttaaccaacttaaaccgtttacgtagtttaccaaacgtaacgttaagttaacgtttaacgtacttttaacgtttcccgtttaacgtacccgtttccggtaacccggttacgggaaccgttacggtacttaacgtaacttaacccggaaacgttacggttcggtaacgtccgtaacggtaccctaccggttaacttccgtagtttacccg

SEQ ID NO: 234804 - DNA, 724 bp, Homo sapiens
  misc_feature: GYAE6OF02F8R7S.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcactccctgtctgcatctggtacggagacagactcactattattcggccgacagtcacgaactaacttaaaccttaacctttttaagtggtactcacgacaaccgaaaccgaggggaaccgaccccaaagtcctccgtagtactcggtatcggtctgacctacttaccgttaaaagtttacgggaggttacggggttcccggggtaccctacgttaccggttaacgggttacgtacggggttcggaccgtaaggtcgggtaacgttccgggtaaacgggtaacttaacctttacgaccctttctaacctaacctacgtaccacggtactacgtccgtacgaaccgttaaccgtaagtaacgtttatttaacgtaaccttaactttacttaacgtacgtaactaacgtaggttaacgttacttacgttttaccctttaccgtttaccttaccgttcccggtacccggttacggtaaccgtacgttacgtaacgttaactaacgttaaaccgtcgtacggtcggtacgtcgaccgtacctcgttctcgttacc

SEQ ID NO: 234805 - DNA, 642 bp, Homo sapiens
  misc_feature: GYAE6OF02GUQXA.21.55.E11.1.454.CMB.1.raw
  modified_base (197)..(197): a, c, t, g, unknown or other
  misc_feature (197)..(197): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagatcactattattgccgacagtcacgacataaactacttttaaatgtatcagcaacaaaccgagggaacgacccaaagcctacctgactcgatgctgctactacctaaagtttagagtacggtcggggtacccagttaccgaggttcaggtggtaccgagttacgggattacggtacggggtaaacttaaacgtttaccgtaccttaccgtacctaaccctataccgaacggtacctacggttacccttacggaacccttaaacgtacgttaaaggtttctttacggaacctttaacttaacgttattacgtaccaagtacgtaacgttactacgtttactttccctttacgtccttaccggtccgtacggtaccgtacgtcgtaacttaaacgtactaaaccgtagttcgtggtacctcgacctacgtacttcgtcttacc

SEQ ID NO: 234806 - DNA, 740 bp, Homo sapiens
  misc_feature: GYAE6OF02IPYPA.21.55.E11.1.454.CMB.1.raw
  modified_base (141)..(141): a, c, t, g, unknown or other
  misc_feature (141)..(141): n is a, c, g, or t
  modified_base (150)..(150): a, c, t, g, unknown or other
  misc_feature (150)..(150): n is a, c, g, or t
  modified_base (242)..(242): a, c, t, g, unknown or other
  misc_feature (242)..(242): n is a, c, g, or t
tcagtcgtcgctcgcacgaccggtgctcgatttagcactcgcacgttgggtttgggggagtcagtctcagtcaggacacagcatggacatgacgggtccccgctcagctcctggggctcctgctactctggctccgaggtnccagatgtnacatccagatcgacccagtcctccatccactccctgtctgctatcgtggtcgaagacaagtaatccaacctatttacgttcggaccggtaanacgttacgaacgtaactaaacttaaaccttacctttttaaaagtggtatacctaacggacctaaaccgaaaaacggaggggtaaaccgaccccgtaaaagtcccgttaccgtaggtactaccggtattcggacctacgtacctagtaccttaaagttaggacgtaacgggttccggtacccaagtacccgttaggtacgtcggtaggactaggtacggtacgtaccggtaagtaacttaaatttccgaactttccacgtaactcgtacacgtactacggtctacgacgtaacctagtaacgttattcgaaccttacgttacacttacggtaaccaaacgttaacgtacttaacggttactttactttacctttcgggttacccttaccgggccgttaacggaccggtttacgtaccggttaatacccgttaaccggtaaacgtacccgtttaggaccggttactacgaacccttacgtactttaccgtcgtttaaccc

SEQ ID NO: 234807 - DNA, 776 bp, Homo sapiens
  misc_feature: GYAE6OF02FHUDL.21.55.E11.1.454.CMB.1.raw
  modified_base (171)..(171): a, c, t, g, unknown or other
  misc_feature (171)..(171): n is a, c, g, or t
tcagtcgtcgctcgcacgaccggtgctcgatttagcactcgcacgttgggtttgggggagtcagtctcagtcaggacacagcatggacatgagggtccccgctcagctcctgggctcctgctactctggctccgaggtgccagatgtgacatccagatcggacccagtccnccatcactcctgtctgcattcgtcggtacggagaaccagtaacgtccaaaccttagtttactcggaccggaactaacgcgacgaactaacgttaaaccttaacctttttaaagtcggtaactccgtaacgacctaaaccgaaaccggtaacggggaaaccggtaccccctaaacgtccgttactacggtaacgtaccgtagtcgtaccgtacgtactaaaccgttaacgttaaacgttaacggacgggttacggtacccgggtaccctaacggttcccggtacggttcgaacggggttcggtaacgtacggtaacggtacgtaccggtacggtaaacttaacgttcccacgtacctccaacgtacacgtacgactacggtactcctaccgtactaaggtaaccttagtttaccaacgtttaattaaccgtattaccgtactaacgttacgtaacgtttaactaccgtttaacttcccgtttaccgtcgtttaccggtaaccggttaggtaccgttacgtacgtaaccgttaaccgtaacggttaaacgtacgtaggttacccgacgtttaccgacccgttaaccttacggttacgttacgtaccg

SEQ ID NO: 234808 - DNA, 681 bp, Homo sapiens
  misc_feature: GYAE6OF02I2Y39.21.55.E11.1.454.CMB.1.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatccactattattcgaccggacaagtcaacgacactaaactacttttaaatgtatacagacaacaaaccgagggaacgaccccgaaagtcctaccgtagatacgactgctgacactacctaagtttagagtacggtacgggtaccctacgtccgtaggttcaggtcggacgtagtggtatcgtagggaactaaactttcactactaccacatcaagtcctagtccgtagacctaacgtaggtaaagttatttacggaacttaaaccgtttacttaacgtttacgtaaccgaaagttaggttaaactttaccgtaagttttaaccgtttaccttttaccgttaaccgttttcccggaacccgttaggggtaacccggttaacggttacgtaacttaaacgtaccggtaaaaccggttaaccgttgggtaaccgtaccgttacggaacccttaccgttacggtttaccgttccgttaaccg

SEQ ID NO: 234809 - DNA, 650 bp, Homo sapiens
  misc_feature: GYAE6OF02HTVZE.21.55.E11.1.454.CMB.1.raw
  modified_base (473)..(473): a, c, t, g, unknown or other
  misc_feature (473)..(473): n is a, c, g, or t
  modified_base (635)..(635): a, c, t, g, unknown or other
  misc_feature (635)..(635): n is a, c, g, or t
tcagtcgtcgctcgcacgaccggtgctcgatttagcactcgcacgttgggtttgggggagtcagtctcagtcaggacacagcatggacatgagggtcccgctcagctcctggggctcctgctactctggctccgaggtgccagatgtgacatccagatcgacccagtcctccatcatccctgtctgctatctggtcggagacagaatccactattattcgaccgaacaacgtcaacgactaactaaacttacctttttaaatggtatcagacaacaaaccgagggaacgaccccaaagcctaccgtagatcgaatcgctcgacactacctaaagtttagaggtaggtccgggtacctacgtccgtaggttcgtaggtcggacgtagtcggtacttcgtagggtaaactaaacgtttcgaccttctacccacactacacgactacgtctacgtacctaaccgtagtaaacgttntttacgtaaccttaaacttttacgtagttcgtaactaacgtagttaacgttactaacgttttactttacctttccttaccggtttcccgacgttacgggaccgtagttcgaacgtaactaaccgtaaacgtacgttacgcggtactacgtacctaacccgtnttaccgttgttaccg

SEQ ID NO: 234810 - DNA, 605 bp, Homo sapiens
  misc_feature: GYAE6OF02FP7SU.21.55.E11.1.454.CMB.1.raw
  modified_base (188)..(188): a, c, t, g, unknown or other
  misc_feature (188)..(188): n is a, c, g, or t
  modified_base (226)..(226): a, c, t, g, unknown or other
  misc_feature (226)..(226): n is a, c, g, or t
  modified_base (269)..(269): a, c, t, g, unknown or other
  misc_feature (269)..(269): n is a, c, g, or t
  modified_base (429)..(429): a, c, t, g, unknown or other
  misc_feature (429)..(429): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtcctccatcactccctgtctncatctggtcgagacagactcactattattcgaccgganagtaccacgaactaacttaaactaccttttaaagtgtatcganacaacaacgaggacgacccaagctccagatcgatgctgcactactaattagaggtaggtcggtccagtaccgtagttcagtcggacgtagtcggatcgtaggtactaattcgactcacacctagccagtctacgttcgagacctaaacgtgtaaagtttntttacgaccttaacttacttacttagtaaccgtaacgtacgttaagttaccttaatttcttttacctttacgtccgtttaccggccgtaccggtacgtacgtaccgtagttactaaccgtaaaccggttacgttcgtacggtactaccgttacgacctttagtcccttagttaccc

SEQ ID NO: 234811 - DNA, 648 bp, Homo sapiens
  misc_feature: GYAE6OF02FVI83.21.55.E11.1.454.CMB.1.raw
  modified_base (223)..(223): a, c, t, g, unknown or other
  misc_feature (223)..(223): n is a, c, g, or t
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaactcacctattattgccgganaagtcacgacataaactacttttaaatgtatcagcaacaaaccgaggaacgacccaagctccngatcgatcgcngactactacctaatttaggagtaggtcgggtcctacgtccgtaggttcgaggtggacgagtggatacggtaggtaacttaaactttctacctcctaccgaacctataccacggtacctagtcctacgaccctaaacggtagtaaccgttattttaacgaccttaaacgtttaccttaagtttaccgtacgtaaaacttacggttaacgttaaccgtaacttttaaccgttttccccttttaacgttaccgttttacccggaccccggttacgggtaaccctagttaccggtaattaaccgtacaaacggttacgtggttaccgacttcggacctactacgttcctcgttac

SEQ ID NO: 234812 - DNA, 752 bp, Homo sapiens
  misc_feature: GYAE6OF02JRALP.21.55.E11.1.454.CMB.1.raw
  modified_base (124)..(124): a, c, t, g, unknown or other
  misc_feature (124)..(124): n is a, c, g, or t
  modified_base (455)..(455): a, c, t, g, unknown or other
  misc_feature (455)..(455): n is a, c, g, or t
  modified_base (472)..(472): a, c, t, g, unknown or other
  misc_feature (472)..(472): n is a, c, g, or t
  modified_base (726)..(726): a, c, t, g, unknown or other
  misc_feature (726)..(726): n is a, c, g, or t
  modified_base (743)..(743): a, c, t, g, unknown or other
  misc_feature (743)..(743): n is a, c, g, or t
tcagtcgtcgctcgcacgaccggtgctcgatttagcactcgcacgttgggtttggggggagtcagtctcagtcaggacacagcatggacatggacgggtccccgctcagctccgtggggctccngctactcgtggcctccggaggtgcccagagtggtgaccacgtccaggatcgaccctagtcctcctatccacttccccgttgtcctggtaccagttccgtcgggtacggaacgtaccgaaggtaacctcctaaccttaagtttaccgttccggaccggtaacgtaacgtaccgaacgtacgtaaaacttaaacctttaacctttttaaagtacggttactaacgaacgtaaccaacgaaacggtaacgggaaaccgacccgtaaaggtccttacgcgactcggactcgctacgaccacttacgttattaacgaggtacgggtaccggtaccnctacggtaggtctacgngtacgtaaggtcgttacgtacggtaggtaactaacgttcctaacgtccctataacccgtagtactaacgccggtaacggttctaacggaccttaacggtaagttaccgttacgttactaaacttaagtacttataaccgtctaacgtacggttactaacgtaacgtttccgttaccgttacgtttccggtaacgtccggtaagccggttactacggtacgttaacaaccgttacgtctacggtacttccgaacnccgttaacctgttaccnccgtttacg

SEQ ID NO: 234813 - DNA, 580 bp, Homo sapiens
  misc_feature: GYAE6OF02FOP78.21.55.E11.1.454.CMB.1.raw
  modified_base (222)..(222): a, c, t, g, unknown or other
  misc_feature (222)..(222): n is a, c, g, or t
  modified_base (437)..(437): a, c, t, g, unknown or other
  misc_feature (437)..(437): n is a, c, g, or t
tcagtcgtcgctcgcacgaccggtgctcgatttagcactcgcacgttgggtttgggggagtcagtctcagtcaggacacagcatggacatgagggtccccgctcagctcctgggctcctgctactctggctccgaggtgccagatgtgacatccagatgacccagtctccatcatccctgtctgcatctgtcggagacagaactcacctattattcgccganagtcacgacataaactacttttaatggtatcagcacaaaccgaggaacgaccccaaagcctcctagactcgatcgctgactactacctaagtttagagtaggtcgggtacccagtccgtagttcaggtggactagtggtactcgtacggaactaaatttccacttctaccaacctataccacgtctacgttcacgacctaaccgtagaacgtttnttttacgaccttaaccttacttacttagacaaacgtagtacgttactacgttactttcctttactacgtttccgccgttagggacctagtacgattaacgtacaacgtacgtggtacgcgtacgacctactattcctgttacc

SEQ ID NO: 234814 - DNA, 795 bp, Homo sapiens
  misc_feature: GYAE6OF02HZ9VB.21.55.E11.1.454.CMB.1.raw
  modified_base (140)..(140): a, c, t, g, unknown or other
  misc_feature (140)..(140): n is a, c, g, or t
  modified_base (154)..(154): a, c, t, g, unknown or other
  misc_feature (154)..(154): n is a, c, g, or t
  modified_base (202)..(202): a, c, t, g, unknown or other
  misc_feature (202)..(202): n is a, c, g, or t
  modified_base (565)..(565): a, c, t, g, unknown or other
  misc_feature (565)..(565): n is a, c, g, or t
tcagtcgtcgctcgcacgaccggtgctcgatttagcactcgcacgttgggtttgggggatcagtctcagtcaggacacagcatggacatgacgggtccccgctcagctccgtggggctcctgctactcgtgctcgaggtnccagatcgtgaacnctccgagacgtcgacccagttctcctagtcctactcccgttgttccgnaccgtatccgtaggtccggaataacgagaactacctacgtaatttcgttccggaccggaataacgtccacgtaactaacttaaacctttaacgtttttaaagtcgtataccgtaacgaccgtaaaccgaaacggtaacggggaaccgtaacccctaaaaggccttacccgtaagggtactaccgggtatcggtacgtttaccggacgtaaccttacggttaaaaaccgttaggtaacgggaccgggttaccggtaccgtaacgttaccggtaacgggtcttaacgggcgggtacgtaacgttcgggtaacttacgggtaaaccggtacttaacggtttccacgttccctaacaacgtctaacncgtaacgtctacgtacgtaacgtactacggtaattcgttactaccggttaaacttcgttactactaacctaagtaaccgttacgttagttaccgttaacttcccgtttcgttaccgtcggttaacccgtacggttaaccgtacgttaccgtaactaacgtaccgtaacgttaaccgttacggaccgttacggtcctacggttaacccttggtacccgttcgtttaaccgg

SEQ ID NO: 234815 - DNA, 632 bp, Homo sapiens
  misc_feature: GYAE6OF02J0M9E.21.55.E11.1.454.CMB.1.raw
  modified_base (149)..(149): a, c, t, g, unknown or other
  misc_feature (149)..(149): n is a, c, g, or t
  modified_base (168)..(168): a, c, t, g, unknown or other
  misc_feature (168)..(168): n is a, c, g, or t
  modified_base (208)..(208): a, c, t, g, unknown or other
  misc_feature (208)..(208): n is a, c, g, or t
  modified_base (213)..(213): a, c, t, g, unknown or other
  misc_feature (213)..(213): n is a, c, g, or t
  modified_base (334)..(334): a, c, t, g, unknown or other
  misc_feature (334)..(334): n is a, c, g, or t
  modified_base (479)..(479): a, c, t, g, unknown or other
  misc_feature (479)..(479): n is a, c, g, or t
  modified_base (608)..(608): a, c, t, g, unknown or other
  misc_feature (608)..(608): n is a, c, g, or t
tcagtcgtcgctcgcacgaccggtgctcgatttagcactcgcacgttgggtttgggggagtcagtctcagtcaggacacagcatggacatgagggtccccgctcagctccgtggggctcctgctactctggctccgaggtgccagatgngacatccagatcgaacccngtcctcctatccactccctgtctgactatcgtggtcgaanacganactcactatttagtcggaccggaatacgtcaacgactaactaaacctttaacttttaagtgtatcacgacaaacgaaaccggaggggaaccgaccccgaagttcctaccgtagtacacgtntacgacgtcgactacctacttaaaggttaggacgtgggttcccggtacctacgacgttagtcgtagtacggctagtggactacggtagtaacttactcgacttaccacactatcgagtcgatacgtcgaactaacgtgaacgttnttacgtaccttagttacctagttacgaactaaacgttggtaactttaccgttaattaccgttttccccgttaagttcccgttaccgtcggtacgtaaccgttagtctaacgtctaacgaattgtcggtntacgctatactacgttctgtaccc

SEQ ID NO: 234816 - DNA, 767 bp, Homo sapiens
  misc_feature: GYAE6OF02JRH34.21.55.E11.1.454.CMB.1.raw
  modified_base (143)..(143): a, c, t, g, unknown or other
  misc_feature (143)..(143): n is a, c, g, or t
  modified_base (174)..(174): a, c, t, g, unknown or other
  misc_feature (174)..(174): n is a, c, g, or t
  modified_base (226)..(226): a, c, t, g, unknown or other
  misc_feature (226)..(226): n is a, c, g, or t
  modified_base (554)..(554): a, c, t, g, unknown or other
  misc_feature (554)..(554): n is a, c, g, or t
  modified_base (579)..(579): a, c, t, g, unknown or other
  misc_feature (579)..(579): n is a, c, g, or t
tcagtcgtcgctcgcacgaccggtgctcgatttagcactcgcacgttggggtttgggggaggtcagtctcagtcaggacacagcatggacatgacgggtcccgctcagctccgtgggctcctgctactctggctccgacggtnccgagatggtgacactccagactcgaccccngttcctaccatacgaccttcccgttgtctcgctacgtcgtgggtaccggtanacgtataactccaccttagtttacgttccggaccggactaaacgtcaacgtaactaaacttaaaccgtttaacttttaacgttagtaactcataccgaaacaacggtaacgggaaccggtaaccaacggccttaccggatacgaccggtatcgtcgtacaccgtactacggttaacttaggacggtacggtaccggaccacgttacgtacggttaggacggtcggagtaggtcgtaacgtacggtacgtacctaacgtcctaacgtctaccgtacgtaactacggctaacgtcgactacgtaaccgtaactcggttaatttacgttanaacccttaacgtttactacgtttanaacccgtagttaaacgttacgttaacgttaccgtttaccctttacgtttcccgttaacccgtacgggtacccttacgggaaacccttcgttaaacggttccttaaactaaccggttaaaccgtccggtttaggtccgtaacccggttctaacccggttccctttaacggttaccgttcgttaaccccg

SEQ ID NO: 234817 - DNA, 183 bp, Homo sapiens
  misc_feature: GYAE6OF02HNPOQ.21.55.E11.1.454.CMB.1.raw
  modified_base (168)..(168): a, c, t, g, unknown or other
  misc_feature (168)..(168): n is a, c, g, or t
  modified_base (178)..(178): a, c, t, g, unknown or other
  misc_feature (178)..(178): n is a, c, g, or t
  modified_base (181)..(183): a, c, t, g, unknown or other
  misc_feature (181)..(183): n is a, c, g, or t
tcagtcgtcgctcgcacgaccggtgctcgatttagcactcgcacgttgggtttgggggagtcagtctcagtccaggacacagcatggacatgagggtccccgctcagctcctgggctcctgctactctcggctccgagtgccagatgtgacatccagatcgaccatcnccatcatccngtnnn

SEQ ID NO: 234818 - DNA, 670 bp, Homo sapiens
  misc_feature: GYAE6OF02IXX8F.21.55.E11.1.454.CMB.1.raw
  modified_base (208)..(208): a, c, t, g, unknown or other
  misc_feature (208)..(208): n is a, c, g, or t
  modified_base (339)..(339): a, c, t, g, unknown or other
  misc_feature (339)..(339): n is a, c, g, or t
  modified_base (402)..(402): a, c, t, g, unknown or other
  misc_feature (402)..(402): n is a, c, g, or t
  modified_base (410)..(410): a, c, t, g, unknown or other
  misc_feature (410)..(410): n is a, c, g, or t
  modified_base (416)..(416): a, c, t, g, unknown or other
  misc_feature (416)..(416): n is a, c, g, or t
  modified_base (454)..(454): a, c, t, g, unknown or other
  misc_feature (454)..(454): n is a, c, g, or t
tcagtcgtcgctcgcacgaccggtgctcgatttagcactcgcacgttggggtttgggggagtcagtctcagtcaggacacagcatggacatgacgggtccccgctcagctccgtggggctcctgctactcgtggctccggaggtcgccgagatgtagacactccagatcgaaccctgttcctcaactcactcccgttgacttcgactntccgttgacgagacaagtactacctactaatttcgttacggacccggaataacgtaccgaacaactaaactaaacctttattttaaagtggtactacagaccaacaaacggtaggacacccaagcctatanacgtacgactgcacacactaactaagtttcgaggacggttcggctaactcggtacgtagtagnggaacgtnacggtnttacgagtaaacttagtaccatcctaacgtcacgttanacggtacgtacgttcacgtacgtaacgtaccgtaagtttaccttaacgtaactacctttaggtatttacgaacacgtaagttaccgtaattacggttactttacccgttaacgttcccgttaccggtaaccgttacggtaaccgttaccggttactacgttaacctaagaccgttaagtccgtagtcgtacgtacctaaccgtcttcgtacttacc

SEQ ID NO: 234819 - DNA, 760 bp, Homo sapiens
  misc_feature: GYAE6OF01CJ5JU.3.48.E04.1.454.CMB.1.raw
  modified_base (224)..(224): a, c, t, g, unknown or other
  misc_feature (224)..(224): n is a, c, g, or t
  modified_base (241)..(241): a, c, t, g, unknown or other
  misc_feature (241)..(241): n is a, c, g, or t
tcagagacgcactccacgaccggtgctcgatttagagagcgtcacagagagaagggctgggcctcaggaagcagcatcggaggtgcctcagccatggcatggatccctctcttcctcggcgtccttgcttactgcacaggatccgtggcctcctatgagctgactcagccacctcagtcgtccgtgtccccagggccagacagccaccgtcacctgctctgganataattggatcaaaatntgacttcctggtttcagtcagactccgaggccaggtcccctgtgcctggtccatcgtttacaagtactaccgaagtccgtacccctgagggtactcccgtagaacgtccgtaattccgtcgtacgggtccttacccgtaacgtccgttacggggaaaccctacgtacgtcccgtaacgttccgtaacggacccctaacgtcccggtaaacgggtacccggggtaacccctaggggtacccttaacgggtacgggtaaccgttccgggtaaacgggtccctttaacgggtaaccctttaacggtttaacccgtcgggttaaccgtaccggggtaccggttaccggggaaccttacggggtcccgggtaccgggtacccttaaccggttacccgtaaacggtttaccggttacccgggggtacggttaaccgggggtaaccctaaacgggtcccgttacgggttaaccccggttccgttaacggggttacccaacggggtacccccgtaagggttccccgg

SEQ ID NO: 234820 - DNA, 488 bp, Homo sapiens
  misc_feature: GYAE6OF01BB8EM.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataatttgggatcaaaatatgcttcctggtttcagcagactccaggccagtcccctgtgctggtcatctttcaagataccaagcgcccctcagggatccctgagcgattctctggctccaactctgggaacacagccactctgaccatcagccgggaccaggctatggatgaggctgactattactgtcaggcgtgggacagcggcgcactccaatagtcggcggaggaccagctagaccgtcaggtcacgcccgaaggtcccg

SEQ ID NO: 234821 - DNA, 499 bp, Homo sapiens
  misc_feature: GYAE6OF01E2UXV.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataatttgggatcaaaatatgcttcctggtttcagcagactccaggccagtcccctgtgctggtcatcttttcaagataccaagcgcccctcacgggatccctgagcgattctctggctccaactctggacacagccactctgaccatcagcggacccaggctatggatgaggctgactattactgtcaggcgtgggacagcggcggcactccaatacgtcggcggagggacccaagccgtgacccgtcctaggtaccacggcccgaaggtcccg

SEQ ID NO: 234822 - DNA, 503 bp, Homo sapiens
  misc_feature: GYAE6OF01CALNY.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataatttgggatcaaaatatgcttcctggtttcagcagactccaggccagtcccctgtgctggtcatctttcaagataccaagcgcccctcagggactccctgagcgattctctggctccaactctgggaacacacgccactctgaccatcagccggacccaggctagtggatgaggctagactattactgtcgaggcgtgggacagcggcggcactccaagtagttcggcggagggaccagccgtgacccggtctacggtacacgcccgaaggtcccg

SEQ ID NO: 234823 - DNA, 486 bp, Homo sapiens
  misc_feature: GYAE6OF01C1P7P.3.48.E04.1.454.CMB.1.raw
  modified_base (431)..(431): a, c, t, g, unknown or other
  misc_feature (431)..(431): n is a, c, g, or t
  modified_base (441)..(441): a, c, t, g, unknown or other
  misc_feature (441)..(441): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataaatttggggatacaaaaatatagcttcctggtttcagcagactccaggccagtcccctgtgctggtcatctttcaagataccaagcgcccctcaggatccctgagcgattctctggctccaactctgggaacacagccaactctgaccatcagcggaccaggctatggatgagctgactatactgtcaggcgtgggacagcggngcactcaatnttcggcgagggacaagctgaccgtctaggtcaagcccaaggtccc

SEQ ID NO: 234824 - DNA, 656 bp, Homo sapiens
  misc_feature: GYAE6OF01C40TH.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccagggcagacagccaccgtcacctgctctggagataagttggaatacaaaatatgctcctggttcagcagactccaggccacgtcccctgtcgctggtctatcgtttcaagtactaaccaagccgcccctcgaacgggactccccgtaggacgtcgtatttcctccgtcggtcctacccaaacttccgtagggaaaccacgtacgccctaacgttcctacgaaccctagtaccgaacggacccgggaacccacgggtactaagtcgggaatcgggaagtcctacggtaactttattaacgtcggtaccgtagggtaccgtggggaacctcgggcgggtacccgggactacccggtaacctaaacggttacgttcccggggacggggtaaacggacccgtaaagggcccttaaccgggtaaccggtcccgtaagggtcccgaccggtaccccgaaggggtccccc

SEQ ID NO: 234825 - DNA, 596 bp, Homo sapiens
  misc_feature: GYAE6OF01ERIC1.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagcccaccgtcacctgctctggagataatttgggatacaaaatatgcttcctggtttcagcagactccaggccacgtcccctgtcgctggtctattctttacaagtactaccaagcccgacccctacgacgggactccccgtagacggccgtacttctcgttcgggccttacccaaaccgttccgtacggggaaaccacgacgccctactctacgaccactacgacggccgggacccaggtcctagtggatgacggctagtactattacgtgtacgagggtcgtagggactacggcggcggacacctaccgtaagtacgttaccgggacggtaacgggaccaacggtccgtacggacccgtccggtacggtacccaccggtcccgaacggtcccg

SEQ ID NO: 234826 - DNA, 768 bp, Homo sapiens
  misc_feature: GYAE6OF01AIE29.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtcccagggcagacgagccaccgtcacctgctctggagattaatttgggatcaaatatgcttcctggtttcagcagactccgaggccagtcccctgtgcgtcggtcacttctttcaacgtactaccgaacgccgccccctacgacgggtactccccgtgacgtcgtacttccgtcgtcggccttacccaaaccgttccgtacgggaaccaccgacgaccctacctctaccgaaccctagtacccgacggacccggggtaaccccgacgggtacctaacggtacgggtacgtacggaacggtccgttacggtaacgtttaaccgtttaaccgttcggttaaccggtacgggggtacccggttaacgggggttaaccggaacgggtccgggggtacccgggtacccgtaaacccgttacccgttaaacgtttaacccgggtttacccggggaacccgggggttaacccgggggtaaccccgtaaaccggggtacccgttaaccgggtaaacccccgggtttacccgggttaacgggttaccccggaaccggggtaaccccccgtaaggggttaacccccccggg

SEQ ID NO: 234827 - DNA, 722 bp, Homo sapiens
  misc_feature: GYAE6OF01B398R.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccagggcagacagccaccgtcacctgctctggagattaagttgggatacaaaatatgcttcctggttcagcagactccgaggccacgtcccctgtcgctggtcattctttcaagtactaacccgaacgtcccgcccctacgacgggacctcccgtaggacgccgtacttcctcgtcggccttaccgaactcgtacgggaaccacgacgtcccacttccgtacgaaccacgtaccgaacgggacccgggaaccccgagggtaccttaggtacgggtaacgtacggacgggtaccgttacggtaacctttacgtttaaccgtcgggtaccggtacggggtccgggttaaggggaaccgtacggggcccgggaccgggtacctaacccgtaacccgtaaacgttaaccgggttaccgggggaaccgggtaacggggaaccccgtaaacggtcccggttaaccgggtaacccccgggtttaccggttaaccgggtaccccgaaccgggtaacccccggtaacggggtccccccgg

SEQ ID NO: 234828 - DNA, 513 bp, Homo sapiens
  misc_feature: GYAE6OF01CG01Y.3.48.E04.1.454.CMB.1.raw
  modified_base (457)..(457): a, c, t, g, unknown or other
  misc_feature (457)..(457): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataatttgggatcaaaatatgcttcctggtttcagcagactccaggccagtcccctgtgctggtcatctttcaagactaccaagccgcccctcgacgggactcccgtgacgcgattctcgtcggcctcccaactcgtacgggaaccacgacgcccactctacgacccatcgaacggccgggaacccaggacctagtggatggaggctagactattctgtcgaggcgtgggacnggcggcgcactcatgtcggcggaggacagctagccgtcaggcacgcccgagtcccg

SEQ ID NO: 234829 - DNA, 561 bp, Homo sapiens
  misc_feature: GYAE6OF01A00K2.3.48.E04.1.454.CMB.1.raw
  modified_base (224)..(224): a, c, t, g, unknown or other
  misc_feature (224)..(224): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctgganataagtttggatacaaatatgcttcctggtttcagcagactccaggccacgtcccctgtgctggtcatctttcaagtataccaagccgacccctcgacgggactcccgtgcgcgtattcctcgtggcctccaacctcgtagggaaccacacgcccactctacgaccatccgacggcgggaccccaggcctagtaggatgacggctaggacttattacgtgtacgaggtcggtgggacacggccgggacgactaccgtaccaagttacgtcggggacgggagggaccgtaacggccgtacggacccggtcctacgggacccacggaccgacggtcccg

SEQ ID NO: 234830 - DNA, 557 bp, Homo sapiens
  misc_feature: GYAE6OF01BQXCJ.3.48.E04.1.454.CMB.1.raw
  modified_base (224)..(224): a, c, t, g, unknown or other
  misc_feature (224)..(224): n is a, c, g, or t
  modified_base (438)..(438): a, c, t, g, unknown or other
  misc_feature (438)..(438): n is a, c, g, or t
  modified_base (456)..(456): a, c, t, g, unknown or other
  misc_feature (456)..(456): n is a, c, g, or t
  modified_base (548)..(548): a, c, t, g, unknown or other
  misc_feature (548)..(548): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctgganataatttgggatacaaaatatgtcttcctggtttcagcagactccaggccacgtcccctgtgctggtcatctttcaagactaccaagccgcccctgacgggctcccgtgacgcgtacttctacgtcggcctacccaactcgtagggaaaccacgacgccactctcgaccatcacgccgggacccaggcctagtgatggagctcgtactattacngtcgaggtcgtagggacnggccggtcggccacgtaccgaatacgttccgggacggtaacgggacctaacggacgtaccggacccgtaccgtaggtcccaccggtacccgnggtccccgg

SEQ ID NO: 234831 - DNA, 623 bp, Homo sapiens
  misc_feature: GYAE6OF01EINS4.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccacctcagtgtccgtgtccccagggcagacagccaccgtcacctgctctggagatatttggatacaaaatatgtcttcctggtttcagcagactccaggccacgtcccctgtcgtcgtggtctatctttacaagtataccaacgccgtcccctcgacgggactccctagacgacgtacttctcgtcggtcctaccaactcgtacgggaaccacgacgcctactctacgacctactaccgacggccgggaacccagggaccttagtacgggtatcgggacggtctacggtaacttacgtttacgtcggtacgacggggtcggtaggggaccacgggccgggaccggacctaaccgtaccgtaaacgttacggtttccggggacgggtaacggggaccaaggtccgtacggacccggttacgtacggtacccgacggcccgtaaacgggtccccg

SEQ ID NO: 234832 - DNA, 655 bp, Homo sapiens
  misc_feature: GYAE6OF01EAL9J.3.48.E04.1.454.CMB.1.raw
  modified_base (472)..(472): a, c, t, g, unknown or other
  misc_feature (472)..(472): n is a, c, g, or t
  modified_base (498)..(498): a, c, t, g, unknown or other
  misc_feature (498)..(498): n is a, c, g, or t
  modified_base (505)..(505): a, c, t, g, unknown or other
  misc_feature (505)..(505): n is a, c, g, or t
  modified_base (512)..(512): a, c, t, g, unknown or other
  misc_feature (512)..(512): n is a, c, g, or t
  modified_base (540)..(540): a, c, t, g, unknown or other
  misc_feature (540)..(540): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtcggcctcctatgagctgactcagcctacctcagtcgtccgtcgtcccgagggcagaccacgcccaccgtccacctgcctcgtaggataattagttaggatacaaatatcgtcttcgtgttacagctacgactccgacgtcctaccgttcccgtgtcgtcgtcggtctacgttacttacgaaagtacctaaccgacgtccccgtccctacggacggtacctccgtagacgtacgtacttcgtccgtacggtcctaccgtaacgtcgtaacggacacgactcccgactcgacaccagtcgacgggtaccgacctggtacttacgggngtacgtggagtccgttaatacgtttnttacggngtaccgngggtcggtacggacgagggtcccggacncctaacgtccgtaaagtcgggttaccggggacgggtaaccgaaccgtaacggtccgtaacccggtacccggtttaccgaccggtaccgaacccggtcccgggaacgttcccccgg

SEQ ID NO: 234833 - DNA, 709 bp, Homo sapiens
  misc_feature: GYAE6OF01B8LKX.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtcgtccgtgtccccagggcagacagccaccgtcacctgctctggagatagtttggatacaaaatatgcttccgtggtttcagcacgactccgaggcccacgtccccctggtcgtcgtggttccattccgtttacaacgtaataacccgaagcccgtcccccgtacgacgggtacctcccgtaggacgtcgtacttcctacgtcggccttaccctaacgttccgtacgggaacccacgacggccctaccttccgtaccgaccacgttccgacgggcccgggaacccgaggtacctaaggtggtagtcggacggtactcgtaacttacgttacgttgtacggtaggggccggttacggggaacgtacggggccgggcccgggtacctaacccgtaccgtaaagttaccgggttcccggggacgggggtaaccgggtaaaccccgagggttaccccgtaccgggttaaccccgggttacccgttaacggggttacccgaacccgggtacccccgaaacggggttcccccccgg

SEQ ID NO: 234834 - DNA, 564 bp, Homo sapiens
  misc_feature: GYAE6OF01BWD3V.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagcccaccgtcacctgctctggagataatttgggatcaaaatatgcttcctggtttcagcagactccaggccagtcccctgtcgctggtcatctttcaagataccaagccgcccctcacgggactcccgtgaacggcgtattctcgtggcctccaactcgtagggaaccacagcccactccacgaccatccgaggccgggacccaggctagtggatgacggctagacttattacgtgtcgaggtcgtgggactacggcgccggctaccgtaccagttaacgttccgggacggtacgggacccgtaaggtccgtacggaaccccgttccgtaacgggtacccaccggccccgtaaaggtccccg

SEQ ID NO: 234835 - DNA, 564 bp, Homo sapiens
  misc_feature: GYAE6OF01E3FI9.3.48.E04.1.454.CMB.1.raw
  modified_base (227)..(227): a, c, t, g, unknown or other
  misc_feature (227)..(227): n is a, c, g, or t
  modified_base (546)..(546): a, c, t, g, unknown or other
  misc_feature (546)..(546): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccagggcagacagccaccgtcacctgctctgganatattggatacaaaatatgcttcctggtttcagcagactccaggccacgtcccctgtgcgtggtcattctttcaagtactaccaagccgcccctacgacgggactccctgacgcgtacttctctcggcctacctaactcgtacgggaaccacgacgcctactctacgaccatcacggaccggacccaggtctagtaggatggacgtctgtactagttacgtgtacgacggtcggtagggactacgggcggcggacctacctaccgtaaagtacgtcgggacggacgggtaccaggctacggaccgtccgtacggtaccncggaccgaacggtccccg

SEQ ID NO: 234836 - DNA, 596 bp, Homo sapiens
  misc_feature: GYAE6OF01B3UXC.3.48.E04.1.454.CMB.1.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctgganattaatttggatacaaaatntgcttctggtttcagcagactccaggccacgtcccctgtcgctggtcatctttacaagtataccgagtccgcccctcgacgggactcccgtgacgcgattctcgtacggtcctacctaactcgtacgggaacctacacgccctactccgtacgaaccagtccacggtacccgggaccctaagggtcctaagtcgggaagtcggacggtctacggtacttacgtttacgtggtacgagggtcggtagggacgacggcgggccgactacctaccgtaaagtacgttccgggacggacgggaaccaggccgtacgtaccggtaccgttacggtaccgaccgcccgaaggtccccg

SEQ ID NO: 234837 - DNA, 870 bp, Homo sapiens
  misc_feature: GYAE6OF01E49RV.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccagggcagacagccaccgtcacctgctctggagattaagttggatacaaaatatgctttccgtgttcagcagactccgacggcctacgtcccctggtcgcgttcggtctacttccttttaccaaacgtaacttaacccgaaacggccccgtacccccgtaccgaacggggtaccttaccccggtggaacgtccgtaacgtttccgttccgttcggcccttaacccgtaaccttcccgggttaaacggggaaccctaaccgaaccggtaccccttaacgtcccgttaaccgaacccctaaggtaccccggaaccggggacccccggggaaaccccgttacggggtaccgttaaacggttcgggtaaacgttacgggacgggttacccgttaaggttaaacccgttttacggtttaacgtttccgggtaaccgtaagggggttacccgggttacggggggaacctaccgggggtccccggggacccgggtaaccccgtaacccgttaacccggtaaaaccggtttaaccgggtttccccgggggaaacccgggggtaacgggggaaccccgaaagggttcccccggtaacccgggttaacccccgggtaacccgggtttacccgggttaacccggaacccccggttaacccccgggtaacgggggttacccccccgg

SEQ ID NO: 234838 - DNA, 683 bp, Homo sapiens
  misc_feature: GYAE6OF01CSNV3.3.48.E04.1.454.CMB.1.raw
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctgganataattggatacaaaatntgtcttctggtttcagcagactcaggccacgtcccctgtcgctggtcacttctttacaagtactaaccaacgccgaccccctcgagggtactcccgtgacgcgtactttctcgtcggcctaccctaactcgtacgggtaaccacgacgccctaaccttcgaccgaaccactccgaacgggtccgggaaccccaagggtccttaggtacggtaacgttacgggacgggttcctaacgtaaccttaacgtttaacccgttggtaccgtaacggggttcgggtacggggaaccgaacgggtcccgggtacgggaccctaacccgttacccggtaaaagttccggttaccggggaaccggggacgggtaacccgaaacggtcccgttacgggtaccccgttaccggttaacggtccgaaaccggcccggtaaaccgggtccccgg

SEQ ID NO: 234839 - DNA, 590 bp, Homo sapiens
  misc_feature: GYAE6OF01ESZOE.3.48.E04.1.454.CMB.1.raw
  modified_base (323)..(323): a, c, t, g, unknown or other
  misc_feature (323)..(323): n is a, c, g, or t
  modified_base (505)..(505): a, c, t, g, unknown or other
  misc_feature (505)..(505): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccgagggcagacacgcccaccgtcacctgctcgtggatataagtttggaatacaaaatatgtcttccgtggttcagcacgacctccgaggccctacgtcccctggtcgcgtcggtctacttcttacgaanactaaccacgccgtaccccgtacgacggtacctacccgtagacgtctacttcgtcgtcggtcctaccgtaacgtcgtacggaacctacgacgccctacgtccacgaccagtacgacgaccgggaccaggtctagtcgagtcgacgtctacgaacttatacgtcgtacgaggtcggtaggacncgggcggccgactcgaccgtagtacggtcgggacggaggtaccgagccgtacgaccgtcgacgtaccgacggccgtacggtcccg

SEQ ID NO: 234840 - DNA, 684 bp, Homo sapiens
  misc_feature: GYAE6OF01EFIT6.3.48.E04.1.454.CMB.1.raw
  modified_base (304)..(304): a, c, t, g, unknown or other
  misc_feature (304)..(304): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccagggcagacacgcccaccgtcacctgcctcgtggagattaagtttgggatacaaaatatgtcttctggttcagcagacctccacggccacgtcccctgtcgcgtggtcnttctttacaagactaccaacgccgccctacgacggactcccgtagagtcgtacttctaccgtcggctaccctaactcggtacggaaacaccgacgtaccctactaccgtacgaacctacgttccgaacgggtaacccgggacccgtgggaccttacgggtaggtacgttacgggacggtaccgtacggttaaccttaacgttacgtcggtaccggtagggtaccgggtagggaaccgacgggtccgggaccggtaccgtaaccgtacctaaaggtaacccggttcggggaacccgggaacgggaacccgtacgggtccgttaaccggtacccggttacccggtacgggtacccgaccggtaccccgaacgggtcccccgg

SEQ ID NO: 234841 - DNA, 676 bp, Homo sapiens
  misc_feature: GYAE6OF01C12N1.3.48.E04.1.454.CMB.1.raw
  modified_base (248)..(248): a, c, t, g, unknown or other
  misc_feature (248)..(248): n is a, c, g, or t
  modified_base (304)..(304): a, c, t, g, unknown or other
  misc_feature (304)..(304): n is a, c, g, or t
  modified_base (315)..(315): a, c, t, g, unknown or other
  misc_feature (315)..(315): n is a, c, g, or t
  modified_base (321)..(321): a, c, t, g, unknown or other
  misc_feature (321)..(321): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccagggcagacacgccacgtcacctgctcgtggagataagttggatacaaaatntgtcttctggttcagcagactccaggccacgtccccgtgtcgctgctatcttacanactaccagccncccgtnaggtactcctaggacgtcgtattcctacgtcggacctaccgtaacgtcggtacggaaccacgtacgccctacgttcaccgaacctacgtccgaacggacccgggaacccagggtccttaaggtcggtaacgtcgggacggttacgtacgttaacttaacgttacggttcgtaccggtaacgggttccgggtacgggaccgacgggtccgggaccggtaacctacccgttaaccggaaacgtttccggtaacccggggacgggtaaaccgggaacccgtaaaggtccccgtttacggaacccccgggttccgttaaacgggtccgaaaccccgggtcccgtaaacgggtcccccgg

SEQ ID NO: 234842 - DNA, 680 bp, Homo sapiens
  misc_feature: GYAE6OF01C2Q6C.3.48.E04.1.454.CMB.1.raw
  modified_base (181)..(181): a, c, t, g, unknown or other
  misc_feature (181)..(181): n is a, c, g, or t
  modified_base (228)..(228): a, c, t, g, unknown or other
  misc_feature (228)..(228): n is a, c, g, or t
  modified_base (249)..(249): a, c, t, g, unknown or other
  misc_feature (249)..(249): n is a, c, g, or t
  modified_base (494)..(494): a, c, t, g, unknown or other
  misc_feature (494)..(494): n is a, c, g, or t
tcagagacgcactccacgaccggtgctcgatttagagagcgtcacagagagaaggggctgggcctcaggaagcagcatcggaggtgcctcagccatggcatggactccctctcttcctcggcgtccttgcttactgcacaggatccgtggccctctatgagtctgactcacgcccaccctnagtcgtccgtcgtccccgagggcagacacgccaccgtcactgctcgnggatatagttggatacaaatntacgtcttacgttggttcagacgactacctccgacggcctacgtcccgtggttcgtcgtcggtactactttcgtttacgaacgtactaccgacgtcccgtaccctacggacggtacctccgtaggacgtaccgtacttccgtcgtcgtacctaccgtacgtcgtacggaactacgcgaccctactcgacgaccgtactaccgcggaccgtaccgagtacgtacgtggaacgtcgacgtaccgtanacgtttacgttacgtcggttacgacgggttcgtaggaccgtaccgggtcgggaccgtaccacgttaccgtaacggttaccgtaccggggaaacggtaccgggaacccgtaggttcccggtaaccggttaaccccgttaccggtaccgggtacccgaacccgggtacccgtaccggttacccccggg

SEQ ID NO: 234843 - DNA, 577 bp, Homo sapiens
  misc_feature: GYAE6OF01A2Y88.3.48.E04.1.454.CMB.1.raw
  modified_base (392)..(392): a, c, t, g, unknown or other
  misc_feature (392)..(392): n is a, c, g, or t
  modified_base (430)..(430): a, c, t, g, unknown or other
  misc_feature (430)..(430): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccagggcagacagccaccgtcacctgctctgagataattgggatacaaatatgtcttcctggtttcagcagtactccaggccacgtcccctgtcgcctggtctacttctttacaagactaccaacgcccgcccctacgacgggtacctcccgtgacgtcgtattctcgtcggtcctacctactcgtacggaacaccgacncctactctacgacctactcgacggccggaccagctagnggtatggacgtcctagacttacgttacgtgtacgaggtacggtagggacacgggccggacgtcaccgtaccgtaagtacgtcgggacggtaccggacgtacggccgtacgtacccgtcgtacggaccgaccgcccgtaggtaccccg

SEQ ID NO: 234844 - DNA, 678 bp, Homo sapiens
  misc_feature: GYAE6OF01AZ9EH.3.48.E04.1.454.CMB.1.raw
tcagagacgcactccacgaccggtgctcgatttagagagcgtcacagagagaaggggctgggcctcaggaagcagcagtcggaggtgcctcagccatggcatggatccctctcttcctcggcgtccttgcttactgcacaggatccgtggcctcctatgagctgactcagccaccctcagtcgtccgttgtccccagggcagacagccaccgtcacctgctctggagattatttggatacaaatatgtcttcctggtttcagtcacgacctccgaggccacgtcccctgtcgctggtctattctttcgaagactaacccgaagcccgaccccgtcgacgggtactcccgtgacgcgtattcctcgtcggcctacctaacgttcgtacgggaaccacgtacgcccacgtctacggaccacgtaccgacggacccgggacccgacggtctaagtcggtagtcggacggttccgtaggtacccttaacgtttccgtacggtaccgtacggggtcccgggttaacgggacccgtagggcccgggacccggtaccgtacccgttaacccggtaagtacccgggttaccggggccggggtaacgggaaccccgtaacgggtccgtacccggtaccccggttaccggtaaccgggtacccgacggaccccggtaacggtccccgg

SEQ ID NO: 234845 - DNA, 680 bp, Homo sapiens
  misc_feature: GYAE6OF01CQ3C6.3.48.E04.1.454.CMB.1.raw
tcagagacgcactccacgaccggtgctcgatttagagagcgtcacagagagaaggggctgggcctcaggaagcagcatcggaggtgcctcagccatggcatggactccctctcttcctcggcgtccttgcttactgcacaggactccgtcggcctcctatgagctgactcacgccaccctcagtcgtccgtcgtccccgagggcacgacacgcccaccgtccacctgctcgtggagtataagtttggatacaaaatatgtcttccttggtttcagcagacctccgacggcctacgttcccctggtcgtcgttggtacctacttccgtttacgaagtaactacccaacggccccgacccctacggaacggtcctacccgtaggacgtcgtacttccgtcgtcgacctacccgtacgtgtacggaactcgaacgtcccacgttcgtacgacctagtacccggaacgggtcccggaaccgtaggtcttaaggcgggtatacgggacgtaccgtacgtaacttacgtttacggtccgtacggacggggtcggttacgggacgccgggtacgggcccggtactaccgtacgtaacttccggggtacgggaccggacgggaacctaccgggaccttaccgggacccttaccgggtacgtacgaaccccggcccgtagggtcccccg

SEQ ID NO: 234846 - DNA, 694 bp, Homo sapiens
  misc_feature: GYAE6OF01C6CZB.3.48.E04.1.454.CMB.1.raw
  modified_base (208)..(208): a, c, t, g, unknown or other
  misc_feature (208)..(208): n is a, c, g, or t
tcagagacgcactccacgaccggtgctcgatttagagagcgtcacagagagaaggggctgggcctcaggaagcagcatcggaggtgcctcagccatggcatggatcccctctcttcctcggcgtccttgcttactgcacaggactccgtggcctcctatgagctgactcacgcccaccctcagtcgtccgtcgtccccgaggcagacncgcccaccgtcacctgctcgtggatatagttggatacaaatatcgtccttacgttggttacagctacgacctaccgagtccctacgtccccgtgtacgctggtcctacgttctttacgaacgtactaacccgaacgtccccgaccccttacgacgggtacctcccgtgacgtcgtacttccgtcgtcgtcctaccacgtcgtaacggactaccgactacctacgtactaccgtactacgtacggacggcccggaaccgtagtaccgtagtacggacgtacggacgtcttacggtaactttacgttcgtacgtacggacggggttcggtacggggactaccgggccgggacgtacctaacccgtaacgtaaccgttcgggttacccggggacgggtaaaccgggtaacccggtacggtacccggttaccggtaacccggttaccggtaaccgggaccgaaccccggacccggtccggtaccccccgg

SEQ ID NO: 234847 - DNA, 684 bp, Homo sapiens
  misc_feature: GYAE6OF01D88TW.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggccctcctatgagctgactcacgcccaccctcagtcgtccgtcgtccccgagggcacgacgacgcccaccgtcacctgcctcgtaggagtaacttaagtttagggaacttaacaaaagttagtcgttacctttccgttaggtttaccaggtaccaacgtaccgtccgaaccggtcccgtaccgttcccctggtcggtcgttacggttactacgtttacctttaacgaaacgtaacctaacccgaaccggtccccgtacccccgtaggaaccgggttacctcccggtacgacggtccgttacttcgtcgtccggtacctaccgtactcggtaacggaacacaccgcctactcgacaccgatcgaacggccggacagacctagaggtacagggactcgtattaactacgttacgcgtacggtacggcggtacggacgcggaccgaccgcacctacgaggtaccggtacgggacgggaaccgtacgtcggacctacggtacccgtcgtacgggaccacccggtaccggtccgtccccgg

SEQ ID NO: 234848 - DNA, 766 bp, Homo sapiens
  misc_feature: GYAE6OF01AQRCC.3.48.E04.1.454.CMB.1.raw
  modified_base (299)..(299): a, c, t, g, unknown or other
  misc_feature (299)..(299): n is a, c, g, or t
  modified_base (403)..(403): a, c, t, g, unknown or other
  misc_feature (403)..(403): n is a, c, g, or t
  modified_base (754)..(754): a, c, t, g, unknown or other
  misc_feature (754)..(754): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtcgtaccgtcgtcccgaggcagacacgccaccgtcaccgtgctcgtaggacgtagttaagttagggaactacgaaaattagtacgttccgtttaccgttcggtttcacgtcaacgtaccnccgccggacctacgttcccctggtccgtcgtcggtactactttaccgttaccaacggtactaccaacgtccccgcccgttacgacggtaccgtccgtgaaccgntcgttactcgtcggtacctaccgtacgtaccgtaacggaacctacggtacctacgttaccctacgttacccgaacctacgtccggaacccgggtacccgggtacccgtaacgggtaccttaacgggtaccggtacggacgtaccggtccggtaacgttaaccgtttacgttaccgtttccggacgggtaccgggttacggggttaccgggaccgacgggtacccgggccgtaacccgaccgttaaccgtaacgggttaccggtccggggtaaccgggtaccggaacccggtacgtccggtaaaccgggttccccgtaacggtacccggtaccgaacccgttaaacccgggnggttacccccgg

SEQ ID NO: 234849 - DNA, 836 bp, Homo sapiens
  misc_feature: GYAE6OF01B3KXG.3.48.E04.1.454.CMB.1.raw
  modified_base (785)..(785): a, c, t, g, unknown or other
  misc_feature (785)..(785): n is a, c, g, or t
tcagagacgcactccacgaccggtgctcgatttagagagcgtcacagagagaaggggctgggcctcaggaagcagcatcggaggtgcctcagccatggcatggactccctctcttcctcggtcgtccttgcttactgcacaggactccggtcggccctcctatgacgtctgacctcacgcccaccctcacggttcgtccgtcgtccccgagggcacgacacgcccaccgtcaccgtgcctcgtaggactagttaaggttggaactaactaaaattacgtcgttcctttccgttcggtttacacggaccgtaacgaccgttacccgaacgggtcccctaccggttcccccgtttgggtccggtccgttacggttaccttaacgttttaccgtttaacgaaaccgttaaccgttaaacccggaacccggtcccccggtacccccggtacggtaaccgggttacccttccccggtaagggaccgttccggttacctttaccggtccgttaccggtacccgttaacccgtaaccggttacccgggttaaacgggaaaccctaacccgtaccgtaccccttaaccgttccctaaccggaacccgtacggtacccggaacccggggtacccgggtaacccgaggttaccggtagtacggtacggtacggacggtactacgtaacgtttacgtccgtacggtaggccgggtacggtacgggtacgccgggtacggtaccggtaccctaacgtacccgtaacggttacgggtaccgggacggtaacggtaccncggtcctaccggaccggtaccgtacggaccgtaccgaccgtcgggtccccg

SEQ ID NO: 234850 - DNA, 733 bp, Homo sapiens
  misc_feature: GYAE6OF01DH56A.3.48.E04.1.454.CMB.1.raw
  modified_base (482)..(482): a, c, t, g, unknown or other
  misc_feature (482)..(482): n is a, c, g, or t
tcagagacgcactccacgaccggtgctcgatttagagagcgtcacagagagaaggggctgggcctcaggaagcagcatcgggaggtgcctcagccatggcatggactccctctctcctcggcgtccttgcttactgcacgaggtactccgtggccctcctatgagtctgacctcgacgccctaccctgtagtccggttccgtccggtcccgagggcacgaccacgccctaccgtccacctgctacgtaggagtagttaaggtttggaactaacgtaaaaattgtcgttccgtttccgttaggtttccacgacgtaacgtacccgtccgaccggtccctaccggtcccctggtcgtcgtcgtacctacgtttccttaacaaacgtaacgtaaccgaccgccccgtaccccgtacggtacggtacctcccgtaggactacggttacctcgtcgtccggtacctactaacgtcgaacggtaaccncgtacacctctaccgacactacacgaccggaccggtacccgagtaacgtcgtaggtacggtcggagtaccttaggtaacctttagttaccggtgggtaccgacgggtacgggacggtacggaccggggtccgacccgtaccgtaacgtaacccgtaaggttccgaaaccggggtcggaaacccggtacctaaggtccccggtaacgttacccggtacgtaacccgaccgacggtccggaaccgtcccccgg

SEQ ID NO: 234851 - DNA, 696 bp, Homo sapiens
  misc_feature: GYAE6OF01DD3KN.3.48.E04.1.454.CMB.1.raw
  modified_base (181)..(181): a, c, t, g, unknown or other
  misc_feature (181)..(181): n is a, c, g, or t
  modified_base (258)..(258): a, c, t, g, unknown or other
  misc_feature (258)..(258): n is a, c, g, or t
tcagagacgcactccacgaccggtgctcgatttagagagcgtcacagagagaagggctgggcctcaggaagcagcatcggaggtgcctcagccatggcatggactccctctcttcctcggcgtccttgtccttactcgcacgaggacttccggtggacccttcctagtgacgtctagaccnctacgccccacctcacggtcgtcccggtcgtaccccgagggtcaacgacaccggccctaccgtccactcgcctacgnggagtacttaagttggactaacaaaattcgtcgttccgttcgttcggttacacggactaagaccttaccgacggtcccgtaccggttcccgtggtcgcgttacgtctacttcgttataacgtaactaccgaaccgccgtcccaggacgtacttcccgaggacgttacgacttcctcgccgttacctaccgacgttccgacggaaccacgtaccgcctagtccgtaccactctacccgggcgggacccgacgaggtacacgttgagcggagtcgtaatacgttagttacgacggtaggcggtacgggtacgggacggtccggcgtaccgcgtaacccgtacgtacggttacggccgggtaaccggggaaccgtaggcccggtaaccgttcgggaccgttacggaacggtccggaaacccgtacggtcccgggtaccccg

SEQ ID NO: 234852 - DNA, 483 bp, Homo sapiens
  misc_feature: GYAE6OF02HB2HI.3.48.E04.1.454.CMB.1.raw
  modified_base (423)..(423): a, c, t, g, unknown or other
  misc_feature (423)..(423): n is a, c, g, or t
  modified_base (439)..(439): a, c, t, g, unknown or other
  misc_feature (439)..(439): n is a, c, g, or t
tcagagacgcactccacgaccggtgctcgatttagagagcgtcacagagagaagggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataatttgggatcaaaatatgcttcctggtttcagcagactccaggccagtcccctgtgctggtcatctttcaagataccaagcgcccctcagggatccctgagcgattctctggctccaactctgggaacacagccactctgaccatcagcgggacccaggctatggatgagctgactattactgtcaggcgtgggacngcggcggcactccatntcggcggaggaccaagctgaccgtccaggtcagcccaaggtccg

SEQ ID NO: 234853 - DNA, 490 bp, Homo sapiens
  misc_feature: GYAE6OF02GIVTS.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataatttgggatcaaaatatgcttcctggtttcagcagactccaggccagtcccctgtgctggtcatctttcaagataccaagcgcccctcagggactccctgagcgattctctggctccaactctgggaacacagccactctgaccatcagcgggacccaggcctatggatgaggctgactattactgtcaggcgtgggacagcggcggcactcatattggcggaggaccaagctgaccgtcgtaggtcacggtcccaggtcccg

SEQ ID NO: 234854 - DNA, 502 bp, Homo sapiens
  misc_feature: GYAE6OF02HSVK1.3.48.E04.1.454.CMB.1.raw
  modified_base (316)..(316): a, c, t, g, unknown or other
  misc_feature (316)..(316): n is a, c, g, or t
  modified_base (418)..(418): a, c, t, g, unknown or other
  misc_feature (418)..(418): n is a, c, g, or t
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
  modified_base (473)..(473): a, c, t, g, unknown or other
  misc_feature (473)..(473): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataatttgggatacaaaatatgcttcctggtttcagcagactccaggccagtcccctgtgctggtcatctttcaagataccaagcgcccctnaggatccctgagcgattctctggctccaactcgtagggaacacacgccactctagaccatcgagcgggaccaggctagtggactgaggtctgactattacgngttcgaggcgtggacngccggngcactcgatacgtcgggcggacggacaacgtcnggaccgtcaggtcacggcccaaggtcccg

SEQ ID NO: 234855 - DNA, 527 bp, Homo sapiens
  misc_feature: GYAE6OF02IISRR.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataattgggatacaaaatatgcttcctggtttcagcagactccaggccagtcccctgtgctggcatctttcaagataccaagccgcccctcagggactccctgagcgacttctctggctaccaactcgtagggacacacgccactctcgaccatcgagccgggaccaggctagtggatggacgctgaactattactgtcgacggcgtcgggacacggcggcggacaccgtaccatacgttcgggcggaacggaccgaagtccgtggacccgtccgtaaggtccgacggtcccgaacggtcccg

SEQ ID NO: 234856 - DNA, 506 bp, Homo sapiens
  misc_feature: GYAE6OF02J0389.3.48.E04.1.454.CMB.1.raw
  modified_base (279)..(279): a, c, t, g, unknown or other
  misc_feature (279)..(279): n is a, c, g, or t
  modified_base (372)..(372): a, c, t, g, unknown or other
  misc_feature (372)..(372): n is a, c, g, or t
  modified_base (398)..(398): a, c, t, g, unknown or other
  misc_feature (398)..(398): n is a, c, g, or t
  modified_base (416)..(416): a, c, t, g, unknown or other
  misc_feature (416)..(416): n is a, c, g, or t
tcagagacgcactccacgaccggtgctcgatttagagagcgtcacagagagaagggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagcagccaccgtcacctgctctggagataatttgggatcaaaatatgcttcctggtttacagcagactccaggccagtccccngtgctggtcatctttcaagataccaagcgcccctcagggactccctgacgcgattctctggctccgaactctgggaacacgacgccacgttcngaccatcagccggacaggcagtcgangaggcctgactagttacngttcaggcgtggactagcggacgcgactcccgatgttcggcggtaggaccaagctacggaccgtaccgtggtaccacgacccgaggtccg

SEQ ID NO: 234857 - DNA, 495 bp, Homo sapiens
  misc_feature: GYAE6OF02GCXXH.3.48.E04.1.454.CMB.1.raw
  modified_base (336)..(336): a, c, t, g, unknown or other
  misc_feature (336)..(336): n is a, c, g, or t
  modified_base (394)..(394): a, c, t, g, unknown or other
  misc_feature (394)..(394): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataatttgggatcaaaatatgcttcctggtttcagcagactccaggccagtcccctgtgctggtcatctttcaagataccaagccgcccctcaggactccctgagcgattcnctggctccaactctgggaacacacgccactctgaccatcagcggacccagctatggangagctagactattactgtcgaggcgtagggacaggcggcgcactccatgtcgggcggacggaccaagcgtacgaccgtcgtaggtcacgcccgaggtcccg

SEQ ID NO: 234858 - DNA, 654 bp, Homo sapiens
  misc_feature: GYAE6OF02I3D5M.3.48.E04.1.454.CMB.1.raw
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
tcagagacgcactccacgaccggtgctcgatttagagagcgtcacagagagaagggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccagggcagacagccaccgtcacctgcctcgnggacgattaagttggatacaaaatntgcttcctggttcagtcagtacctcaggccacgtccctgtcgctggtccattccttacaagtactaccgaagcccgacccctagacgggtactcccgtagacgacgtacttccgttcgtcggtcctaccctaaaccttcggtacgggaaccactacgccacgtactacgaccaactaccgacgaccggacccgaggtacctagtacggatacggtacggtcctacgtaactaacgtttacttcggtaccgtacggtaccggtacggtaaccggacggccggggtaccgaaccgtaccgttaccgtaagttaacggtccggggtaaccggtaacggggaaccaacgggtaccttaccgggaacccgtccgtaaccgggttaccaaccggtacccgaaccggtcccgg

SEQ ID NO: 234859 - DNA, 679 bp, Homo sapiens
  misc_feature: GYAE6OF02IHMXL.3.48.E04.1.454.CMB.1.raw
  modified_base (283)..(283): a, c, t, g, unknown or other
  misc_feature (283)..(283): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataatttgggatcaaaatatgcttcctggtttcagtcagactcaggccagtcccctgtncgtggtcattctttacaaagtactaccgaagccgcccctcaagggactcccgtgacgcgtattcctctggcctacccaaacttcgtacgggaacctacgacgtaccctaactccgtcgaaccctataccgaaggtacccggggaaccccaagggtccttaacgtacgggaattacgggaacgggtcctaagtaccgttaactttacgtacggttacgacggggtaccggttacggggaaccgtaagggcccgggggtaccggaccgtaacccgttaccgtaaaagttccggtttccggggaaccgggggtaaccgggaaacccgaacggtaccggtacggtacccggttacccgtaacgggttacccgaaccgtaccccggtaaagggtcccccgg

SEQ ID NO: 234860 - DNA, 513 bp, Homo sapiens
  misc_feature: GYAE6OF02IQB2O.3.48.E04.1.454.CMB.1.raw
  modified_base (409)..(409): a, c, t, g, unknown or other
  misc_feature (409)..(409): n is a, c, g, or t
  modified_base (445)..(445): a, c, t, g, unknown or other
  misc_feature (445)..(445): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataatttgggatcaaaatatgcttcctggttttcagcagactccaggccacgtcccctgtcgctggtcattctttcaagataaccaagccgcccctgacgggactcccgtgagcgtattctctggcctccaactcgtagggaacacacgccactctacgaccatccacgcgggacccaggctagnggatgagtctgtactattactgtacaggcgtggacngcggcgcactccagttagtcggacgggaggaccgaagcgtacgccgtacgtaggcacgccaggtcccg

SEQ ID NO: 234861 - DNA, 556 bp, Homo sapiens
  misc_feature: GYAE6OF02HQGMA.3.48.E04.1.454.CMB.1.raw
  modified_base (426)..(426): a, c, t, g, unknown or other
  misc_feature (426)..(426): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataatttgggatacaaaatatgcttcctggtttcagcagactccaggccacgtcccctgtgctggtcatctttcaagataccaagccgcccctcgagggactcccgtgacgcgtacttctcgttcggcctacccaaacttcgtacgggaaccacgacgcccactcctcgaacccatccgaggccgggaacccaggacctagnggatggagtctagacttattactgtcgagggcgtgggacacggcggcggctacgacctatacgttccgggacggacgggaccaacgccgtacggacccgtccgtacggtccgacggtcccgaaggtcccg

SEQ ID NO: 234862 - DNA, 585 bp, Homo sapiens
  misc_feature: GYAE6OF02HL2JD.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataatttggatcaaaatatgcttcctggtttcagcagactccaggccagtcccctgtcgcgtggtcattctttacaagtactaccaagccgcccctcgacgggtactcccgtgacgcgattcctctcggcctaccaactcgtagggaaccacgacgccactctacgaccactcgaacggccgggaacccaggtactagtcggagtcggaggtcctagacttacgttacgtgtacgagggcgtagggacgacggccgggcggactacctaccgtagttacggttccgggacgggaacgggacccgtaaggtaccgtcggtacccggtccgtaacggtccgaaccggacccgaaggtccccgg

SEQ ID NO: 234863 - DNA, 606 bp, Homo sapiens
  misc_feature: GYAE6OF02G5VHJ.3.48.E04.1.454.CMB.1.raw
  modified_base (251)..(251): a, c, t, g, unknown or other
  misc_feature (251)..(251): n is a, c, g, or t
  modified_base (441)..(441): a, c, t, g, unknown or other
  misc_feature (441)..(441): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccagggcagacagccaccgtcacctgctcgtggagtattaagttgggatacaaaatntgcttcctggttcagcagactcagccacgtcccctgtcgctggtctatcctttacaagtataaccaagcccgtacccctcgacgggactcccgtgacgcgtacttctcgtggacctaccaacgttcgtacggaacacgacgccctacgtctacgacctacgtccgacggccgggacccagggtactaggnggaacgtggacggtctggtaacttagttactcggtacgagggccggtagggacgcggaccgggcgaccgacctaccgtaagttcggtaccgggaccgggtaacgggacccgaaggtccgtacggtacccggttccgacggtcgaaccggaccccgaggtccccgg

SEQ ID NO: 234864 - DNA, 511 bp, Homo sapiens
  misc_feature: GYAE6OF02HMYSW.3.48.E04.1.454.CMB.1.raw
  modified_base (366)..(366): a, c, t, g, unknown or other
  misc_feature (366)..(366): n is a, c, g, or t
  modified_base (427)..(427): a, c, t, g, unknown or other
  misc_feature (427)..(427): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataatttgggatcaaaatatgcttcctggtttcagcagactccaggccagtcccctgtgctggtcatctttcaagataccaagcgccctcagggatccctgagcgattctctggctccaactctgggaacacgagccactcngaccatcagcgggacccaggctagtggatggaggctgactattactgtcaggcgtcggganacggcggcgcacgtcccattacgttcgggcggacgggaccaaaggtcctaggacccgtacgtaggtccacggcccgtaggtccg

SEQ ID NO: 234865 - DNA, 515 bp, Homo sapiens
  misc_feature: GYAE6OF02HXNZX.3.48.E04.1.454.CMB.1.raw
  modified_base (416)..(416): a, c, t, g, unknown or other
  misc_feature (416)..(416): n is a, c, g, or t
  modified_base (469)..(469): a, c, t, g, unknown or other
  misc_feature (469)..(469): n is a, c, g, or t
  modified_base (487)..(487): a, c, t, g, unknown or other
  misc_feature (487)..(487): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataatttgggatacaaaatatgacttcctggtttcagtcagactccgaggccacgtcccctggtgctggtcactctttccaagataacccaagtccgcccctgacgggctcccgtgagccgattcctctcggcctccaactctacgggaacacacgaccactctcgaccatcagaccgggacccaggctagnggatgaggctagactatacgtgtacaggcgtagggacaggcggcgcactcatntcggcggaggaccagcgngaccgtctaggtcacgcccgaagtcccg

SEQ ID NO: 234866 - DNA, 564 bp, Homo sapiens
  misc_feature: GYAE6OF02FUP9Z.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataatttgggatacaaaatatgcttcctggtttcagcagactcaggccagtcccctgtgctggtcatctttcaagataccaagccgcccctcacgggactcccgtgacgcgattctctggctaccaactcgtgggaacacacgccactctcgaccatcgacgccgggaccaggtctagtggactggagctagtactattacgtgtacgacggtcggtagggacaggccgggacggctaaccgtccgaagttacggtccgggtaaccgggaacgggacccgtaacggtccgtacggtacccgttccgtaacgggtccaaccggaccccgtaaggtcccccg

SEQ ID NO: 234867 - DNA, 632 bp, Homo sapiens
  misc_feature: GYAE6OF02FXC3T.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccatggcctcctatgagctgactcagccaccctcagtcgtccgtgtccccagggcagacagccaccgtcacctgctctggagataattgggatacaaaatatgcttcctggtttcagcagactccaggccacgtcccctgtcgctggtcattctttcaagtactaaccaagccgcccctcgacggactcccgtgacgtcgtactttcgtcgtcggtcctacccgtaactcgtacgggaaccacgacgacctactcgtacgacctagtacgacggaccgggacccaggacttagtacggagtggacggcgtacgacttagttacgtgtcgtacgggtcggttacgggacgacggccgggcggtaccctaccgtaccgtaaagttacggttaccggggaccggggtaaccggggtaacccgtaacggtcccgttaaccgggtacccggttacccggtaccgggtacccggtacccggaccccggtaacggg

SEQ ID NO: 234868 - DNA, 612 bp, Homo sapiens
  misc_feature: GYAE6OF02F81TW.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataatttgggatcaaaatatgcttctggtttcagcagctccaggccagtcccctgtgctggtcacttctttacaagactaccaagcccgtccccgtcgacgggtactccccgtagacgcgtacttcgtcgtcggcctccgtaactcgtacgggaaccaccgacgcccactcctacgaccatccgacggcccgggaacccgacgggctagtggtacgtcggacggtcctagtaccttattaacgttggtaccgagggtccggtagggaccgagggtccgggcgaccgtacctaccgtagttaccggtcgggacgggtaacggaaccgtaacggtcccgtacgggtacccgtccggttaacggtccgaccggtacccggaaggtccccgg

SEQ ID NO: 234869 - DNA, 599 bp, Homo sapiens
  misc_feature: GYAE6OF02ITMA4.3.48.E04.1.454.CMB.1.raw
  modified_base (511)..(511): a, c, t, g, unknown or other
  misc_feature (511)..(511): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagcccaccctcagtgtccgtcgtccccagggcagacagccaccgtcacctgctctggacgaataagtttgggatacaaaatatagtcttccgttggtttcagcagactccgacggccctacgtccccgtgtcgtcgttcggtacctattccgtttacaagtaactaacccgaacgtcccgcccctacggaacggtacctcccgtaggacgtcgtacttcctcgtcggtacctaccgtaactcgtacgggaaccacgacgaccactccgtagaacctatcgacggccggaaccgagtactagtaggatggacgctagtactattcgtgtagacggtcgtaggganacgggccggcgtaccactacagttcgtacgggcggaaccggacaacgtcgtacgtacccgtcgtaggccgacgtacccgaggtccccg

SEQ ID NO: 234870 - DNA, 625 bp, Homo sapiens
  misc_feature: GYAE6OF02HO4K4.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataattgggatcaaaatatgtcttcctggtttcagcagactccaggccagtcccctgtgctggtcatctttcagactaccaagccgcccctcgacgggactcccgtgaacgcgtacttcctcgtcggcctccaacttcgtacgggacctaccgacgtcccacgttccgtacgacctacgtcgacggaccgggaccctacgggtactacgtggagttcggacggtcctagactttacttacgtggtacgacgggtacgtcggggaccacgggccgggaccggacctaccgttccgaagtttaccggttccgggaacgggtaccgggaaccgtaacggtaccgttacgggtaccccggttaccggtaacggttccgaaccgggtaccccgaaggggtcccccg

SEQ ID NO: 234871 - DNA, 614 bp, Homo sapiens
  misc_feature: GYAE6OF02F6063.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggccctcctatgagctgactcagcccaccctcagtgtcccgtgtccccgagggccagacagcccaccgtccacctgcctcgtggagattaagtttgggaatacaaaatatgtcttccgttggtttcagcagacctccgacggcccacgtccccctggtacgtccgttggtcctatttcctttacgaacgtactaacccaacgcccgacccccgtcgacgggtacctccgtagacgtcgtacttctcgtcgtcctacctactcgtacggaaccacgaccgcctactcgtacaaccacgtcgacggtaccggaccaggctagtgtagcgacggtctaacgtacttaacgtcgttcggacggtgggcggtaggacgcggccggtaccgacgtacctacgtagtcggtaccgggagggtaaccgacgaagccgtacgtaccgtacgtacggccgacgtaccgcgtaccccg

SEQ ID NO: 234872 - DNA, 610 bp, Homo sapiens
  misc_feature: GYAE6OF02JNFBW.3.48.E04.1.454.CMB.1.raw
tcagagacgcactccacgaccggtgctcgatttagagagcgtcacagagagaaggggcgtgggcctcaggaagcagcatcggaggtgcctcagccatggcatggatccctctcttcctcggcgtccttgcttactgcacaggatccgtggcctcctatgagctgactcagccaccctcagtcgtccgtgtccccagggcagacagccaccgtcacctgctctggagataatttggatacaaaatatgtcttacctggtttcacgtcagactccaggcctacgtcccctgtcgccgtggtcattctttacaagtactaccaagtccgacccctcgacgggactccctgacgcgtacttctcgtcggcctacctaacgtcgtagggaaccacgaacgcctactacgtcgaacctatacacggccggtacccaggtaccttagtggatcgacggtctagactacttacgtcgtacgacggtcgtacggtacgaggaccgggtcgaccgtaaccgttaccgaagttacggtttccggggaccggtaacgggtaccgaacgtccgtaacgggacccgttaccggtacggtacccgacggtaccccgaggtcccgg

SEQ ID NO: 234873 - DNA, 683 bp, Homo sapiens
  misc_feature: GYAE6OF02GPUMN.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccatggcctcctatgagctgactcagccaccctcagtgtccgtgtccccagggcagacagccaccgtcacctgctctggagataatttgggatacaaaatatgcttcctggtttcagcagactccaggccagtcccctgtcgcgtggtcattcctttacaagtactaccaagccgcccctacgacgggtactccccgtagacgtcgtactttcctcgtcggtccttacccgaaaccttccgtacgggaaccaccgacggaccctaaccgttccgtacggaaccctaacgttaccgaacgggacccggggaaccccacgggtaccttaaggttacgggaacttagggaacggtcgtacgtaaccgttaacgtttaaccgtggttaccgaggggtccgggttacggggaacgacgggccgggtaccgggaccgtaaccgtaccgtaacggttacggttccggggaccgggtaacgggaacccgtaacggtccgtaccggtacccggttaccggtacggtaccgaccggtacccgtaaccggg

SEQ ID NO: 234874 - DNA, 674 bp, Homo sapiens
  misc_feature: GYAE6OF02H8MF8.3.48.E04.1.454.CMB.1.raw
  modified_base (228)..(228): a, c, t, g, unknown or other
  misc_feature (228)..(228): n is a, c, g, or t
  modified_base (232)..(232): a, c, t, g, unknown or other
  misc_feature (232)..(232): n is a, c, g, or t
  modified_base (266)..(266): a, c, t, g, unknown or other
  misc_feature (266)..(266): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagcccaccctcagttcgtccgtcgtccccgagggcagacacgcccaccgtcacctgctcgngganattagttgggatacaaatatgcttccgtgtttcngcagactccgaggccacgtcccctgtcgtccgtggtcctattcctttacaaagtactaacccgaacggcccgtaccccgtcgaacgggtactcccgtagacgtcgtacttctcgtcggcctccaacgtcgtacggacacacgcctactctcgacctgtacgacggtccggacccgacggtctagtacggacgtacgaggtcgtacgtacttacgttaccgtgtaccggtaggtacggtaggggaacctgggcccgggacggtaccctaccgttaacccggtaactttaccgggttaccggggaccgggtaaacccgggtacccgtaacgggtacccgttaccgggtaccccggttaaccggttaccgggtaccggtaaccccggtaccccggtaagggttccccccgg

SEQ ID NO: 234875 - DNA, 909 bp, Homo sapiens
  misc_feature: GYAE6OF02GVCD6.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccagggcagacagccaccgtcacctgctcgtggagataagtttgggatacaaaattatcgacttccgtggtttcagcagacctccgaggccacgtcccctgtcgcttggtcagttctttacaagtacttacccgaagtcccgtaccccctacgacgggtaccttccccgtaggacggtcgtaactttccgtacgtcggtcctacccgtaaactccgttagggaaacctaccgaaccgtccctaaccgttacctaccgaacccgtacgttacccggaacgggtaccccggggtaaaccccgaacggggtacccgtttaagggtaacggggtaaaccgtttaccggggtacggggtaacccgtttacggtaaacccgttttaacgggttttaaccccgttaaccgggggtttaacccggtaacccgggggggttacccggggtttaccggggggaaccgtaaaccggggggccccggggggttaccccggaaaacccctttacccggggttaaacccccgttaaaggttttaccccggggtttaaccgggggggaaaccccggggggtaaacccggggggtaaacccctaaacccgggggttaacccggtttacccccggggtaaaccccccgggttttacccggggttaaaccgggggtttaccccggaaacccccgggtaaccccccgggttaaacccggggtttaccccccccggg

SEQ ID NO: 234876 - DNA, 599 bp, Homo sapiens
  misc_feature: GYAE6OF02GVI6P.3.48.E04.1.454.CMB.1.raw
  modified_base (390)..(390): a, c, t, g, unknown or other
  misc_feature (390)..(390): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataagttggatacaaaatatgcttcctggtttcagcagtacctccacggccacgtcccctgtcgtctggtctatctttacaacgtatacccgaagccgcccctacgagggtactcccgtgacgccgtattctcgtcggcctaccacgtcgtacgggaactacgacnccacgtctacgacctagtaccgacgtaccgggacccgtaggacctagtggatacggagtctagtacttacgttacngtacgnggcgtacggacgacgtcggacgtcacgttacccgagttacggttaccgggacggtaacgggtacctaacggtccgtaacggacccgttccggttaccggtaccgaccggtacccgaacggtccccgg

SEQ ID NO: 234877 - DNA, 662 bp, Homo sapiens
  misc_feature: GYAE6OF02HNJ4J.3.48.E04.1.454.CMB.1.raw
  modified_base (224)..(224): a, c, t, g, unknown or other
  misc_feature (224)..(224): n is a, c, g, or t
  modified_base (241)..(241): a, c, t, g, unknown or other
  misc_feature (241)..(241): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctgganataattgggatcaaatntgcttcctggtttcagcagactccgaggcctacggtcccctgtcgtcgtggtcacttctttacaacgtactaccgaacgccgtcccctacgacgggaccttcccgtggacgtcgtacttccgttcgtcggtcctaccgaacttcgtacgggaacacgtacgcctactccgtacgaacctacgtaccacgggtaccgggaacccgaggtacctacggtaggaactggacggtctagtaccttacgttacgtagtaccgagggtccggttacgggaaccgtagggcccggggacggaccgtaaccgtaccgtacgttaacggtttcccggggaacggggtaaccgggaaccgtaacggtacccgttaccgggaccccggtttaccgtaaccgggtcccaaccgggtacccgaacgggtccccg

SEQ ID NO: 234878 - DNA, 591 bp, Homo sapiens
  misc_feature: GYAE6OF02HFH6W.3.48.E04.1.454.CMB.1.raw
  modified_base (569)..(569): a, c, t, g, unknown or other
  misc_feature (569)..(569): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataattgggatacaaaatatgcttcctggttcagcagactccaggccagtcccctgtgctggtcatctttcaagtactaccaagccgcccctcgacgggactcccgtgacgcgtacttctcgtcggctcctaactcgtagggaaccacgacgcctactctacgacccaatccgacggccgggaccctaggacctagaggactggacgccgtatacttattactggtacgacggtcgtagggacacgggtccggacggacctaccgtaccgtaagttacgttccggggaacgggtacgggtaacccgaaggtccgttaccggacccgttacccgacgggttaaccncccggtacccgaacggtccccg

SEQ ID NO: 234879 - DNA, 606 bp, Homo sapiens
  misc_feature: GYAE6OF02FSUVP.3.48.E04.1.454.CMB.1.raw
  modified_base (245)..(245): a, c, t, g, unknown or other
  misc_feature (245)..(245): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagcccaccgtcacctgctctggagataagtttgggatcaaaatntgcttcctggtttcagcagactccgacggtccacgtcccctgtgcgtggtcattctttacaagactaccaagccgcccctcgagggactccgtgacgcgtattctcgtcgcctccactctagggaacacgacgccactctcgaccatccgaggccgggacccacggtactagtgggtatacggacggtctacggtacttacgtttacgtcggtacgtacgggcggttacggggacgtacgggccggccggacgtaccgtaccgtaacgttacgttacccggggcgggaacgggtacccgtaaggtccgtacggtacccggttaccggttacgggtaccaccggtacccgaaggtcccccgg

SEQ ID NO: 234880 - DNA, 581 bp, Homo sapiens
  misc_feature: GYAE6OF02GDNGP.3.48.E04.1.454.CMB.1.raw
  modified_base (395)..(395): a, c, t, g, unknown or other
  misc_feature (395)..(395): n is a, c, g, or t
  modified_base (427)..(427): a, c, t, g, unknown or other
  misc_feature (427)..(427): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataagtttggatacaaaatatgcttcctggtttcagcagactccaggccacgtcccctgtgctggtctgtctttcaagtactaccaagccgcccctacgacgggactcccgtgacgcgtattctcgtcggcctcctaactcgtagggaaccacgacgccacctctcgaccntcgacggccgggacccaggctagtggatcggngctagactagttctgtcgaggtcgtagggacagggccgggcggtaccacctaccgtatacggttaccgggaccgggaacgggacccgaaacggtcccgtacggtaaccccggttcccgtagggttacccgacggtaccccggacgggtccccgg

SEQ ID NO: 234881 - DNA, 774 bp, Homo sapiens
  misc_feature: GYAE6OF02JVBCE.3.48.E04.1.454.CMB.1.raw
  modified_base (324)..(324): a, c, t, g, unknown or other
  misc_feature (324)..(324): n is a, c, g, or t
tcagagacgcactccacgaccggtgctcgatttagagagcgtcacagagagaagggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccagggcagacagccaccgtcacctgcctctggatattaagttgggatacaaagtatgtcttctggtttcagcacgactccgaggccacgtcccctgtgcgtggtcacttctttacaagtactaccagtccncccctagacggtacctcccgtagacgtccgtacttcgtcgtcggacctacccgtaacgttcgtacgggaactaccgacggtacccctaacgttacctaccggaaccctaaacgttacccggaaaccgggtaccccggggtaaaccccgtaaggggtaaccccttagggtaaccgggtaacgttaaccgggtacggtaccgttaacgtaaaccgtttacgtttaaccgttgggtaacccgggtaagggtccggggtaacggggtaaccgtccggggtacccggggtaccggtacccgttaacccgttaacccggaacgttttaacgggttacccggggaaacggggttaacccgggaaccgtaaaccgggttcccggttaaccgggtaacccggttacccgggttaaaccgggtcccgaacccgggtacccccggagggttaccccccggg

SEQ ID NO: 234882 - DNA, 553 bp, Homo sapiens
  misc_feature: GYAE6OF02G0PT9.3.48.E04.1.454.CMB.1.raw
  modified_base (243)..(243): a, c, t, g, unknown or other
  misc_feature (243)..(243): n is a, c, g, or t
  modified_base (456)..(456): a, c, t, g, unknown or other
  misc_feature (456)..(456): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataagttggatacaaaatntgtcttctgtttcagcagactcagccacgtcccctgtgctggtcatctttcaagactaccaagccgtcccctcgacggtctcccgtgacgcgtacttcctctcggtcctaccaactcgtacgggaaccacgacgccctactccgtacgacccatccgacggccgggaacccaggcctagtggatggagcgtgtactattacgtgtaccgaggngtcgggacgaggccggcgacgtacctaccacgttacgtccgggacggacggaccacgtcgtacggaccgtcgtacgtccgacggtacccgagtcccg

SEQ ID NO: 234883 - DNA, 606 bp, Homo sapiens
  misc_feature: GYAE6OF02IPJ7H.3.48.E04.1.454.CMB.1.raw
  modified_base (224)..(224): a, c, t, g, unknown or other
  misc_feature (224)..(224): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctgganataatttggatacaaaatatgcttcctggtttcagcagactccaggccagtcccctgtgctggtcatctttcaagataccaagccgcccctcacgggatcccgtgacgcgtacttctactcggtctaccgtaaactccgtagggaacacgacgaccactcctagacccatcgacggaccgggacccagggacctagtggataggacggtactgaacttaagtttactgttacgtacgggcggtagggaccgtagggccgggacggtaccgtacctaccgtaagttaccgttaccggggacgggtaaccgggaaccgtaacggtaccgtaccggaacccggttaccgtacgggttaccgaccggtaccccgaagggtccccgg

SEQ ID NO: 234884 - DNA, 702 bp, Homo sapiens
  misc_feature: GYAE6OF02JGN4H.3.48.E04.1.454.CMB.1.raw
  modified_base (270)..(270): a, c, t, g, unknown or other
  misc_feature (270)..(270): n is a, c, g, or t
  modified_base (379)..(379): a, c, t, g, unknown or other
  misc_feature (379)..(379): n is a, c, g, or t
  modified_base (603)..(603): a, c, t, g, unknown or other
  misc_feature (603)..(603): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccgagggccaggaccacggacccgacccggtccaacccgtgccttccgtgggacataacgttttgggatacaaaaagtntgctttcctggtttcaggcagaccttccgaggtacccacgtcccccttgtacgtccgttcggtcctaattccttttacaaggtacttacccgaagtcccgcccccgtanaacggggtaccttccccgtaggtaccgtcgtaacgttttcctcccgttgggacccttaacccgaacgtttcccggttaacggggaaaccctaccgaaccgtcccaaccgtttccgtaaccgaacctaccgtaccgtaaccgggcccgggtacccgaaacggtccgtacgtagggactggaaccggcttacgtactattaacgtgtacgacgggtgtacgggacngtccgggctctaccgtcctagttcggtaccgggcgggtaaggcccaaggtccctacggtaccccgtaccgtacggtccggaccgacccgtacgtcccgg

SEQ ID NO: 234885 - DNA, 740 bp, Homo sapiens
  misc_feature: GYAE6OF02IHMQP.3.48.E04.1.454.CMB.1.raw
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccacctcagtgtccgtgtccccagggcagacagccaccgtcacctgctcgtgganataagtttggaatacaaaatatnccttacctggtttcagtcagtacctccgaggcctacgtcccctagtcgcgttggtactacttctttacgaacgtacttaaccgaacgtcccgaccccgttacggaacgggtaaccttcccgtaacggtacgtaccgtaacgttttcctaccgttcgggtacccttacctaaccgtttcggtaaccggggaaaccctaacgaccgtaccctaacttccgtacgaaaccgtactaccgtacgggacccgggaacccgtacgggaccttaaggtcgggaagttcggaacggtccgtacgtaactaacgttacgtacggtacgacgggtacggtcgggtaaccacgggtccggggacgtacctaaccgtacccgtaacgtacggtttacccggggaacggtaccggggtaacccgtaaggtaccccgtacgggttaacccccgttaccgggttaccggtaacccggaacccgggtaccccggtaaccgggtcccccg

SEQ ID NO: 234886 - DNA, 721 bp, Homo sapiens
  misc_feature: GYAE6OF02GHTJ6.3.48.E04.1.454.CMB.1.raw
  modified_base (255)..(255): a, c, t, g, unknown or other
  misc_feature (255)..(255): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccgagggcagacacgcccaccgtcacctgcctcgtggatattaagtttggactacaaaatntgctttccgtggttcagcagacctccgacggcctacgtccccgtgtcgtcgttcggtctacttcctttacaacgtactaacccgaacgcccgtacccccgtacgacgggtaccttcccgtaggacgtacgtactttccgtcgtcggtacctaccgtaacgtcgtacgggaaaccaccgacgaccctactaccgtacaaccacgtccgacgggacccggacccgtaggtaccgtaggtacggtagtacggacgtactacgtacctttaagttccgtacggtaccggtacgggtccgggtaacgggaccgtacgggccggtaccggtaccgtaacccgttacgtaacgttaccgggttaccgggggaaccggggtaacgggtaacccgtaagggttccccgtaaccgggtacccggttacccggttaacgggtacccggaacccggtacccggaccggttacccccgg

SEQ ID NO: 234887 - DNA, 734 bp, Homo sapiens
  misc_feature: GYAE6OF02HSS8P.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccgagggcagacagcccaccgtcacctgctcgtaggatattagtttggatacgaaaattagtcgtcctttccgttggtttacagtccacgaccttccgacggccctaccgtccccgtggtcgtcgttcggtacctacttccgtttaacgaagtacctaaccaacggccccgtcccctaggacgggtacctcccgtggacgtccgtaactttccgttaccgtcggtaccttacccgaacgtttccggtaacgggaacctaaccgaccgtacccacgttcccgtaccggaaccctagtaccggaccgggtacccgggaacccgtacgggtacctacgggtagggtacggtacgggacggttacctaggtaacctttaacgttccgtacggtacgggtacgggtcgggtacgggtaacgccgggtcgggacccgtaccgtaacgtacccgtaaggttccggtaacgggcgggaacggtaaccgaccggtcgtacccggtaccggttccggacggttacccgaaccggacccggtaccgtccccgg

SEQ ID NO: 234888 - DNA, 714 bp, Homo sapiens
  misc_feature: GYAE6OF02JFTBK.3.48.E04.1.454.CMB.1.raw
  modified_base (248)..(248): a, c, t, g, unknown or other
  misc_feature (248)..(248): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagcccaccctcagtgtcccgtcgtccccagggcagacagccaccgtcacctgctcgtggatagttaagttggatacaaatntgtcttccgtggtttcagcacgactccgacggccacgtccccgtagtcgtccgtggtctacgttcctttacgaaacgtacgtaacctaacggcccgtacccccgtagacggtaccgtcccgtgacggtactacgttcctacgtcggacctacccaacgtccgtaacggtaacgacccgtacgtacccgtaccgtactacccgactaacgtcccgtaacgggaccccgggaaccgtaccgggtacttaccggtagggtaaccgtgggtaaccgtacccggtaataccggtttaactaccggttttacggaaccggtacggtaccgggttaggaccggtaaccgggtccggtaccgaccgtaaccgtccgtaagttaccggtccgggtacgggacggaaccgtaacggccttaccggttacccggtccgtaccggtaccgtaaacccggtaccggaacccggttcccg

SEQ ID NO: 234889 - DNA, 689 bp, Homo sapiens
  misc_feature: GYAE6OF02G949Z.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagcccaccctcagtcgtcccgtgtccccgagggccaggacacgcccaccgtcacctgcctctaggagtagttaagtttgggaataacaaaatacgtgtctttccgttcggtttacacgctagaccttaccgacggaccctaccggttccccgtggtcgtcgttcggtctacttcctttacgaacgtaactaccgaaccgccgacccccgtacgtaacgggtactacccgtggaacgtcgtactttccgtcgttcggtacctacctaaccgtacgtacggaaccaccgacgtcccactcaccgaccagtacgcggaccgggacctacggctacggtgtaagtcggaggtacgtaacgtacttacgttacgtccggtacgacgggtacgggtacgggaacgccggggacggcccggtaccaaccgtacgtaacgttacggtaacgggcgggtaaccggaaccaacgggtcgtaacggtacccggtacggtaaccggtaccggaaccgaccggtaccgtccccgg

SEQ ID NO: 234890 - DNA, 615 bp, Homo sapiens
  misc_feature: GYAE6OF02HS803.3.48.E04.1.454.CMB.1.raw
  modified_base (147)..(147): a, c, t, g, unknown or other
  misc_feature (147)..(147): n is a, c, g, or t
  modified_base (290)..(290): a, c, t, g, unknown or other
  misc_feature (290)..(290): n is a, c, g, or t
  modified_base (494)..(494): a, c, t, g, unknown or other
  misc_feature (494)..(494): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgnggcctcctatgagctgactcagccaccctcagtgtccgtgtcccagggcagacagccacgtcacctgctcgtggatataatttcgggatacaaaattagtgacctttcctggtttaccaggtcagctcgagccacgtccctgngcgttggctatcttcgaagtactaccgaagccgtcccctaggacggactcccgtagacgcgtacgttctcgtcggcctaccaccttaggtacgggaacaccaccgaccctacgtaccctgaacccgtactaccgaaccggccgggtaaccccaggtaccgtaagtgggtacgtggacgtcgtacgagtttacctgtcgtaccgngggtacgtacggtacgcgtaccgggacgtacgacgttaccaggttaacgtcgggaacgggtacggacccacggtcgtaccgtaccggaccggttacggtaccgacggaccgtaccggtacc

SEQ ID NO: 234891 - DNA, 724 bp, Homo sapiens
  misc_feature: GYAE6OF02G311N.3.48.E04.1.454.CMB.1.raw
  modified_base (178)..(178): a, c, t, g, unknown or other
  misc_feature (178)..(178): n is a, c, g, or t
  modified_base (256)..(256): a, c, t, g, unknown or other
  misc_feature (256)..(256): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagcccaccctnagtcgtcccgtacgtccccgagggcagacaggcccacccggtcacctgcctctggagtataagtttggatacaaaatntcgcttaccgtggtttacagtcagacctccgacggccctaacgtccccctaggtcgtaccgtggtcctaatttcgttacaagtactaccgaagtcccgacccctcggtaacgggtcctcccggttagacggtactacgtttccttcgacgggtcctaccctaaccgtcgttacgggaaacctacgacgtacccaacgtccgtacaacctaacgtaccgaacggaccgggtaaccccaggtaccgtaacgtcgggtaacgttcggacggtaccgtacgtaaacttacttacggtacgtaccggaacgggtacgggttacggacgtcggtccgggaccggtaaccgtaccgtaacccgtagttacggttacccggggaaccggggtaacgggaaccgtaaacggtcccggtaacggtaccccgttcgggttaaccggaccgtaacccgggacccggtaacggttccccgg

SEQ ID NO: 234892 - DNA, 765 bp, Homo sapiens
  misc_feature: GYAE6OF02GUV0O.3.48.E04.1.454.CMB.1.raw
  modified_base (621)..(621): a, c, t, g, unknown or other
  misc_feature (621)..(621): n is a, c, g, or t
tcagagacgcactccacgaccggtgctcgatttagagagcgtcacagagagaaggggctgggcctcaggaagcagcatcggatgtgcctcagccatggcatggatccctctcttcctcggcgtccttgcttactgcacaggatccgtggcctcctatgagctgactcacgcccaccctcagtcgtccgtcgtccccgaggcagacacgccaccgtccacctgctcgtggagtataagtttgggactaacaaaatagtcgtccttaccgtttcggtttcgacgtcacgtaccgttccgaaccgggtcctaccgttccccgttgtacggtccgtttcggtcctactttaccgtttacaaaggtaacttaaccccgaagtcccccgtacccgtacggacgggtaccctcccggttagacgaccgttacgtttcgtacgtcgggtacctaccgtaaaccgtcggtaacggaaccacgtaacgccctaacgtccgtacgaccctagtcggaaacgggcccggaacccgtaaggtccgttaggtacggacgttaacggaccgttacgttaccgttaacttaacggtttacgtaccgttaggggaccggggtacggttacggggaacncccgggtaccggaccgggacttaacccccggttataaacggggtttccggcccgggggaacgggaaccggtaccgtaacggtcccggtacggtaaccccgtttaccggggttaacggcccgttaaacgggcccccgtaaccggg

SEQ ID NO: 234893 - DNA, 686 bp, Homo sapiens
  misc_feature: GYAE6OF02GNS2K.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcacgccaccctcagtcgtccgtcgtccccagggcacgacacgcccaccggtccactcgtctcgtggagattaagttgggataacaaattatcgtcttccttggtttacagacgtagactacgacggcctaccgtccccgtgtcgtcgtacgtctactcctttacgaacgtactaaccgaacgtccccgtaccctacgtacggacctcccgtagacgtacgtcttctccgtcgtcctacctacgtcgtacggaacaccgacaccctacgtctaccgaacctagacccgacgggacccgtacccgaggtaccgttaagcgtacggtaggacggtacgtaactacgttaacgttaccgtcgtacggacggtcggtacggacggtaccgggcgggtacgacccgtacgtaccgttacgtaccggtaccgggaccggggtaacggaacccgtaacggtccggtaacgggtacccggttacccggttaccggaaccgtcccgggtaccccgtacggttacccccgg

SEQ ID NO: 234894 - DNA, 768 bp, Homo sapiens
  misc_feature: GYAE6OF02IJNGV.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtcggcctcctatgagctgacctcacgcccaccctcagtcgtccgtcgtccccgagggccagacacgccaccgtcacctgctcgtggagattagttggatacgtaaatgtgtccttcgtggttcagctacgacctccgacggccctaccgttcccctggtcgtccgtcggtactactttccttacgaacgtacctaaccgaaccgtcccgtacccccgtaggtaccgggtacctccccggtagtaccggtaccgttacgtttccgtcggtaccggtacctacccgtaacgtaccggtacgggaaccaccgtaccgtaccctaccgtaccgtaccgaacctacgtaccgaccggggacccggtaacccgtacggtcgtaacgtacggtacggtacggtacggtaccgttaacgtaaccgttacggttaccgtacgggtacgaccgggggttaccggtacgggtaacgggtccgggtcccgggaaccgtacccgaccgttaacccggtaggttacccgggttacccggggaacggggtaacccggtaaacgtacgggtacccgttacggtaacccggtaccggtaccgggttaccgaacccggtaccccgggaacgttcccccgg

SEQ ID NO: 234895 - DNA, 868 bp, Homo sapiens
  misc_feature: GYAE6OF02GHRUW.3.48.E04.1.454.CMB.1.raw
tcagagacgcactccacgaccggtgctcgatttagagagcgtcacagagagaagggctgggcctcaggaagcagcatcggaggtgcctcagccatggcatggatccctctcttcctcggcgtccttgcttactgcacaggatccgtggccctcctatgagctgactcagcccacctcagtcgtccgtcgtaccccgagggcagaccgacgcccaccgtccaccttgaccgtcgtcggaagtaagttaacggttttggggaacttaacgtaaaaaacttagttcgttacccgtttacccgtttgggttttacccaaaggtacctaacggacccgtttacccggaaccggggtacccgttaacccggttccccccgttaaggtccggtacccgtttcgggttaaccttaaccggttttccgttttaacgaaaaccggttaaccgttaaaaccccggttaaacggcccccggacccccgtttaccgggaaccggggtttaacccttaccccggtacggggtaacgtaccgttaaccttttccgtaccggttaccgggtacccttaaccccgttaacggtacgggtaaccgggtaaaccgaccgtaccgtacccgtaacgttacccgtaccgaaccgtaacccgttaccggaaaccgggtcccggggaacctcgggtacccttaggacggtaacgtcgggacgtcggtaactagttaaccgtttacgcggacgtacgggtcgtaacggaacgccgggacgtccgtaacaaccttacggagttacggtcgggaacggtaaccgtaccgtaacggtaccttaccggaacggtttacctaaggggtcccaaccggttaccggacttacccccggg

SEQ ID NO: 234896 - DNA, 775 bp, Homo sapiens
  misc_feature: GYAE6OF02FKW8G.3.48.E04.1.454.CMB.1.raw
  modified_base (179)..(179): a, c, t, g, unknown or other
  misc_feature (179)..(179): n is a, c, g, or t
tcagagacgcactccacgaccggtgctcgatttagagagcgtcacagagagaaggggctgggcctcaggaagcagcatcggaggtgcctcagccatggcatggattccctctcttcctcggcgtccttgcttactgcacaggatccgtggcctcctatgagctgactcacgccaccctnagtcgtccgtgtccccgaggcagacagcccaccgtcacctgctcgtggagattaagttggatacaaatatgcttcctggttacagctacgacctccacggaccctacggtaccccctggtcgtcttacgggtctacttccgtttaccgaagtactaacccgtaacgtacccgtaccccccttacgacgggtacctcccgtacggacgtaccgtacgtttcccgttacgttcgggtacccttaccctaaaccggtttccgtacgggtaaacctaccgaaccgtacccgtacccgttaccgtccgtaaaccccgtaacgttacccggaaccgggtaccccgggaaccccgagggtacccgttaacgttcggtaaggtacggaccgggtccgtacgtaaccgttacgtttaacgtacggtacgtacggtccgggtacggtaaccgacggcccgggaccgtccgtaaccttacccgttaagttaccgggtttaccgggaaccgggttaacgggaacccgtaaccggtaccgtacccggggtaacccgttacccggtaaacggttacccgtaacgggtaccccggtaacgggtacccccgg

SEQ ID NO: 234897 - DNA, 817 bp, Homo sapiens
  misc_feature: GYAE6OF02FK0OW.3.48.E04.1.454.CMB.1.raw
  modified_base (247)..(247): a, c, t, g, unknown or other
  misc_feature (247)..(247): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtcgtccgtgtccccagggcacgacacgccaccgtcacctgcctctggagataatttgggatcaaaatntgcttcctggtttcagcagactccaggcccagtcccctgtcgcttcggtctacttctttacaaacgtactaacccgaaagcccgtacccccgtagaacggggtacctccccgttaggaacgtccgtaacgtttccttacgttacggtcccttacccaaaccgtttcggtaacggggaaaccctacgaaccggtccctaaccgttccgtaacgtaaccccgtaacgttaccccgacgggtaaccccggggtaaccccgaacggggtacccttaaacggttcggggtaacgttacgggtaacgggtacccgttaggtaaacctttaacggttttacccgtaagggttacccggtacggggtaccggttaacgggggaacccgtacggggacccgggtacccggtaaccgttaacccgttaaccgtaaaccggttacggtttaaccccggggggaacgggtaaaccgggggtaacccgtaaacgggtcccggttaacccgggttaacccccgggttaccggttaaccggggttacccgaaccccgggtaccccggtaaacggggttcccccgg

SEQ ID NO: 234898 - DNA, 759 bp, Homo sapiens
  misc_feature: GYAE6OF02GSF4M.3.48.E04.1.454.CMB.1.raw
tcagagacgcactccacgaccggtgctcgatttagagagcgtcacagagagaaggggctgggcctcaggaagcagcatcggaggtgcctcagccatggcatggatccctctcttcctcgcgtccttgcttactgcacaggatccgtggcctcctatgagctgactcagcccaccctcagtcgtccgtcgtccccgagggcagacagccaccgtcacctgactcgtgagataagttggatacaaaatatgtcttccgtggtttcagcgacgacctaccgacggcctacgtccccgtggtcgcgtcggtacctacttctttacgaacgtaactaaacccgaagaccccgtaccccctacgaacgggtaccttacccgtagtaacgaccgttaactttccgttcgtacggtcccttacccgtaaccgtaccgtaaccggggaaacctaccgaccgtacccaccttaccgacgtaacccgtatacccggaacgggtcccgggaacccgtacggtaccttacggtaggtacgtaaggtacggtaccgttaggtaaccttaagttaaccggttacggttaaccggtacggggtaccggtacggggtaaccggtacgggccggggtacccgtacgtaacccgttaccgaacggtttaccggttaccggggaaccggggaaaccggtaacccggtaacggccgggttaaccgaacccggttacggttaaccggaacccggaccggtaaccccggtaacggtccccgg

SEQ ID NO: 234899 - DNA, 566 bp, Homo sapiens
  misc_feature: GYAE6OF02IXI4H.3.48.E04.1.454.CMB.1.raw
  modified_base (322)..(322): a, c, t, g, unknown or other
  misc_feature (322)..(322): n is a, c, g, or t
  modified_base (329)..(329): a, c, t, g, unknown or other
  misc_feature (329)..(329): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataatttgggatcaaaaatatgcttcctgtttcagcagactcaggcctagtcccctgtgctggtcagtctttacaagactaccaaagccgaccccttnaacgggntccctgacgcgatttactctggctaccaaacgtctagggaacacgacgacactctacgacccaatcagtcgggaccaaggcctagtggaatggaaggtcctggtaactagtttaactgtaccgagggcggttagggcctaaggccgggcggaccgactacccgaagttaacgtacgggccgggagggaaccaaggaccgagacccggttccaagggtccaaggccccgtaagggccc

SEQ ID NO: 234900 - DNA, 753 bp, Homo sapiens
  misc_feature: GYAE6OF02HS3HJ.3.48.E04.1.454.CMB.1.raw
  modified_base (226)..(226): a, c, t, g, unknown or other
  misc_feature (226)..(226): n is a, c, g, or t
  modified_base (297)..(297): a, c, t, g, unknown or other
  misc_feature (297)..(297): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccagggcagacagccaccgtcacctgctctgganatattgggatacaaatatgtcttcgtgtttacagtcagactcgagcccacgtcccctgtcgcgtggtcctnttctttacgaacgtactaaccgaaccggcgacccccctgaccgggacttacccgtagcggtaccgtacttccgtacgttcggtaccttaccctaaccgttccgtacgggaaacctaacggtacgtaccctaaccgttcccgtacgtaaacccctacgtaccgaaccgggtacccgggaccccggtacggtaccggttaaggtccgggtaaacttacgggaccgggtacgttacggtaaacctttaacgtttaaccgttacgggttaccggtacgggtacgggtacgggaaccggtacgggtacccgggccggaaccttaacccgtacccgtaacgtttaccgggttaaccggggacggggtaaccggggtaaccgtaaccggtcccggtaacgggttaccccggttcccggttaacggttacccggtaacccgggtaccccgtaacggtcccccgg

SEQ ID NO: 234901 - DNA, 708 bp, Homo sapiens
  misc_feature: GYAE6OF02JURMU.3.48.E04.1.454.CMB.1.raw
  modified_base (552)..(552): a, c, t, g, unknown or other
  misc_feature (552)..(552): n is a, c, g, or t
tcagagacgcactccacgaccggtgctcgatttagagagcgtcacagagagaagggctgggcctcaggaagcagcatcggaggtgcctcagccatggcatggatccctctcttcctcggcgtccttgcttactgcacaggactccgtcggcctcctatgagctgactcacgccaccctcacgtgtccgtgtccccgagggcagacacgccaccgtcacctgactcgtggacgtattaacgtttggataacgtaaatatcgtcttccgttggtttacacgctacgactccacggccctaccgtcccctggtctaccgtgtactacgttcctttacgaaaggtactaccgaacggtcccgaccccggttcgaacgggtacctacccggttgaaccgtacgtacttccgtacgtccgggacttacctaacgtacgtacggaacctacgacgtacccgtactccgtacgtaacctactccgacggaccgggtaccgacggtaccgtaggtacggtacgtacggacggtacctacgggtaactttacgttaccgttntaccggtacgggtccgggttaacgggtaccgtacgggtacccgccggacctaacgttaccgtaaaccgttcggaccggggttaacccgggaaggtacccgaaacgttcggtaaccgtcgtacccgtaggacccgtacggacccgtaggtcccccgg

SEQ ID NO: 234902 - DNA, 822 bp, Homo sapiens
  misc_feature: GYAE6OF02HATGA.3.48.E04.1.454.CMB.1.raw
  modified_base (162)..(162): a, c, t, g, unknown or other
  misc_feature (162)..(162): n is a, c, g, or t
  modified_base (254)..(254): a, c, t, g, unknown or other
  misc_feature (254)..(254): n is a, c, g, or t
tcagagacgcactccacgaccggtgctcgatttagagagcgtcacagagagaaggggctgggcctcaggaagcagcatcggaggtgcctcagccatgggcatggactccctctcttcctcggcgtccttgcttactgcacaggatccgtggcctcctatganctgactcagcccacctcagtcgtccgtcgtccccgagggcacgacacggcccaccgtccacctcgctcgtggatattagttggatacaaatntcgtacttcgttggttacacgcacgtctccgacggtcctacgtccccgtgtcgtcgtcggtctacttcctttacgaacgtaacctaaccgaaccgtcccgtcccccgtacggtaacgggtccttcccgtacggaccggtacgttactttccgttacggtccggtacccttacccgttaaccgtaccgggttaacggaaccctaacgtacccggacccttaccgttccgttaaccgaaaccccgttaccgtaaccgggaacccggggtacccgggtaaacccggtaacggttacccggttaagttccggggtaaacgttggggaaccggttcccgttaacgttaacgtttaccggttcggttaaccgggtacgggttacggggtccggggttaaggggacccggttaccgggggaccggtaccggtaaccctaccgttaccggttaacggttccgggttaaccggggaccgggtaaccgggaaccggtacggtacccgggtttaccggtacccggtttacgggtaacccggaacccgtaccgggtaccccgtaacccgggttcccccgg

SEQ ID NO: 234903 - DNA, 798 bp, Homo sapiens
  misc_feature: GYAE6OF02F9KS5.3.48.E04.1.454.CMB.1.raw
  modified_base (255)..(255): a, c, t, g, unknown or other
  misc_feature (255)..(255): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccggtggcctcctatgagctgactcacgccaccctcagtcgtccgtcgtccccgagggcagacacgccaccgtcacctgcctcgtggagtataagtttgggatacaaaattntacgtctttccttggtttcagtacacgacctccgacggaccctaccggtcccccgtaggttcgacgttcggtacctacgtttccttttaacaacggtaactaaccgaacggtcccgtaccccccgttagacgggtaccttaccccgtggaaccgtccgtactttaccgtcgttaccgggtacctaaccccgtaacgttacccggtaacgggaaaacctaccgtaccggtacccctacgtaccgttacccgaaacctaacggtaccgtaaaccgggcccgggaaacccgtagggtacccttaaggtagggaacgtacgggtacggtccttaacgtacctttaacgttacccgtggtaaccggtggggtaaccggtcgggacgtaacggggcccgggccggtaaccgtaaccgttaaccgttaacggtacggggtttacccggggaaccgggaaccggggtaaaccctaccggtaccgtaaccggttaccccggttacggttaaacccgggaccggtacccggaccccggtaacggtccccccgg

SEQ ID NO: 234904 - DNA, 743 bp, Homo sapiens
  misc_feature: GYAE6OF02JJHQP.3.48.E04.1.454.CMB.1.raw
  modified_base (254)..(254): a, c, t, g, unknown or other
  misc_feature (254)..(254): n is a, c, g, or t
  modified_base (278)..(278): a, c, t, g, unknown or other
  misc_feature (278)..(278): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgttccttgcttactgcacaggatccgtggcctcctatgagctgactcagcccacctcagtcgtccgtcgtccccgagggcagacacgcccaccgtcacctcgcctcgtggagacttaagttggatacaaaatntcgtcttaccgtggtttacacgtnacgtaacctccgacggaccctacggttcccctggtcgtccgttcgggttacctactttcctttacgaaacgtaaccttaaccgaaccgtacccggccccttaacgacgggtaccttaccctggaactcgtaacttcgtcgtcgcctaaccgtacttacgtacggaaccacgacgcctaccgtctaaccggaccctagaccggtacggacccgggaaaccgtacggtacgtaacgttacgggtaacgtcgggtaccgttactaccggttaaacgttacgtttaaaccgtgggttaccggaacggggttacggttaccggggaaccgtgggtaaccggaccgggtactaaccctaaccggtacgtttaccggggaaccgggtccggaaccggtaaccgtaacgtcccggttaaaccgcccgggttacgttaaaccgggtacgacccggtaacccgtacggtccccgg

SEQ ID NO: 234905 - DNA, 771 bp, Homo sapiens
  misc_feature: GYAE6OF02G37CB.3.48.E04.1.454.CMB.1.raw
tcagagacgcactccacgaccggtgctcgatttagagagcgtcacagagagaagggctggcctcaggaagcagcatcggaggtgcctcagccatggcatggatccctctcttcctcgcgtccttgcttactgcacaggatccgtggcctcctatgagctgacctcacgcccaccctcagtcgtcccgtcgtccccgagggcacgacacggcccaccggtccaccgtcgcctcgtaggagtaattaagttgggatactaaaagtatgtcttccgttggtttcagcgtagacctccgacggtcccaccgttccccgtgttcgccgttcggtcttaactctttacgaacgtactacccaacggccgtccccctaggacggtactcccgtgacgtcgtacttcgtcgtcggtacctacccgtaacgttccggtaacgggaaaccaaccgtaccgtaccctactccgtaccggtaacctacggtaccaccgggacccgggtacctaacgggtcctaggttacgggacgtacgggtaacggttacgtaccgttaacgttacgttacgtacggtaccgggtacgggtaccgggtacgggaaccggtacgggcccggggaaaccgtacccgtccggtaaaccttacgggttaccgggttacccggggaacgggtaaccccgggaaacgtacccgggtaccggttacccgggtaaccccggtttaccgggtaaccggttaccgaacccccgggttaccccggtaacggggtaccccccgg

SEQ ID NO: 234906 - DNA, 871 bp, Homo sapiens
  misc_feature: GYAE6OF02GWOXM.3.48.E04.1.454.CMB.1.raw
  modified_base (184)..(184): a, c, t, g, unknown or other
  misc_feature (184)..(184): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtcccttgcttactgcacaggatccgtcggtccctcctatgagctcgatcacgcccaaccctnacgtcgttccgtacgtccccgagggcacgacgacgtcccgaccgttccacctcgtccgtcgtaggtaacgaagtttaaggttacgggaacttaacctaaaacttgttaccgttccttttacccgggttagtttaccgacgtaaccgtaggacccgtttaccgaccggttacccgtaacccgttcccgttggtccgttacgtcggtaccgtttacttacctttaacgaagttaacccaaccgaacccggtccccgtaccccgtaaccggagggtacccttaccgacgggtaactaccgttacgttaccgtcgtaccgtacccgttacccgtaacgttcggtaacggaactaccggaccttaccaccgttaccctaccgaaccctagtacccgggaaccggcccggggtaaacctaccgggttgtaaacggtcggtaacggtacgggtacgttaccggttaccgttaaccgtttaacgttacccgtacgggtaaccggttcggggttaacgggcccgtaaggggacccggcccgggtaaaccctacgaacccggtttagttaaccgttccggggtaaccgggggacctaaacccggggaacttccccgggtaacccggtacggtttcccccggttaaacgggtaccccggaaccgttaacccgggtaccccggtaccggttacccccgg

SEQ ID NO: 234907 - DNA, 627 bp, Homo sapiens
  misc_feature: GYAE6OF02HL1NH.3.48.E04.1.454.CMB.1.raw
  modified_base (181)..(181): a, c, t, g, unknown or other
  misc_feature (181)..(181): n is a, c, g, or t
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
  modified_base (241)..(241): a, c, t, g, unknown or other
  misc_feature (241)..(241): n is a, c, g, or t
  modified_base (293)..(293): a, c, t, g, unknown or other
  misc_feature (293)..(293): n is a, c, g, or t
  modified_base (533)..(533): a, c, t, g, unknown or other
  misc_feature (533)..(533): n is a, c, g, or t
tcagagacgcactccacgaccggtgctcgatttagagagcgtcacagagagaaggggctgggcctcaggaagcagcatcgggaggtgcctcagccatggcatggatccctctcttctcggcgtccttgcttactgacacaggatccgtggcctctatgagctgactcgacgccctaccctnacggtcgtccggtcgtaccccgagggccagaccacgcccaccgtcaccttnctcgngganattaagttggaataacaaagtatgtccttacgttcggttcacgtcacgtacncgacggcctacggtccctgtcgcgtcgtactacttaccttacgtaactaactaaccgaacgtcccgtacccaggtaccggtactccgtagacgtaccgtacttcgtacgtcgactacaacgttcgtaacggaacctacgacgtccaaccttcgacactacgtccgacggaccgaactcggtctacggtggagtggaacgtcgagtattacgttgtacgtaccgtgggacggtcgtaacgnggccgcgtaacaccgagtaagtcggtaacgggccggaagaccgtagtacgtccggtaaccgttcggtaggtacccacggtaccgtaacggcccg

SEQ ID NO: 234908 - DNA, 789 bp, Homo sapiens
  misc_feature: GYAE6OF02GQRCZ.3.48.E04.1.454.CMB.1.raw
  modified_base (185)..(185): a, c, t, g, unknown or other
  misc_feature (185)..(185): n is a, c, g, or t
  modified_base (637)..(637): a, c, t, g, unknown or other
  misc_feature (637)..(637): n is a, c, g, or t
tcagagacgcactccacgaccggtgctcgatttagagagcgtcacagagagaaggggctgggcctcaggaagcagcatcgggaggtgcctcagccatggcatggatccctctcttcctcgcgtcctgcttactgcacagctccgtggcccttctagtgacgtctgtacctcacgccctacccgtntacggttcgttcccgtcggtcccgagggcacgacacgtacccaccgtccacgtcgcctcgtggaatacgttaaggtttacggaataacgtaaaattcgttacgtccttttaccggttgggtttaccggacgaccgttaccgttacccggacggtcccgttacggttccccgtgtccggtcgtaccggtacttacgttacctttaactaagtaacctaacccgaccgtcccgtaccccgtaggaccggttaccccttcgtaacgtagggtaaccctttacttccggttaccgggttcgtacccctacgttaaccgttccgggtaaaccgggaacctaccgacccgtttacccttacccgtacgtaccgtaaccgtacgttacccggaaccggggcccgggaaacctacggttagaccgggttaggacggttaacggcttacgggttaaccttnttaacccgtggttaccggtacgacgggtaggaccgtacggaccgggtccgggtcaaccgtacgtacgtacggttacggacgggaccggtaagtaccgaacgccggtttacgaccgttagggcctaccgacgtacccgtaggtccctacccgg

SEQ ID NO: 234909 - DNA, 653 bp, Homo sapiens
  misc_feature: GYAE6OF02HU95N.3.48.E04.1.454.CMB.1.raw
  modified_base (270)..(270): a, c, t, g, unknown or other
  misc_feature (270)..(270): n is a, c, g, or t
tcagagacgcactccacgaccggtgctcgatttagagagcgtcacagagagaaggggctgggcctcaggaagcagcatcggaggtgcctcagccatggcatggactccctctcttcctcggcgtccttgcttactgcacaggatccgtggcctcctagtgagctgactcacgcccaccctcgagttcgtccgtcgtaccccgagggcagacgacgcccaccgtccacctcgccttcgtggacgtaattagtttagggaataactaaaatntcgtacctttccgttaggtttacagtcgacgtacctaccgacggtaccctaccgttccccgtggtcgtcgtggtctacttcttacgaagtactaaccgacgcccgtaccctacgaacggtacctccgtagacgtacgtacttcgtcgtcgacctacctaacgtcgtaacgggaacctacgacgaccctctcgtacgactacgaccgacggccggtaccaggtctaggtacggtagtacggacgtacgtaacgtacttacgtcgtacgtaggtcgggtacgtacggacggcgccgggacgactacgacgtagtcggtacgggcggaaacggacgaacgccggtacgtaccggtcgtaccgtacgacccggtaccggtcgtaccg

SEQ ID NO: 234910 - DNA, 647 bp, Homo sapiens
  misc_feature: GYAE6OF02GZQ56.3.48.E04.1.454.CMB.1.raw
  modified_base (256)..(256): a, c, t, g, unknown or other
  misc_feature (256)..(256): n is a, c, g, or t
tcagagacgcactccacgaccggtgctcgatttagagagcgtcacagagagaaggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccgagggcagacacgccgaccgtcaccgtgctcgtggatattaagtttggaataacaaaatntcgtacttcgttgttcagctacgactccgacgccctacgtccccgtgtcggtcgtcgtctacttcttacaaggtaacctaaccgaacgtcccgtaccccgtacgtacgggtacctacccggtagacgtcgtacttcgtcgtacggtcctaccgtaacgtcgtacggaccacgacgtaccctacgtactacgaacctacgtacgccggtaaccggaccgacggtacgtagtacggtaggtagacgtacgtacgtacttacgtaccgtagaccggtacggtacggtacggacgacgggtccggacgtaccacgttacgtaacgttacggaccgggacggaacgggacacggtcgtaccggtaccgtacgtacgacgaccggacacggtacccg

SEQ ID NO: 234911 - DNA, 734 bp, Homo sapiens
  misc_feature: GYAE6OF02JFYR5.3.48.E04.1.454.CMB.1.raw
  modified_base (185)..(185): a, c, t, g, unknown or other
  misc_feature (185)..(185): n is a, c, g, or t
  modified_base (232)..(232): a, c, t, g, unknown or other
  misc_feature (232)..(232): n is a, c, g, or t
  modified_base (248)..(248): a, c, t, g, unknown or other
  misc_feature (248)..(248): n is a, c, g, or t
  modified_base (250)..(250): a, c, t, g, unknown or other
  misc_feature (250)..(250): n is a, c, g, or t
  modified_base (681)..(681): a, c, t, g, unknown or other
  misc_feature (681)..(681): n is a, c, g, or t
tcagagacgcactccacgaccggtgctcgatttagagagcgtcacagagagaagggcgtgggcctcaggaagcagcatcggaggtgcctcagccatggcatggatccctcgtcttaccgtcggcgttccttacgctttactcggcacgaggactcgtggcctctatgagctgactcagccacctnagtcgtccgtcgcccaggcagacacgccaccgtcactgctctggagntaagtttgatcaaatntncttctgttcagcgatcgtccgaacggtcctacgttccctagtcgtacgtcggtctacttcttacgaagacttaccgacgtccgtacccctggacggtactacccgtgaccgtacgtacttccgtctacggcctaccgtaacctacgggtaggaaacccgtacgaccggtacccaccgtttcgtaaccgtaacccgttaaacgcgtaacccggggaccccgggttaaccaaacgggggtttccaaacccggtttacgggtaagttacccgggggtaattacccgagggttttaaaaccctaccgttttaacgggtacccggtttccaaccggggttacgggttaaacgggaccttaaacgggggccgtacccgggttacaacccgggtttactacgggtacggttacccgggtacggggaacgtaaacccgnggaccgttaaccggtacccggtacgttacgaccgtacgacccgtacggtcccg

SEQ ID NO: 234912 - DNA, 721 bp, Homo sapiens
  misc_feature: GYAE6OF02GXD6I.3.48.E04.1.454.CMB.1.raw
  modified_base (234)..(234): a, c, t, g, unknown or other
  misc_feature (234)..(234): n is a, c, g, or t
  modified_base (355)..(355): a, c, t, g, unknown or other
  misc_feature (355)..(355): n is a, c, g, or t
tcagagacgcactccacgaccggtgctcgatttagagagcgtcacagagagaaggggctgggcctcaggaagcagcatcggaggtgcctcagccatggcatggatccctctcttcctcgcgtccttgcttactgcacaggatccggtggacctcctatgagctgactcagcccaccctcagtcgtccgtcgtccccgagggccagacacgcccaccgtccacctcgaccttcgngagtattaacgtttgggaataacaaaattctagtcctttccgttggtttacacgtactaacggtacctaccgaacggccctaacgttcccctggtccgtcgttcggtctacttccgtttanaaacggtactaacccgtacgcccgtaccccgtacgaagggtcctcccggtgacgtctacgtttccgtacgtcggtaccctacctaaaccgtcggtaaccggaaacaccgacgttacccaactaccgtaccaaccgtaatcccggaacgggacccgggtacccgagggtaccgttaacggtggtaacgacggtacggtacttacgtacgtttaacttccgtggtaccgtacgggtacgtagggaccgtacggggtccgacgtaccctacgtaccgtagttaccgggccggggtaacggaacggtaccgcggtacccgtaccggttaaccgccggttaacggaccgacccggttaccgacgtccccgg

SEQ ID NO: 234913 - DNA, 174 bp, Homo sapiens
  misc_feature: GYAE6OF01CTNFK.16.34.D01.1.454.CMB.1.raw
  modified_base (173)..(174): a, c, t, g, unknown or other
  misc_feature (173)..(174): n is a, c, g, or t
tcagtgtactactccacgaccggtgctcgatttagatcgtctgtgttgggtttgggggaagaggaagactgacggtcccccaggagttcaggtgctgggcacagcggccctgggctgcctggtcaaggactacttccgagtagtacactgagcgggctggcaaggcgcatagnn

SEQ ID NO: 234914 - DNA, 173 bp, Homo sapiens
  misc_feature: GYAE6OF01ACMKH.16.34.D01.1.454.CMB.1.raw
  modified_base (173)..(173): a, c, t, g, unknown or other
  misc_feature (173)..(173): n is a, c, g, or t
tcagtgtactactccacgaccggtgctcgatttagatcgtctgtgttgggtttgggggaagaggaagactgacggtcccccaggagttcaggtgctgggcacagcggccctgggctgcctggtcaaggactacttccgagtagtacactgagcgggctggcaaggcgcatagn

SEQ ID NO: 234915 - DNA, 174 bp, Homo sapiens; identical to SEQ ID NO: 234913
  misc_feature: GYAE6OF01A87TB.16.34.D01.1.454.CMB.1.raw
  modified_base (173)..(174): a, c, t, g, unknown or other
  misc_feature (173)..(174): n is a, c, g, or t

SEQ ID NO: 234916 - DNA, 175 bp, Homo sapiens
  misc_feature: GYAE6OF02JCS7M.16.34.D01.1.454.CMB.1.raw
  modified_base (173)..(175): a, c, t, g, unknown or other
  misc_feature (173)..(175): n is a, c, g, or t
tcagtgtactactccacgaccggtgctcgatttagatcgtctgtgttgggtttgggggaagaggaagactgacggtcccccaggagttcaggtgctgggcacagcggccctgggctgcctggtcaaggactacttccgagtagtacactgagcgggctggcaaggcgcatagnnn

SEQ ID NO: 234917 - DNA, 175 bp, Homo sapiens
  misc_feature: GYAE6OF02IXZD0.16.34.D01.1.454.CMB.1.raw
  modified_base (174)..(175): a, c, t, g, unknown or other
  misc_feature (174)..(175): n is a, c, g, or t
tcagtgtactactccacgaccggtgctcgatttagatcgtctgtgttgggtttgggggaagaggaagactgacggtccccccaggagttcaggtgctgggcacagcggccctgggctgcctggtcaaggactacttccgagtagtacactgagcgggctggcaaggcgcatagnn

SEQ ID NO: 234918 - DNA, 155 bp, Homo sapiens
  misc_feature: GYAE6OF01BEZZI.53.82.H05.1.454.CMB.1.raw
  modified_base (151)..(155): a, c, t, g, unknown or other
  misc_feature (151)..(155): n is a, c, g, or t
tcagcgcgtatacacacgaccggtgctcgatttagtcgagctctctcgcggcacgaccggtgctcgatttagtcgagctctctcgcggcacgaccggtgctcgatttagcagtactgcgttgggtctgagcgggctggcaaggcgcatagnnnnn

SEQ ID NO: 234919 - DNA, 139 bp, Homo sapiens
  misc_feature: GYAE6OF01CQZMX.53.82.H05.1.454.CMB.1.raw
  modified_base (139)..(139): a, c, t, g, unknown or other
  misc_feature (139)..(139): n is a, c, g, or t
tcagcgcgtatacacacgaccggtgctcgatttagtcgagctctctcgcgggcacgaccggtgctcgatttagtacacgtgattagggattgggtgatagggtaggcactcgtctgagcgggctggcaaggcgcatagn

SEQ ID NO: 234920 - DNA, 145 bp, Homo sapiens
  misc_feature: GYAE6OF01A8MZE.53.82.H05.1.454.CMB.1.raw
  modified_base (143)..(145): a, c, t, g, unknown or other
  misc_feature (143)..(145): n is a, c, g, or t
tcagcgcgtatacacacgaccggtgctcgatttagtcgagctctctcgcgggcacgaccggtgctcgatttagtagtgtagattcgcggggatggcctccctcgagtctacagtgctctgagcgggctggcaaggcgcatagnnn

SEQ ID NO: 234921 - DNA, 192 bp, Homo sapiens
  misc_feature: GYAE6OF01ETGQ5.53.82.H05.1.454.CMB.1.raw
  modified_base (150)..(150): a, c, t, g, unknown or other
  misc_feature (150)..(150): n is a, c, g, or t
  modified_base (189)..(192): a, c, t, g, unknown or other
  misc_feature (189)..(192): n is a, c, g, or t
tcagcgcgtatacacacgaccggtgctcgatttagtcgagctctctcgcgggcacgaccggtgctcgatttagtcgagctctctcgcgggcacgaccggtgctcgatttagtcgagctctctcgcgggcacgaccggtgctcgatttagngacatctcgcagttcttgagcggctggcaagcgcatagnnnn

SEQ ID NO: 234922 - DNA, 144 bp, Homo sapiens
  misc_feature: GYAE6OF01CQF4R.53.82.H05.1.454.CMB.1.raw
  modified_base (144)..(144): a, c, t, g, unknown or other
  misc_feature (144)..(144): n is a, c, g, or t
tcagcgcgtatacacacgaccggtgctcgatttagtcgagctctctcgcgggcacgaccggtgctcgatttagtcgagctctctcgcgggcacgaccggtgctcgatttagcagacgtctgagcgggctggcaaggcgcatagn

SEQ ID NO: 234923 - DNA, 158 bp, Homo sapiens
  misc_feature: GYAE6OF01AWGYK.53.82.H05.1.454.CMB.1.raw
  modified_base (129)..(129): a, c, t, g, unknown or other
  misc_feature (129)..(129): n is a, c, g, or t
  modified_base (139)..(139): a, c, t, g, unknown or other
  misc_feature (139)..(139): n is a, c, g, or t
  modified_base (155)..(158): a, c, t, g, unknown or other
  misc_feature (155)..(158): n is a, c, g, or t
tcagcgcgtatacacacgaccggtgctcgatttagtcgagctctctcgcggcacgaccggtgctcgatttagtcgagctctctcgcgggcacgaccggtgctcgatttagcagtactgcgttgggttcngcggcggtgngacgacggcatagtgnnnn

SEQ ID NO: 234924 - DNA, 121 bp, Homo sapiens
  misc_feature: GYAE6OF01DZ7S3.53.82.H05.1.454.CMB.1.raw
  modified_base (121)..(121): a, c, t, g, unknown or other
  misc_feature (121)..(121): n is a, c, g, or t
tcagcgcgtatacacacgaccggtgctcgatttagtcgagctctctcgcgggcacgaccggtgctcgatttagtatctgatagttgggttctgaggcggtcgtggacgaaggcgacatagn

SEQ ID NO: 234925 - DNA, 151 bp, Homo sapiens
  misc_feature: GYAE6OF01DBF2Z.53.82.H05.1.454.CMB.1.raw
  modified_base (150)..(151): a, c, t, g, unknown or other
  misc_feature (150)..(151): n is a, c, g, or t
tcagcgcgtatacacacgaccggtgctcgattagtcgagctctctcgcgggcacgaccggtgctcgatttagtcgagctctctcgcgggcacgaccggtgctcgatttagtgacatctcgcagttctgagcggctggcaaggcgcatagnn

SEQ ID NO: 234926 - DNA, 186 bp, Homo sapiens
  misc_feature: GYAE6OF01CB8K9.53.82.H05.1.454.CMB.1.raw
  modified_base (185)..(186): a, c, t, g, unknown or other
  misc_feature (185)..(186): n is a, c, g, or t
tcagcgcgtatacacacgaccggtgctcgatttagtcgagctctctcgcggcacgaccggtgatcgatttatcgagctctctcgcggcacgaccggtgctcgatttagctctacgctcagggcacgaccggtgctcgatttagtgacatctcgcagttctttgagcggctggcaaggcgcatagnn

SEQ ID NO: 234927 - DNA, 141 bp, Homo sapiens
  misc_feature: GYAE6OF01CHVHS.53.82.H05.1.454.CMB.1.raw
  modified_base (140)..(141): a, c, t, g, unknown or other
  misc_feature (140)..(141): n is a, c, g, or t
tcagcgcgtatacacacgaccggtgctcgatttagtcgagctctctcgcgggcacgaccggtgctcgattagctctacgctcagggcacgaccggtgctcgatttagcagacgtctgagcgggctggcaaggcgcatagnn

SEQ ID NO: 234928 - DNA, 143 bp, Homo sapiens
  misc_feature: GYAE6OF01CQ39A.53.82.H05.1.454.CMB.1.raw
  modified_base (143)..(143): a, c, t, g, unknown or other
  misc_feature (143)..(143): n is a, c, g, or t
tcagcgcgtatacacacgaccggtgctcgatttagtcgagctctctcgcgggcacgaccggtgctcgattagtcgagctctctcgcgggcacgaccggtgctcgatttagcagacgtctgagcgggctggcaaggcgcatagn

SEQ ID NO: 234929 - DNA, 106 bp, Homo sapiens
  misc_feature: GYAE6OF01CEH0D.53.82.H05.1.454.CMB.1.raw
  modified_base (106)..(106): a, c, t, g, unknown or other
  misc_feature (106)..(106): n is a, c, g, or t
tcagcgcgtatacacacgaccggtgctcgatttagtcgagctctctcgcgggcacgaccggtgctcgatttagcagacgtctgagcgggctggcaaggcgcatagn

SEQ ID NO: 234930 - DNA, 189 bp, Homo sapiens
  misc_feature: GYAE6OF01BJ0NT.53.82.H05.1.454.CMB.1.raw
  modified_base (185)..(189): a, c, t, g, unknown or other
  misc_feature (185)..(189): n is a, c, g, or t
tcagcgcgtatacacacgaccggtgctcgatttagtcgagctctctcgcgggcacgaccggtgctcgatttagctctacgctcagggcacgaccggtgctcgatttagctctacgctcagggcacgaccggtgctcgatttagtgacatctcgcagttcttgagcggcgtgcgaagacgcatagnnnnn

SEQ ID NO: 234931 - DNA, 145 bp, Homo sapiens
  misc_feature: GYAE6OF01DB0K4.53.82.H05.1.454.CMB.1.raw
  modified_base (144)..(145): a, c, t, g, unknown or other
  misc_feature (144)..(145): n is a, c, g, or t
tcagcgcgtatacacacgaccggtgctcgatttagtcgagctctctcgcgggcacgaccggtgctcgatttagtcgagctctctcgcgggcacgaccggtgctcgatttagcagacgtctgagcgggctggcaaggcgcatagnn

SEQ ID NO: 234932 - DNA, 286 bp, Homo sapiens
  misc_feature: GYAE6OF01AJ944.53.82.H05.1.454.CMB.1.raw
  modified_base (265)..(286): a, c, t, g, unknown or other
  misc_feature (265)..(286): n is a, c, g, or t
tcagcgcgtatacacacgaccggtgctcgatttagtcgagctctctcgcgggcacgaccggtgctcgattagtcgagctctctcgcgggaacgaccggtgctcgatttagtcgagctctctcgcgggcacgaccggtgctcgatttagtcgagctctctcgcgggcacgaccggtgctcgatttagcgagctctctcgcgggcacgccggtgctcgatttagctgcgtcacgatctctcctgagcgggctggcaaggcgcatagnnnnnnnnnnnnnnnnnnnnnn

SEQ ID NO: 234933 - DNA, 158 bp, Homo sapiens
  misc_feature: GYAE6OF01A28HM.53.82.H05.1.454.CMB.1.raw
  modified_base (158)..(158): a, c, t, g, unknown or other
  misc_feature (158)..(158): n is a, c, g, or t
tcagcgcgtatacacacgaccggtgctcgatttagtcgagctctctcgcgggtgctcgatttagtcgagatctctcgcgggcacgaccggtgctcgatttagtctagcgacttccgcggggtacgcactcgtctgagcgggctggcaaggcgcatagn

SEQ ID NO: 234934 - DNA, 195 bp, Homo sapiens
  misc_feature: GYAE6OF01BH0KR.53.82.H05.1.454.CMB.1.raw
  modified_base (168)..(168): a, c, t, g, unknown or other
  misc_feature (168)..(168): n is a, c, g, or t
  modified_base (189)..(195): a, c, t, g, unknown or other
  misc_feature (189)..(195): n is a, c, g, or t
tcagcgcgtatacacacgaccggtgctcgatttagtcgagctctctcgcgggcacgaccggtgctcgatttagtcgagctctctcgcgggcacgaccggtgctcgatttagtcgagctctctcggcgggcacggaccggtgctcgatttagatctgatagttgggttnagcggcgtgcaagcgcatagnnnnnnn

SEQ ID NO: 234935 - DNA, 205 bp, Homo sapiens
  misc_feature: GYAE6OF01C8T26.53.82.H05.1.454.CMB.1.raw
  modified_base (205)..(205): a, c, t, g, unknown or other
  misc_feature (205)..(205): n is a, c, g, or t
tcagcgcgtatacacacgaccggtgctcgatttagtcgagctctctcgcggcacgaccggtgctcgatttagtcgagctctctcgcgggcacgaccggtgctcgatttagtacacgtgattagggattggggacagaccaacaccagtcttcatcttcccgccatctgatcgtactgcgctgagcgggctggcaaggcgcatagn

SEQ ID NO: 234936 - DNA, 143 bp, Homo sapiens
  misc_feature: GYAE6OF01D2390.53.82.H05.1.454.CMB.1.raw
tcagcgcgtatacacacgaccggtgctcgatttagtcgagctctctcgcgggcacgaccggtgctcgatttagtagtgtagatttgcgggggatggcctccctcgagtctacagtgctctgagcgggctggcaaggcgcatag

SEQ ID NO: 234937 - DNA, 135 bp, Homo sapiens
  misc_feature: GYAE6OF01BQ9G5.53.82.H05.1.454.CMB.1.raw
  modified_base (123)..(135): a, c, t, g, unknown or other
  misc_feature (123)..(135): n is a, c, g, or t
tcagcgcgtatacacacgaccggtgctcgattagtcgagctctctcgcgggtcctgcggcacgaccggtgctcgatttagctgcgtcacgatctctcctgagcgggctggcaaggcgcatagnnnnnnnnnnnnn

SEQ ID NO: 234938 - DNA, 145 bp, Homo sapiens
  misc_feature: GYAE6OF01CFCKC.53.82.H05.1.454.CMB.1.raw
  modified_base (145)..(145): a, c, t, g, unknown or other
  misc_feature (145)..(145): n is a, c, g, or t
tcagcgcgtatacacacgaccggtgctcgatttagtcgagctctctcgcgggcacgaccggtgctcgatttagtagtgtagattccgcgggggatggcctccctcgagtctacagtgctctgagcgggctggcaaggcgcatagn

SEQ ID NO: 234939 - DNA, 105 bp, Homo sapiens
  misc_feature: GYAE6OF01B1WMD.53.82.H05.1.454.CMB.1.raw
tcagcgcgtatacacacgaccggtgctcgatttagtcgagctctctcgcgggcacgaccggtgctcgatttagcagacgtctgagcgggctggcaaggcgcatag

SEQ ID NO: 234940 - DNA, 156 bp, Homo sapiens
  misc_feature: GYAE6OF01C9OKZ.53.82.H05.1.454.CMB.1.raw
  modified_base (112)..(112): a, c, t, g, unknown or other
  misc_feature (112)..(112): n is a, c, g, or t
  modified_base (140)..(140): a, c, t, g, unknown or other
  misc_feature (140)..(140): n is a, c, g, or t
  modified_base (153)..(156): a, c, t, g, unknown or other
  misc_feature (153)..(156): n is a, c, g, or t
tcagcgcgtatacacacgaccggtgctcgatttagtcgagctctctcgcgggcacgaccggtgcacgatttagtcgagctctctcgcgggcacgaccggtgctcgatttagngacatctcgcagttcttgagcggcgtgngagacggcatagnnnn

SEQ ID NO: 234941 - DNA, 140 bp, Homo sapiens
  misc_feature: GYAE6OF01BJ258.53.82.H05.1.454.CMB.1.raw
tcagcgcgtatacacacgaccggtgctcgatttagtcgagctctctcgcgggcacgaccggtgctcgatttagctctacgctcagggcacgaccggtgctcgatttagcagacgtctgagcgggctggcaaggcgcatag

SEQ ID NO: 234942 - DNA, 191 bp, Homo sapiens
  misc_feature: GYAE6OF01CGMHP.53.82.H05.1.454.CMB.1.raw
  modified_base (180)..(180): a, c, t, g, unknown or other
  misc_feature (180)..(180): n is a, c, g, or t
  modified_base (184)..(191): a, c, t, g, unknown or other
  misc_feature (184)..(191): n is a, c, g, or t
tcagcgcgtatacacacgaccggtgctcgatttagtcgagctctctcgcgggcacgaccggtgctcgatttagtcgagctctctcgcggcacgaccggtgctcgatttagctctacgctcagggcacgaccggtgctcgatttagatctgatagttgggttcagcggcgtgcgagagcanagtnnnnnnnn

SEQ ID NO: 234943 - DNA, 165 bp, Homo sapiens
  misc_feature: GYAE6OF01E0QZ5.53.82.H05.1.454.CMB.1.raw
  modified_base (165)..(165): a, c, t, g, unknown or other
  misc_feature (165)..(165): n is a, c, g, or t
tcagcgcgtatacacacgaccggtgctcgatttagtcgagctctctcgcgggcacgaccggtgctcgatttagtcacgcgagaaagggaagggggctggccctgacgtgtttctgttcccaccctcctctcgtactgcgctgagcgggctggcaaggcgcatagn

SEQ ID NO: 234944 - DNA, 187 bp, Homo sapiens
  misc_feature: GYAE6OF01EJPY6.53.82.H05.1.454.CMB.1.raw
  modified_base (164)..(164): a, c, t, g, unknown or other
  misc_feature (164)..(164): n is a, c, g, or t
  modified_base (172)..(173): a, c, t, g, unknown or other
  misc_feature (172)..(173): n is a, c, g, or t
  modified_base (181)..(181): a, c, t, g, unknown or other
  misc_feature (181)..(181): n is a, c, g, or t
  modified_base (185)..(187): a, c, t, g, unknown or other
  misc_feature (185)..(187): n is a, c, g, or t
tcagcgcgtatacacacgaccggtgctcgatttagtcgagctctctcgcgggcacgaccggtgctcgatttagtcgagctctctcgcgggcacgaccggtgctcgatttagctctacgctcagggcacgaccggtgctcgatttagtatctgatagttgggtcngaggcggnngacaggcnatgnnn

SEQ ID NO: 234945 - DNA, 144 bp, Homo sapiens
  misc_feature: GYAE6OF01EM499.53.82.H05.1.454.CMB.1.raw
  modified_base (144)..(144): a, c, t, g, unknown or other
  misc_feature (144)..(144): n is a, c, g, or t
tcagcgcgtatacacacgaccggtgctcgatttagtcgagctctctcgcgggcacgaccggtgctcgatttagtagtgtagattcgcgggggatggcctccctcgagtctacagtgctctgagcgggctggcaaggcgcatagn

SEQ ID NO: 234946 - DNA, 144 bp, Homo sapiens; identical to SEQ ID NO: 234945
  misc_feature: GYAE6OF01DXIVO.53.82.H05.1.454.CMB.1.raw
  modified_base (144)..(144): a, c, t, g, unknown or other
  misc_feature (144)..(144): n is a, c, g, or t

SEQ ID NO: 234947 - DNA, 145 bp, Homo sapiens; identical to SEQ ID NO: 234931
  misc_feature: GYAE6OF01COHF3.53.82.H05.1.454.CMB.1.raw
  modified_base (144)..(145): a, c, t, g, unknown or other
  misc_feature (144)..(145): n is a, c, g, or t

SEQ ID NO: 234948 - DNA, 105 bp, Homo sapiens; identical to SEQ ID NO: 234939
  misc_feature: GYAE6OF01CZFIZ.53.82.H05.1.454.CMB.1.raw

SEQ ID NO: 234949 - DNA, 165 bp, Homo sapiens
  misc_feature: GYAE6OF01D0MDD.53.82.H05.1.454.CMB.1.raw
  modified_base (164)..(165): a, c, t, g, unknown or other
  misc_feature (164)..(165): n is a, c, g, or t
tcagcgcgtatacacacgaccggtgctcgatttagtcgagctctctcgcgggcacgaccggtgctcgatttagctttacgctcagggcacgaccggtgctcgatttagtctagcgacttccgcggggtacgcactcgtctgagcgggctggcaaggcgcatagnn

SEQ ID NO: 234950 - DNA, 145 bp, Homo sapiens; identical to SEQ ID NO: 234931
  misc_feature: GYAE6OF01DEPWK.53.82.H05.1.454.CMB.1.raw
  modified_base (144)..(145): a, c, t, g, unknown or other
  misc_feature (144)..(145): n is a, c, g, or t

SEQ ID NO: 234951 - DNA, 144 bp, Homo sapiens; identical to SEQ ID NO: 234922
  misc_feature: GYAE6OF01DF0VG.53.82.H05.1.454.CMB.1.raw
  modified_base (144)..(144): a, c, t, g, unknown or other
  misc_feature (144)..(144): n is a, c, g, or t

SEQ ID NO: 234952 - DNA, 186 bp, Homo sapiens
  misc_feature: GYAE6OF01C5I68.53.82.H05.1.454.CMB.1.raw
  modified_base (185)..(186): a, c, t, g, unknown or other
  misc_feature (185)..(186): n is a, c, g, or t
tcagcgcgtatacacacgaccggtgctcgatttagtcgagctctctcgcgggcacgaccggtgctcgatttagtcgagctctctcgcggcacgaccggtgctcgatttagctctacgctcagggcacgaccggtgctcgatttagtgacatctcgcagttcttgagcggctggcaagcgcatagnn

SEQ ID NO: 234953 - DNA, 218 bp, Homo sapiens
  misc_feature: GYAE6OF01CUO4M.53.82.H05.1.454.CMB.1.raw
  modified_base (214)..(218): a, c, t, g, unknown or other
  misc_feature (214)..(218): n is a, c, g, or t
tcagcgcgtatacacacgaccggtgctcgatttagtcgagctctctcgcgggcacgaccggtgctcgatttagtcgagctctctcgcgggcacgaccggtgctcgatttagctctacgctcagggcacgaccggtgctcgatttagctctacgctcagggcacgaccggtgctcgatttagcagacgtctgcgcgggctggcaaggcgcatagnnnnn

SEQ ID NO: 234954 - DNA, 154 bp, Homo sapiens
  misc_feature: GYAE6OF01AHDW8.53.82.H05.1.454.CMB.1.raw
  modified_base (152)..(154): a, c, t, g, unknown or other
  misc_feature (152)..(154): n is a, c, g, or t
tcagcgcgtatacacacgaccggtgctcgatttagtcgagctctctcgcgggcacgaccggtgctcgatttagtcgagctctctcgcgggcacgaccggtgctcgatttagtgacatctcgcagttcttgagcggctggcaaggcgcatagnnn

SEQ ID NO: 234955 - DNA, 153 bp, Homo sapiens
  misc_feature: GYAE6OF01BLRW1.53.82.H05.1.454.CMB.1.raw
  modified_base (151)..(153): a, c, t, g, unknown or other
  misc_feature (151)..(153): n is a, c, g, or t
tcagcgcgtatacacacgaccggtgctcgatttagtcgagctctctcgcgggcacgaccggtgctcgatttagctctacgctcagggcacgaccggtgctcgatttagtgacatctcgcagttctttgagcgggctggcaaggcgcatagnnn

SEQ ID NO: 234956 - DNA, 141 bp, Homo sapiens
  misc_feature: GYAE6OF01EEWEK.53.82.H05.1.454.CMB.1.raw
  modified_base (141)..(141): a, c, t, g, unknown or other
  misc_feature (141)..(141): n is a, c, g, or t
tcagcgcgtatacacacgaccggtgctcgatttagtcgagctctctcgcgggcacgaccggtgctcgatttagcgagacgcgcagggcacgaccggtgctcgatttagcagacgtctgagcgggctggcaaggcgcatagn

SEQ ID NO: 234957 - DNA, 151 bp, Homo sapiens
  misc_feature: GYAE6OF01CPSFV.53.82.H05.1.454.CMB.1.raw
  modified_base (129)..(129): a, c, t, g, unknown or other
  misc_feature (129)..(129): n is a, c, g, or t
  modified_base (146)..(146): a, c, t, g, unknown or other
  misc_feature (146)..(146): n is a, c, g, or t
  modified_base (150)..(151): a, c, t, g, unknown or other
  misc_feature (150)..(151): n is a, c, g, or t
tcagcgcgtatacacacgaccggtgctcgatttagtcgagctctctcgcgggcacgaccggtgctcgatttagtcgagctctctcgcgggcacgaccggtgctcgatttagtatctgatagttgggtcngaggcggctgacaggcnatgnn

SEQ ID NO: 234958 - DNA, 151 bp, Homo sapiens
  misc_feature: GYAE6OF01B8JSN.53.82.H05.1.454.CMB.1.raw
  modified_base (150)..(151): a, c, t, g, unknown or other
  misc_feature (150)..(151): n is a, c, g, or t
tcagcgcgtatacacacgaccggtgctcgatttagtcgagctctctcgcgggcacgaccggtgctcgatttagtcgagctctctcgcggcacgaccggtgctcgatttagtgacatctcgcagttctgagcggctggcaaggcgcatagnn

SEQ ID NO: 234959 - DNA, 155 bp, Homo sapiens
  misc_feature: GYAE6OF01A9PZK.53.82.H05.1.454.CMB.1.raw
  modified_base (152)..(155): a, c, t, g, unknown or other
  misc_feature (152)..(155): n is a, c, g, or t
tcagcgcgtatacacacgaccggtgctcgatttagtcgagctctctcgcgggcacgaccggtgctcgatttagtcgagctctctcgcgggcacgaccggtgctcgatttagtgacatctcgcagttctgagcgggctggcaaggcgcatagnnnn

SEQ ID NO: 234960 - DNA, 186 bp, Homo sapiens
  misc_feature: GYAE6OF01C38MJ.53.82.H05.1.454.CMB.1.raw
  modified_base (181)..(186): a, c, t, g, unknown or other
  misc_feature (181)..(186): n is a, c, g, or t
tcagcgcgtatacacacgaccggtgctcgatttagtcgagctctctcgcggcacgaccggtgctcgatttagtcgagctctctcgcgggcacgaccggtgctcgatttagtcgagctctctcgcgggcacgaccggtgctcgatttagcagacgtctgagcgggctggcaaggcgcatagnnnnnn

SEQ ID NO: 234961 - DNA, 200 bp, Homo sapiens
  misc_feature: GYAE6OF01B5C9G.53.82.H05.1.454.CMB.1.raw
  modified_base (185)..(185): a, c, t, g, unknown or other
  misc_feature (185)..(185): n is a, c, g, or t
  modified_base (191)..(200): a, c, t, g, unknown or other
  misc_feature (191)..(200): n is a, c, g, or t
tcagcgcgtatacacacgaccggtgctcgatttagtcgagctctctcgcgggcacgaccggtgctcgatttagtcgagctctctcgcggcacgaccggtgctcgatttagtcgagctctctcggcgggcacgaccggtgctcgatttagatctgatagttgggtctgagcgggctggacaaggcntatagnnnnnnnnnn

SEQ ID NO: 234962 - DNA, 186 bp, Homo sapiens
  misc_feature: GYAE6OF01DD7YY.53.82.H05.1.454.CMB.1.raw
  modified_base (144)..(144): a, c, t, g, unknown or other
  misc_feature (144)..(144): n is a, c, g, or t
  modified_base (184)..(186): a, c, t, g, unknown or other
  misc_feature (184)..(186): n is a, c, g, or t
tcagcgcgtatacacacgaccggtgctcgatttagtcgagctctctcgcgggcacgaccggtgctcgatttagctctacgctcagggcacgaccggtgctcgatttagctctacgctcagggcacgaccggtgctcgatttagngacatctcgcagttcttgagcggcgtgcgaagcgcatagnnn

SEQ ID NO: 234963 - DNA, 106 bp, Homo sapiens; identical to SEQ ID NO: 234929
  misc_feature: GYAE6OF01CRFC4.53.82.H05.1.454.CMB.1.raw
  modified_base (106)..(106): a, c, t, g, unknown or other
  misc_feature (106)..(106): n is a, c, g, or t

SEQ ID NO: 234964 - DNA, 143 bp, Homo sapiens
  misc_feature: GYAE6OF01BUYKA.53.82.H05.1.454.CMB.1.raw
tcagcgcgtatacacacgaccggtgctcgatttagtcgagctctctcgcgggcacgaccggtgctcgatttagtcgagctctctcgcgggcacgaccggtgctcgatttagcagacgtctgagcgggctggcaaggcgcatag

SEQ ID NO: 234965 - DNA, 155 bp, Homo sapiens
  misc_feature: GYAE6OF01BF457.53.82.H05.1.454.CMB.1.raw
  modified_base (154)..(155): a, c, t, g, unknown or other
  misc_feature (154)..(155): n is a, c, g, or t
tcagcgcgtatacacacgaccggtgctcgatttagtcgagctctctcgcgggcacgaccggtgctcgatttagtcgagctctctcgcgggcacgaccggtgctcgatttagtgacatctcgcagttctttgagcgggctggcaaggcgcatagnn

SEQ ID NO: 234966 - DNA, 157 bp, Homo sapiens
  misc_feature: GYAE6OF01B4S9N.53.82.H05.1.454.CMB.1.raw
  modified_base (157)..(157): a, c, t, g, unknown or other
  misc_feature (157)..(157): n is a, c, g, or t
tcagcgcgtatacacacgaccggtgctcgatttagtcgagctctctcgcgggagagctcccaaagaactgcgagatgtcactaaatcgagcaccggtcgtgcctggtcaaggactacttcctcgtactgcgctgagcgggctggcaaggcgcatagn

SEQ ID NO: 234967 - DNA, 146 bp, Homo sapiens
  misc_feature: GYAE6OF01B0JOR.53.82.H05.1.454.CMB.1.raw
  modified_base (122)..(122): a, c, t, g, unknown or other
  misc_feature (122)..(122): n is a, c, g, or t
  modified_base (144)..(146): a, c, t, g, unknown or other
  misc_feature (144)..(146): n is a, c, g, or t
tcagcgcgtatacacacgaccggtgctcgatttagtcgagctctctcgcgggcacgaccggtgctcgatttagtcgagctctctcgcgggcacgaccggtgctcgatttagcagacgtctgngcgggctggcaaggcgcatagnnn

SEQ ID NO: 234968 - DNA, 269 bp, Homo sapiens
  misc_feature: GYAE6OF01BPYEC.53.82.H05.1.454.CMB.1.raw
  modified_base (221)..(221): a, c, t, g, unknown or other
  misc_feature (221)..(221): n is a, c, g, or t
  modified_base (239)..(239): a, c, t, g, unknown or other
  misc_feature (239)..(239): n is a, c, g, or t
  modified_base (241)..(241): a, c, t, g, unknown or other
  misc_feature (241)..(241): n is a, c, g, or t
  modified_base (259)..(269): a, c, t, g, unknown or other
  misc_feature (259)..(269): n is a, c, g, or t
tcagcgcgtatacacacgaccggtgctcgatttagtcgagctctctcgcgggcacgaccggtgctcgattagtcgagctctctcgcgggcacgaccggtgctcgatttagtcgagctctctcgcgggcacgaccggtgctcgatttagtcgagctctctcgcggcacgaccggtgctcgatttagcgagctctctcgcggcacgccggtgctcgatttagnacatctcgcagttcttgngnggctggcaaggcgcatgnnnnnnnnnnn

SEQ ID NO: 234969 - DNA, 114 bp, Homo sapiens
  misc_feature: GYAE6OF01B6TEX.53.82.H05.1.454.CMB.1.raw
tcagcgcgtatacacacgaccggtgctcgatttagtcgagctctctcgcgggcacgaccggtgctcgatttagtatctgatagttgggtctgagcgggctggcaaggcgcatag

SEQ ID NO: 234970 - DNA, 190 bp, Homo sapiens
  misc_feature: GYAE6OF01CG2RV.53.82.H05.1.454.CMB.1.raw
  modified_base (181)..(190): a, c, t, g, unknown or other
  misc_feature (181)..(190): n is a, c, g, or t
tcagcgcgtatacacacgaccggtgctcgatttagtcgagctctctcgcgggcacgaccggtgctcgatttagtcgagctctctcgcgggcacgaccgtgctcggtttagtcgagctctctcgcgggcacgaccggtgctcgatttagcagacgtctgacgcgggctggcaaggcgcatgnnnnnnnnnn

SEQ ID NO: 234971 - DNA, 146 bp, Homo sapiens
  misc_feature: GYAE6OF01ECUPS.53.82.H05.1.454.CMB.1.raw
  modified_base (144)..(146): a, c, t, g, unknown or other
  misc_feature (144)..(146): n is a, c, g, or t
tcagcgcgtatacacacgaccggtgctcgatttagtcgagctctctcgcgggcacgaccggtgctcgatttagtagtgtagattcgcgggggatggcctccctcgagtctacagtgctctgagcgggctggcaaggcgcatagnnn

SEQ ID NO: 234972 - DNA, 141 bp, Homo sapiens
  misc_feature: GYAE6OF01DJH6F.53.82.H05.1.454.CMB.1.raw
  modified_base (120)..(120): a, c, t, g, unknown or other
  misc_feature (120)..(120): n is a, c, g, or t
tcagcgcgtatacacacgaccggtgctcgatttagtcgagctctctcgcgggcacgaccggtgctcgatttagctctacgctcagggcacgaccggtgctcgatttagcagacgtctggngcgggctggcaaggcgcatag

SEQ ID NO: 234973 - DNA, 143 bp, Homo sapiens
  misc_feature: GYAE6OF01D8ERI.53.82.H05.1.454.CMB.1.raw
tcagcgcgtatacacacgaccggtgctcgatttagtcgagctctctcgcgggcacgaccggtgctcgatttagtagtgtagattcgcgggggatggcctccctcgagtctacagtgctctgagcgggctggcaaggcgcatag

SEQ ID NO: 234974 - DNA, 178 bp, Homo sapiens
  misc_feature: GYAE6OF01CESG5.53.82.H05.1.454.CMB.1.raw
  modified_base (176)..(178): a, c, t, g, unknown or other
  misc_feature (176)..(178): n is a, c, g, or t
tcagcgcgtatacacacgaccggtgctcgatttagtcgagctctctcgcgggcacgaccggtgctcgatttagctctacgctcagggcacgaccggtgctcgatttagctctacgctcagggcacgaccggtgctcgatttagcagacgtctgagcgggctggcaaggcgcatagnnn

SEQ ID NO: 234975 - DNA, 144 bp, Homo sapiens
  misc_feature: GYAE6OF01C0IZ6.53.82.H05.1.454.CMB.1.raw
  modified_base (144)..(144): a, c, t, g, unknown or other
  misc_feature (144)..(144): n is a, c, g, or t
tcagcgcgtatacacacgaccggtgctcgatttagtcgagctctctcgcgggcacgaccggtgctcgatttagtcgagctctctcgcgggcacgaccggtgctcgatttagcagacgtctgcgcgggctggcaaggcgcatagn

SEQ ID NO: 234976 - DNA, 148 bp, Homo sapiens
  misc_feature: GYAE6OF01EI6J4.53.82.H05.1.454.CMB.1.raw
  modified_base (145)..(148): a, c, t, g, unknown or other
  misc_feature (145)..(148): n is a, c, g, or t
tcagcgcgtatacacacgaccggtgctcgatttagtcgagctctctcgcgggcacgaccggtgctcgatttagtcgagctctctcgcgggcacgaccggtgctcgatttagcagacgtctgtcgcgggctggcaaggcgcatagnnnn

SEQ ID NO: 234977 - DNA, 144 bp, Homo sapiens
  misc_feature: GYAE6OF01C2FJ7.53.82.H05.1.454.CMB.1.raw
  modified_base (144)..(144): a, c, t, g, unknown or other
  misc_feature (144)..(144): n is a, c, g, or t
tcagcgcgtatacacacgaccggtgctcgatttagtcgagctctctcgcggacacgaccggtgctcgatttagtagtgtagattcgcgggggatggcctccctcgagtctacagtgctctgagcgggctggcaaggcgcatagn

SEQ ID NO: 234978 - DNA, 187 bp, Homo sapiens
  misc_feature: GYAE6OF01CZ3ZF.53.82.H05.1.454.CMB.1.raw
  modified_base (182)..(187): a, c, t, g, unknown or other
  misc_feature (182)..(187): n is a, c, g, or t
tcagcgcgtatacacacgaccggtgctcgatttagtcgagctctctcgcgggcacgaccggtgctcgatttagtcgagctctctcgcgggcacgaccggtgctcgatttagcgagctctctcggcgggcacgaccggtgctcgatttagcagacgtctgcgcgggctggcaaggcgcatagnnnnnn

SEQ ID NO: 234979 - DNA, 153 bp, Homo sapiens
  misc_feature: GYAE6OF01BWCGP.53.82.H05.1.454.CMB.1.raw
  modified_base (140)..(140): a, c, t, g, unknown or other
  misc_feature (140)..(140): n is a, c, g, or t
  modified_base (150)..(150): a, c, t, g, unknown or other
  misc_feature (150)..(150): n is a, c, g, or t
tcagcgcgtatacacacgaccggtgctcgatttagtcgagctctctcgcgggcacgaccggtgctcgatttagtcgagctctctcgcgggcacgaccggtgctcgatttagtgacatctcgcagtttcttgaggcggtcnggagaggcanatg

SEQ ID NO: 234980 - DNA, 224 bp, Homo sapiens
  misc_feature: GYAE6OF01A2IVW.53.82.H05.1.454.CMB.1.raw
  modified_base (220)..(224): a, c, t, g, unknown or other
  misc_feature (220)..(224): n is a, c, g, or t
tcagcgcgtatacacacgaccggtgctcgatttagtcgagctctctcgcgggcacgaccggtgctcgatttagtcgagctctctcgcgggcacgaccggtgctcgatttagtcgagctctctcgcgggcacgaccggtgctcgatttagtcgagctctctcgcgggcacgaccggtgctcgatttagcagacgtctgtcgcgggctggcaaggcgcatgnnnnn

SEQ ID NO: 234981 - DNA, 755 bp, Homo sapiens
  misc_feature: GYAE6OF01B88CA.53.82.H05.1.454.CMB.1.raw
  modified_base (92)..(92): a, c, t, g, unknown or other
  misc_feature (92)..(92): n is a, c, g, or t
  modified_base (221)..(221): a, c, t, g, unknown or other
  misc_feature (221)..(221): n is a, c, g, or t
  modified_base (241)..(241): a, c, t, g, unknown or other
  misc_feature (241)..(241): n is a, c, g, or t
tcagcgcgtatacacacgaccggtgctcgattagtcgagctctctcgcgggcacgaccggtgctcgatttagtagtgtagattcgcggggancttcagctgtggtagagaagacaggattcaggacaatctccagcatggccggcttccctctcctcctcaccctcctcactcactgtgcgagggtcctgggcccagtctgtgctgactcacgccaccctnagcgtcgtcgggaccccggnaggacggtcaccatcctccgtgttctaggaagccgacggtaccaactaagtccgggtaagttgtaatttttggttacttcgtcgtaaccctagtctacgccgtcccgaagggaccgcccgggacccctaaaccgtccttactaacgtttacgaacggtaaatgaactccgaacggccggtaccccgtacgggtaccggggttcccctacggtaacccgttactttccgttaccggttacggtacccgttaaccgtaacggtttccggttaccggaccctaacccggtccgtaccgggtaccccttacccggtccggaccctactccgggtaccgttaccggggtccccgttacccgggttaccggaacggtagttccgggacggttacgttaggttaacttttaacgttcgttacggacgtaccgacgttcgtaacgggttcgggaacttcgggaaccttcggtacggttagttaggggtttggttcgggttacgggttcggttaaccgggggg

SEQ ID NO: 234982 - DNA, 127 bp, Homo sapiens
  misc_feature: GYAE6OF01B7W3C.53.82.H05.1.454.CMB.1.raw
  modified_base (108)..(109): a, c, t, g, unknown or other
  misc_feature (108)..(109): n is a, c, g, or t
  modified_base (111)..(127): a, c, t, g, unknown or other
  misc_feature (111)..(127): n is a, c, g, or t
tcagcgcgtatacacacgaccggtgctcgatttagtcgagctctctcgcgggcacgaccggtgctcgatttagcagacgtctgagcgggctggcaaaggcgcataggnntnnnnnnnnnnnnnnnnn

SEQ ID NO: 234983 - DNA, 216 bp, Homo sapiens
  misc_feature: GYAE6OF01AIB67.53.82.H05.1.454.CMB.1.raw
  modified_base (191)..(191): a, c, t, g, unknown or other
  misc_feature (191)..(191): n is a, c, g, or t
  modified_base (213)..(216): a, c, t, g, unknown or other
  misc_feature (213)..(216): n is a, c, g, or t
tcagcgcgtatacacacgaccggtgctcgatttagtcgagctctctcgcgggcacgaccggtgctcgatttagtcgagctctctcggggcacgaccggtgctcgatttagctctacgctcagggcacgaccggtgctcgatttagctctacgctcagggcacgaccggtgctcgatttagcagacgtctgngcgggctggcaaggcgcatagnnnn

SEQ ID NO: 234984 - DNA, 186 bp, Homo sapiens
  misc_feature: GYAE6OF01EPTN1.53.82.H05.1.454.CMB.1.raw
  modified_base (177)..(177): a, c, t, g, unknown or other
  misc_feature (177)..(177): n is a, c, g, or t
  modified_base (182)..(186): a, c, t, g, unknown or other
  misc_feature (182)..(186): n is a, c, g, or t
tcagcgcgtatacacacgaccggtgctcgatttagtcgagctctctcgcgggcacgaccggtgctcgatttagtcgagctctctcgcggcacgaccggtgctcgatttagtagtgtagattcgcgggggattggccctcctcgagtctacagtgctcgtgagcgggctggcaaggcncatgnnnnn

SEQ ID NO: 234985 - DNA, 152 bp, Homo sapiens
  misc_feature: GYAE6OF01BWT6L.53.82.H05.1.454.CMB.1.raw
  modified_base (145)..(152): a, c, t, g, unknown or other
  misc_feature (145)..(152): n is a, c, g, or t
tcagcgcgtatacacacgaccggtgctcgatttagtcgagctctctcgcgggcacgaccggtgctcgatttagtcgagctctctcgcgggcacgaccggtgctcgatttagcagacgtctgtcgcgggctggcaaggcgcatagnnnnnnnn

SEQ ID NO: 234986 - DNA, 219 bp, Homo sapiens
  misc_feature: GYAE6OF01EFZ8O.53.82.H05.1.454.CMB.1.raw
  modified_base (157)..(157): a, c, t, g, unknown or other
  misc_feature (157)..(157): n is a, c, g, or t
  modified_base (206)..(206): a, c, t, g, unknown or other
  misc_feature (206)..(206): n is a, c, g, or t
  modified_base (211)..(219): a, c, t, g, unknown or other
  misc_feature (211)..(219): n is a, c, g, or t
tcagcgcgtatacacacgaccggtgctcgatttagtcgagctctctcgcgggcacgaccggtgctcgatttagtcgagctctctcgcgggcacgaccggtgctcgatttagcgagctctctcgcgggcacgccggtgctcgatttagcgagctctcncgcgggcacgccggtgctgatttagcagcgtctgcgcggctggcaggcncatgnnnnnnnnn

SEQ ID NO: 234987 - DNA, 152 bp, Homo sapiens
  misc_feature: GYAE6OF01CPEMO.53.82.H05.1.454.CMB.1.raw
tcagcgcgtatacacacgaccggtgctcgatttagtcgagctctctcgcgggcacgaccggtgctcgatttagtcgagctctctcgcgggcacgaccggtgctcgatttagcacacgatagttgggtttgagcgggctggcaaggcgcatag

SEQ ID NO: 234988 - DNA, 145 bp, Homo sapiens
  misc_feature: GYAE6OF01CKE89.53.82.H05.1.454.CMB.1.raw
  modified_base (144)..(145): a, c, t, g, unknown or other
  misc_feature (144)..(145): n is a, c, g, or t
tcagcgcgtatacacacgaccggtgctcgatttagtcgagctctctcgcgggcacgaccggtgctcgatttagctacgctctaagggcacgaccggtgctcgatttagcagacgtctgacgggcgggctggcaaggcgcatagnn

SEQ ID NO: 234989 - DNA, 113 bp, Homo sapiens
  misc_feature: GYAE6OF01CFDPQ.53.82.H05.1.454.CMB.1.raw
  modified_base (106)..(113): a, c, t, g, unknown or other
  misc_feature (106)..(113): n is a, c, g, or t
tcagcgcgtatacacacgaccggtgctcgatttagtcgagctctctcgcgggcacgaccggtgctcgatttagatcacgtgcgtgcgggctggcaaggcgcatagnnnnnnnn

SEQ ID NO: 234990 - DNA, 107 bp, Homo sapiens
  misc_feature: GYAE6OF01CWUN2.53.82.H05.1.454.CMB.1.raw
  modified_base (106)..(107): a, c, t, g, unknown or other
  misc_feature (106)..(107): n is a, c, g, or t
tcagcgcgtatacacacgaccggtgctcgatttagtcgagctctctcgcgggcacgaccggtgctcgatttagcagacgtctgagcgggctggcaaggcgcatagnn

SEQ ID NO: 234991 - DNA, 157 bp, Homo sapiens
  misc_feature: GYAE6OF01BKHE9.53.82.H05.1.454.CMB.1.raw
  modified_base (142)..(157): a, c, t, g, unknown or other
  misc_feature (142)..(157): n is a, c, g, or t
tcagcgcgtatacacacgaccggtgctcgatttagtcgagctctctcgcgggcacgaccggtctcgatttagtcgagctctctcgcggcacgaccggtgctcgatttagcagacgtctgagcgggctggcaaggcgcatagnnnnnnnnnnnnnnnn

SEQ ID NO: 234992 - DNA, 147 bp, Homo sapiens
  misc_feature: GYAE6OF01BPKFR.53.82.H05.1.454.CMB.1.raw
  modified_base (144)..(147): a, c, t, g, unknown or other
  misc_feature (144)..(147): n is a, c, g, or t
tcagcgcgtatacacacgaccggtgctcgatttagtcgagctctctcgcgggcacgaccggtgctcgatttagctctacgctcagggcacgaccggtgctcgatttagcagacgtctggtcgcgggctgggcaaggcgcatagnnnn

SEQ ID NO: 234993 - DNA, 147 bp, Homo sapiens
  misc_feature: GYAE6OF01A3ALT.53.82.H05.1.454.CMB.1.raw
  modified_base (136)..(136): a, c, t, g, unknown or other
  misc_feature (136)..(136): n is a, c, g, or t
  modified_base (142)..(147): a, c, t, g, unknown or other
  misc_feature (142)..(147): n is a, c, g, or t
tcagcgcgtatacacacgaccggtgctcgatttagtcgagctctctcgcgggcacgaccggtgctcgatttagacgacagctcgagggcacgaccggtgctcgattagcagacgctgcgcgggctgggacaaggcncatagnnnnnn

SEQ ID NO: 234994 - DNA, 147 bp, Homo sapiens
  misc_feature: GYAE6OF01DG67X.53.82.H05.1.454.CMB.1.raw
  modified_base (144)..(147): a, c, t, g, unknown or other
  misc_feature (144)..(147): n is a, c, g, or t
tcagcgcgtatacacacgaccggtgctcgatttagtcgagctctctcgcgggcacgaccggtgctcgatttagctctacgctcagggcacgaccggtgctcgatttagtctagcgacttcagcgggctggcaaggcgcaatagnnnn

SEQ ID NO: 234995 - DNA, 183 bp, Homo sapiens
  misc_feature: GYAE6OF01CH1XF.53.82.H05.1.454.CMB.1.raw
  modified_base (177)..(183): a, c, t, g, unknown or other
  misc_feature (177)..(183): n is a, c, g, or t
tcagcgcgtatacacacgaccggtgctcgatttagtcgagctctctcgcgggcacgaccggtgctcgatttagtcgagctctctcgcgggcacgaccggtgctcgatttagtacacgtgattagggattgggtgatagggtacgcactcgtctgagcgggctggcaaggcgcatagnnnnnnn

SEQ ID NO: 234996 - DNA, 146 bp, Homo sapiens
  misc_feature: GYAE6OF01CQNNT.53.82.H05.1.454.CMB.1.raw
  modified_base (138)..(138): a, c, t, g, unknown or other
  misc_feature (138)..(138): n is a, c, g, or t
  modified_base (142)..(146): a, c, t, g, unknown or other
  misc_feature (142)..(146): n is a, c, g, or t
tcagcgcgtatacacacgaccggtgctcgatttagtcgagctctctcgcgggcacgaccggtgctcgatttagtcgagctctctcgcgggcacgaccggtgctcgatttagtagtgtagatcgcggcgtgcaggcgcntagnnnnn

SEQ ID NO: 234997 - DNA, 195 bp, Homo sapiens
  misc_feature: GYAE6OF01DKH61.53.82.H05.1.454.CMB.1.raw
  modified_base (192)..(195): a, c, t, g, unknown or other
  misc_feature (192)..(195): n is a, c, g, or t
tcagcgcgtatacacacgaccggtgctcgatttagtcgagctctctcgcgggcacgaccggtgctcgatttagtcgagctctctcgcgggcacgaccggtgctcgattttagtcgagctctctcgcgggtcacgaccggtgctcgattttagtgacatctcgcagttctgagcggctggcaaggcgcatagnnnn

SEQ ID NO: 234998 - DNA, 202 bp, Homo sapiens
  misc_feature: GYAE6OF01AX2N3.53.82.H05.1.454.CMB.1.raw
  modified_base (173)..(202): a, c, t, g, unknown or other
  misc_feature (173)..(202): n is a, c, g, or t
tcagcgcgtatacacacgaccggtgctcgatttagtcgagctctctcgcgggcacgaccggtgctcgatttagtcgagctctctcgcgggggtgctcgatttagctctacgctcagggcacgaccggtgctcgatttagcagacgtctggagcgggctggcaaggcgcatagnnnnnnnnnnnnnnnnnnnnnnnnnnnnnn

SEQ ID NO: 234999 - DNA, 108 bp, Homo sapiens
  misc_feature: GYAE6OF01AZ4EK.53.82.H05.1.454.CMB.1.raw
  modified_base (106)..(108): a, c, t, g, unknown or other
  misc_feature (106)..(108): n is a, c, g, or t
tcagcgcgtatacacacgaccggtgctcgatttagtcgagctctctcgcgggcacgaccggtgctcgatttagcagacgtctgagcgggctggcaaggcgcatagnnn

SEQ ID NO: 235000 - DNA, 213 bp, Homo sapiens
  misc_feature: GYAE6OF01D028E.53.82.H05.1.454.CMB.1.raw
  modified_base (188)..(213): a, c, t, g, unknown or other
  misc_feature (188)..(213): n is a, c, g, or t
tcagcgcgtatacacacgaccggtgctcgatttagtcgagctctctcgcgggcacgaccggtgctcgatttagtcgagctctctcgcggcacgaccggtgctcgatttagtagtgtagattcggcgggggatcggccctcccgtcgagtctacagtgctctggaggcgggctggacaaggcgcatagnnnnnnnnnnnnnnnnnnnnnnnnnn

SEQ ID NO: 235001 - DNA, 217 bp, Homo sapiens
  misc_feature: GYAE6OF01CR09W.53.82.H05.1.454.CMB.1.raw
  modified_base (180)..(217): a, c, t, g, unknown or other
  misc_feature (180)..(217): n is a, c, g, or t
tcagcgcgtatacacacgaccggtgctcgatttagtcgagctctctcgcggcacgaccggtgctcgatttagtcgagctctctcgcggcacgaccggtgctcgatttagctctacgctcagggcacgaccgtgctcgatttagcagacgtctggtcgcgggctaggcaaggcgcaagtgnnnnnnnnnnnnnnnnnnnnnnnnnnnnnnnnnnnnnn

SEQ ID NO: 235002 - DNA, 157 bp, Homo sapiens
  misc_feature: GYAE6OF01BGPAV.53.82.H05.1.454.CMB.1.raw
tcagcgcgtatacacacgaccggtgctcgattttagtcgagctctctcgcgggagagctcccaaagaactgcgagatgtcactaaatcgagcaccggtcgtgcctggtcaaggactacttcctcgtactgcgctgagcgggctggcaaggcgcatag

SEQ ID NO: 235003 - DNA, 144 bp, Homo sapiens; identical to SEQ ID NO: 234922
  misc_feature: GYAE6OF02HGHX4.53.82.H05.1.454.CMB.1.raw
  modified_base (144)..(144): a, c, t, g, unknown or other
  misc_feature (144)..(144): n is a, c, g, or t

SEQ ID NO: 235004 - DNA, 269 bp, Homo sapiens
  misc_feature: GYAE6OF02G2CT2.53.82.H05.1.454.CMB.1.raw
  modified_base (189)..(189): a, c, t, g, unknown or other
  misc_feature (189)..(189): n is a, c, g, or t
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
  modified_base (257)..(269): a, c, t, g, unknown or other
  misc_feature (257)..(269): n is a, c, g, or t
tcagcgcgtatacacacgaccggtgctcgatttagtcgagctctctcgcggcacgaccggtgctcgatttagtcgagctctctcgcggcacgaccggtgctcgatttagtcgagctctctcggcgggcacgaccggtgctcgatttagcgagctctcgtcgcggcacgaccggtgctacgatttagctntacgctcgagggcacgaccggtgctcgaatttagatctgatcgttgggtcagcgcgngcgngagcgannnnnnnnnnnnn

SEQ ID NO: 235005 - DNA, 143 bp, Homo sapiens
  misc_feature: GYAE6OF02FHK13.53.82.H05.1.454.CMB.1.raw
  modified_base (143)..(143): a, c, t, g, unknown or other
  misc_feature (143)..(143): n is a, c, g, or t
tcagcgcgtatacacacgaccggtgctcgatttagtcgagctctctcgcgggcacgaccggtgctcgatttagtagtgtagattcgcggggatggcctccctcgagtctacagtgctctgagcgggctggcaaggcgcatagn

SEQ ID NO: 235006 - DNA, 143 bp, Homo sapiens
  misc_feature: GYAE6OF02IRESX.53.82.H05.1.454.CMB.1.raw
  modified_base (143)..(143): a, c, t, g, unknown or other
  misc_feature (143)..(143): n is a, c, g, or t
tcagcgcgtatacacacgaccggtgctcgatttagtcgagctctctcgcgggcacgaccggtgctcgatttagtcgagctctctcgcggcacgaccggtgctcgatttagcagacgtctgagcgggctggcaaggcgcatagn

SEQ ID NO: 235007 - DNA, 145 bp, Homo sapiens
  misc_feature: GYAE6OF02HFAAD.53.82.H05.1.454.CMB.1.raw
  modified_base (144)..(145): a, c, t, g, unknown or other
  misc_feature (144)..(145): n is a, c, g, or t
tcagcgcgtatacacacgaccggtgctcgatttagtcgagctctctcgcgggcacgaccggtgctcgatttagtagtgtagattcgcgggggatggcctccctcgagtctacagtgctctgagcgggctggcaaggcgcatagnn

SEQ ID NO: 235008 - DNA, 151 bp, Homo sapiens
  misc_feature: GYAE6OF02IG1C3.53.82.H05.1.454.CMB.1.raw
  modified_base (151)..(151): a, c, t, g, unknown or other
  misc_feature (151)..(151): n is a, c, g, or t
tcagcgcgtatacacacgaccggtgctcgattagtcgagctctctcgcgggcacgaccggtgctcgatttagtcgagctctctcgcgggcacgaccggtgctcgatttagtgacatctcgcagttctgagcgggctggcaaggcgcatagn

SEQ ID NO: 235009 - DNA, 203 bp, Homo sapiens
  misc_feature: GYAE6OF02GYATI.53.82.H05.1.454.CMB.1.raw
  modified_base (200)..(203): a, c, t, g, unknown or other
  misc_feature (200)..(203): n is a, c, g, or t
tcagcgcgtatacacacgaccggtgctcgatttagtcgagctctctcgcggcacgaccggtgctcgatttagtcgagctctctcgcggctctcgcgggcacgaccggtgctcgatttagtcgagctctctcgcgggcacgaccggtgctcgatttagctgcgtcacgatctctcctgagcgggctggcaaggcgcatagnnnn

SEQ ID NO: 235010 - DNA, 214 bp, Homo sapiens
  misc_feature: GYAE6OF02HJY7F.53.82.H05.1.454.CMB.1.raw
  modified_base (207)..(214): a, c, t, g, unknown or other
  misc_feature (207)..(214): n is a, c, g, or t
tcagcgcgtatacacacgaccggtgctcgatttagtcgagctctctcgcgggcacgaccggtgctcgatttagtcgagctctctcgcgggcacgaccggtgctcgatttagtcgagctctctcgcgggcacgaccggtgctcgatttagtacacgtgattagggattgggtacgcactcgtctgagcgggctggcaaggcgcatagnnnnnnnn

SEQ ID NO: 235011 - DNA, 113 bp, Homo sapiens
  misc_feature: GYAE6OF02G634S.53.82.H05.1.454.CMB.1.raw
tcagcgcgtatacacacgaccggtgctcgatttagtcgagctctctcgcgggcacgaccggtgctcgatttagtgacatctcgcagttctgagcgggctggcaaggcgcatag

SEQ ID NO: 235012 - DNA, 115 bp, Homo sapiens
  misc_feature: GYAE6OF02I3HYN.53.82.H05.1.454.CMB.1.raw
  modified_base (115)..(115): a, c, t, g, unknown or other
  misc_feature (115)..(115): n is a, c, g, or t
tcagcgcgtatacacacgaccggtgctcgatttagtcgagctctctcgcgggcacgaccggtgctcgatttagtatctgatagttgggtctgagcgggctggcaaggcgcatagn

SEQ ID NO: 235013 - DNA, 151 bp, Homo sapiens
  misc_feature: GYAE6OF02HFWWK.53.82.H05.1.454.CMB.1.raw
  modified_base (131)..(131): a, c, t, g, unknown or other
  misc_feature (131)..(131): n is a, c, g, or t
  modified_base (150)..(151): a, c, t, g, unknown or other
  misc_feature (150)..(151): n is a, c, g, or t
tcagcgcgtatacacacgaccggtgctcgatttagtcgagctctctcgcggcacgaccggtgctcgatttagtcgagctttctcgcgggcacgaccggtgctcgatttagtatctgatagttgggttcagnggcgtgcgagaggcatagnn

SEQ ID NO: 235014 - DNA, 135 bp, Homo sapiens
  misc_feature: GYAE6OF02F0YNV.53.82.H05.1.454.CMB.1.raw
  modified_base (113)..(135): a, c, t, g, unknown or other
  misc_feature (113)..(135): n is a, c, g, or t
tcagcgcgtatacacacgaccggtgctcgatttagtcgagctctctcgcgggacgaccggtgctcgatttagtatctgatagttgggtctgagcggctggcaaggcgcatagnnnnnnnnnnnnnnnnnnnnnnn

SEQ ID NO: 235015 - DNA, 115 bp, Homo sapiens
  misc_feature: GYAE6OF02G85OO.53.82.H05.1.454.CMB.1.raw
  modified_base (115)..(115): a, c, t, g, unknown or other
  misc_feature (115)..(115): n is a, c, g, or t
tcagcgcgtatacacacgaccggtgctcgatttagtcgagctctctcgcgggcacgaccggtgctcgatttagtgacatctcgcagttcttgagcgggctggcaaggcgcatagn

SEQ ID NO: 235016 - DNA, 144 bp, Homo sapiens; identical to SEQ ID NO: 234945
  misc_feature: GYAE6OF02FZWJ1.53.82.H05.1.454.CMB.1.raw
  modified_base (144)..(144): a, c, t, g, unknown or other
  misc_feature (144)..(144): n is a, c, g, or t

SEQ ID NO: 235017 - DNA, 148 bp, Homo sapiens
  misc_feature: GYAE6OF02GUR5E.53.82.H05.1.454.CMB.1.raw
  modified_base (126)..(126): a, c, t, g, unknown or other
  misc_feature (126)..(126): n is a, c, g, or t
  modified_base (128)..(128): a, c, t, g, unknown or other
  misc_feature (128)..(128): n is a, c, g, or t
  modified_base (135)..(135): a, c, t, g, unknown or other
  misc_feature (135)..(135): n is a, c, g, or t
  modified_base (147)..(148): a, c, t, g, unknown or other
  misc_feature (147)..(148): n is a, c, g, or t
tcagcgcgtatacacacgaccggtgctcgatttagtcgagctctctcgcgggcacgaccggtgctcgatttagcgagacgcgcagggcacgaccggtgctcgatttagtatctgatagttgggttngnggcgtgngagaggcatagnn

SEQ ID NO: 235018 - DNA, 120 bp, Homo sapiens
  misc_feature: GYAE6OF02IZ96Q.53.82.H05.1.454.CMB.1.raw
  modified_base (120)..(120): a, c, t, g, unknown or other
  misc_feature (120)..(120): n is a, c, g, or t
tcagcgcgtatacacacgaccggtgctcgatttagtcgagctctctcgcgggcacgaccggtgctcgatttagcactcgcacgttgggttctgaggcggcgtggacgaaggcgcagtagn

SEQ ID NO: 235019 - DNA, 141 bp, Homo sapiens
  misc_feature: GYAE6OF02F958V.53.82.H05.1.454.CMB.1.raw
  modified_base (141)..(141): a, c, t, g, unknown or other
  misc_feature (141)..(141): n is a, c, g, or t
tcagcgcgtatacacacgaccggtgctcgatttagtcgagctctctcgcgggcacgaccggtgctcgatttagctctacgctcagggcacgaccggtgctcgatttagcagacgtctgagcgggctggcaaggcgcatagn

SEQ ID NO: 235020 - DNA, 106 bp, Homo sapiens; identical to SEQ ID NO: 234929
  misc_feature: GYAE6OF02FULWS.53.82.H05.1.454.CMB.1.raw
  modified_base (106)..(106): a, c, t, g, unknown or other
  misc_feature (106)..(106): n is a, c, g, or t

SEQ ID NO: 235021 - DNA, 152 bp, Homo sapiens
  misc_feature: GYAE6OF02HZ6BY.53.82.H05.1.454.CMB.1.raw
  modified_base (150)..(152): a, c, t, g, unknown or other
  misc_feature (150)..(152): n is a, c, g, or t
tcagcgcgtatacacacgaccggtgctcgatttagtcgagctctctcgcgggcacgaccggtgctcgatttagctctacgctcagggcacgaccggtgctcgatttagtgacatctcgcagttcttgagcggcgtgcgagacggcatagnnn

SEQ ID NO: 235022 - DNA, 152 bp, Homo sapiens
  misc_feature: GYAE6OF02IGDEJ.53.82.H05.1.454.CMB.1.raw
  modified_base (152)..(152): a, c, t, g, unknown or other
  misc_feature (152)..(152): n is a, c, g, or t
tcagcgcgtatacacacgaccggtgctcgatttagtcgagctctctcgcgggcacgaccggtgctcgatttagtcgagctctctcgcgggcacgaccggtgctcgatttagtgacatctcgcagttctgagcgggctggcaaggcgcatagn

SEQ ID NO: 235023 - DNA, 151 bp, Homo sapiens
  misc_feature: GYAE6OF02HM4MT.53.82.H05.1.454.CMB.1.raw
  modified_base (144)..(151): a, c, t, g, unknown or other
  misc_feature (144)..(151): n is a, c, g, or t
tcagcgcgtatacacacgaccggtgctcgatttagtcgagctctctcgcgggcacgaccggtgctcgatttagtcgagctctctcgcgggcacgaccggtgctcgatttagcagacgtctgagcgggctggcaaggcgcatagnnnnnnnn

SEQ ID NO: 235024 - DNA, 108 bp, Homo sapiens
  misc_feature: GYAE6OF02G3FNR.53.82.H05.1.454.CMB.1.raw
  modified_base (108)..(108): a, c, t, g, unknown or other
  misc_feature (108)..(108): n is a, c, g, or t
tcagcgcgtatacacacgaccggtgctcgattagtcgagctctctcgcgggcacgaccggtgctcgatttagcagtactgcgctgagcgggctggcaaggcgcatagn

SEQ ID NO: 235025 - DNA, 143 bp, Homo sapiens; identical to SEQ ID NO: 234973
  misc_feature: GYAE6OF02F3D80.53.82.H05.1.454.CMB.1.raw

SEQ ID NO: 235026 - DNA, 189 bp, Homo sapiens
  misc_feature: GYAE6OF02IE1QH.53.82.H05.1.454.CMB.1.raw
  modified_base (182)..(189): a, c, t, g, unknown or other
  misc_feature (182)..(189): n is a, c, g, or t
tcagcgcgtatacacacgaccggtgctcgatttagtcgagctctctcgcgggcacgaccggtgctcgatttagtcgagctctctcgcgggtacgaccggtgctcgatttagtagtgtagattcgcgggggatggcctccctcgagtctacagtgctctgagcgggctggcaaggcgcatagnnnnnnnn

SEQ ID NO: 235027 - DNA, 106 bp, Homo sapiens; identical to SEQ ID NO: 234929
  misc_feature: GYAE6OF02H8WSY.53.82.H05.1.454.CMB.1.raw
  modified_base (106)..(106): a, c, t, g, unknown or other
  misc_feature (106)..(106): n is a, c, g, or t

SEQ ID NO: 235028 - DNA, 144 bp, Homo sapiens; identical to SEQ ID NO: 234945
  misc_feature: GYAE6OF02GY114.53.82.H05.1.454.CMB.1.raw
  modified_base (144)..(144): a, c, t, g, unknown or other
  misc_feature (144)..(144): n is a, c, g, or t

SEQ ID NO: 235029 - DNA, 144 bp, Homo sapiens; identical to SEQ ID NO: 234922
  misc_feature: GYAE6OF02GN4EX.53.82.H05.1.454.CMB.1.raw
  modified_base (144)..(144): a, c, t, g, unknown or other
  misc_feature (144)..(144): n is a, c, g, or t

SEQ ID NO: 235030 - DNA, 154 bp, Homo sapiens
  misc_feature: GYAE6OF02GZ6KC.53.82.H05.1.454.CMB.1.raw
  modified_base (154)..(154): a, c, t, g, unknown or other
  misc_feature (154)..(154): n is a, c, g, or t
tcagcgcgtatacacacgaccggtgctcgatttagtcgagctctctcgcgggcacgaccggtgctcgatttagtcgaggctctctcgcgggcacgaccggtgctcgatttagtgacatctcgcagttcttgagcgggctggcaaggcgcatagn

SEQ ID NO: 235031 - DNA, 151 bp, Homo sapiens
  misc_feature: GYAE6OF02GF5U7.53.82.H05.1.454.CMB.1.raw
  modified_base (151)..(151): a, c, t, g, unknown or other
  misc_feature (151)..(151): n is a, c, g, or t
tcagcgcgtatacacacgaccggtgctcgatttagtcgagctctctcgcgggcacgaccggtgctcgatttagtcgagctctctcgcggcacgaccggtgctcgatttagtgacatctcgcagttctgagcgggctggcaaggcgcatagn

SEQ ID NO: 235032 - DNA, 181 bp, Homo sapiens
  misc_feature: GYAE6OF02H5165.53.82.H05.1.454.CMB.1.raw
  modified_base (178)..(181): a, c, t, g, unknown or other
  misc_feature (178)..(181): n is a, c, g, or t
tcagcgcgtatacacacgaccggtgctcgatttagtcgagctctctcgcgggcacgaccggtgctcgatttggacgacagctcagggcacgaccggtgctcgatttagtagtgtagattcgcggggatggcctccctcgagtctacagtgctctgagcgggctggcaaggcgcatagnnnn

SEQ ID NO: 235033 - DNA, 231 bp, Homo sapiens
  misc_feature: GYAE6OF02JEKOT.53.82.H05.1.454.CMB.1.raw
  modified_base (185)..(185): a, c, t, g, unknown or other
  misc_feature (185)..(185): n is a, c, g, or t
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
  modified_base (216)..(216): a, c, t, g, unknown or other
  misc_feature (216)..(216): n is a, c, g, or t
  modified_base (219)..(219): a, c, t, g, unknown or other
  misc_feature (219)..(219): n is a, c, g, or t
  modified_base (222)..(231): a, c, t, g, unknown or other
  misc_feature (222)..(231): n is a, c, g, or t
tcagcgcgtatacacacgaccggtgctcgatttagtcgagctctctcgcgggcacgaccggtgctcgatttagtcgagctctctcggctacgaccggtgcgtcgagtttagtcgagcctctctcgcgggcacgaccggtgctcgatttagcgagctctctcgcggcacgccggtgctgatttagngacatctcgcagttctgagcggtnganagcntanagnnnnnnnnnn

SEQ ID NO: 235034 - DNA, 112 bp, Homo sapiens
  misc_feature: GYAE6OF02FJPVE.53.82.H05.1.454.CMB.1.raw
tcagcgcgtatacacacgaccggtgctcgatttagtcgagctctctcgcgggcacgaccggtgctcgatttagtgacatctcgcagttctgagcggctggcaaggcgcatag

SEQ ID NO: 235035 - DNA, 178 bp, Homo sapiens
  misc_feature: GYAE6OF02G3ZIB.53.82.H05.1.454.CMB.1.raw
  modified_base (147)..(178): a, c, t, g, unknown or other
  misc_feature (147)..(178): n is a, c, g, or t
tcagcgcgtatacacacgaccggtgctcgatttagtcgagctctctcgcgggcgacgaccggtgctcgatttagtcgagctctctcgcggcacgaccggtgcctcgatttagcagacgtcgtggagcgggctggcaaggcgcatagnnnnnnnnnnnnnnnnnnnnnnnnnnnnnnnn

SEQ ID NO: 235036 - DNA, 143 bp, Homo sapiens; identical to SEQ ID NO: 234964
  misc_feature: GYAE6OF02IRAZV.53.82.H05.1.454.CMB.1.raw

SEQ ID NO: 235037 - DNA, 226 bp, Homo sapiens
  misc_feature: GYAE6OF02F1Q5Z.53.82.H05.1.454.CMB.1.raw
  modified_base (203)..(207): a, c, t, g, unknown or other
  misc_feature (203)..(207): n is a, c, g, or t
  modified_base (209)..(226): a, c, t, g, unknown or other
  misc_feature (209)..(226): n is a, c, g, or t
tcagcgcgtatacacacgaccggtgctcgatttagtcgagctctctcgcgggcacgaccggtgctcgatttagtcgagctctctcgcgggcacgaccggtgctcgatttagcagacgtctgtcgcgggctggcaaggcgcatagctgcctggtcaaggactacttcctcgtactgcgctgagcgggctggcaaggcgcatagnnnnnannnnnnnnnnnnnnnnnn

SEQ ID NO: 235038 - DNA, 181 bp, Homo sapiens
  misc_feature: GYAE6OF02HU282.53.82.H05.1.454.CMB.1.raw
  modified_base (179)..(181): a, c, t, g, unknown or other
  misc_feature (179)..(181): n is a, c, g, or t
tcagcgcgtatacacacgaccggtgctcgatttagtcgagctctctcgcgggcacgaccggtgctcgatttagtcgagctctctcgcggcacgaccggtgctcgatttagctctacgctcagggcacgaccggtgctcgatttagcagacgtctgtagcgggctggcaaggcgcatagnnn

SEQ ID NO: 235039 - DNA, 185 bp, Homo sapiens
  misc_feature: GYAE6OF02F2I9A.53.82.H05.1.454.CMB.1.raw
  modified_base (182)..(185): a, c, t, g, unknown or other
  misc_feature (182)..(185): n is a, c, g, or t
tcagcgcgtatacacacgaccggtgctcgatttagtcgagctctctcgcgggcacgaccggtgctcgatttagtcgagctctctcgcgggcacgaccggtgctcgatttagtagtgtagattcgcgggggatggcctccctcgagtctacagtgctctgagcgggctggcaaggcgcatagnnnn

SEQ ID NO: 235040 - DNA, 221 bp, Homo sapiens
  misc_feature: GYAE6OF02HHDYZ.53.82.H05.1.454.CMB.1.raw
  modified_base (218)..(221): a, c, t, g, unknown or other
  misc_feature (218)..(221): n is a, c, g, or t
tcagcgcgtatacacacgaccggtgctcgatttagtcgagctctctcgcgggcacgaccggtgctcgatttagtcgagctctctcgcgggcacgaccggtgctcgatttagctctacgctcgagggcacgaccggtgctcgatttagtagtgtagattcgcgggggatggcctccctcgagtctacagtgctctgagcgggctggcaaggcgcatagnnnn

SEQ ID NO: 235041 - DNA, 207 bp, Homo sapiens
  misc_feature: GYAE6OF02HTTM9.53.82.H05.1.454.CMB.1.raw
  modified_base (165)..(165): a, c, t, g, unknown or other
  misc_feature (165)..(165): n is a, c, g, or t
  modified_base (191)..(207): a, c, t, g, unknown or other
  misc_feature (191)..(207): n is a, c, g, or t
tcagcgcgtatacacacgaccggtgctcgatttagtcgagctctctcgcgggcacgaccggtgctcgatttagtcgagctctctcgcgggcacgaccggtgctcgatttagcgagctctctcgcggcacgaccggtgctcgattttagatctgatagttgggtcngagcggtctggacaaggcgctaatgnnnnnnnnnnnnnnnnn

SEQ ID NO: 235042 - DNA, 114 bp, Homo sapiens
  misc_feature: GYAE6OF02G7JJI.53.82.H05.1.454.CMB.1.raw
  modified_base (112)..(114): a, c, t, g, unknown or other
  misc_feature (112)..(114): n is a, c, g, or t
tcagcgcgtatacacacgaccggtgctcgatttagtcgagctctctcgcggccgaccggtgctcgatttagctcgatatagttgggtctgagcggctggcaaggcgcatagnnn

SEQ ID NO: 235043 - DNA, 237 bp, Homo sapiens
  misc_feature: GYAE6OF02FXGVZ.53.82.H05.1.454.CMB.1.raw
  modified_base (222)..(222): a, c, t, g, unknown or other
  misc_feature (222)..(222): n is a, c, g, or t
  modified_base (228)..(237): a, c, t, g, unknown or other
  misc_feature (228)..(237): n is a, c, g, or t
tcagcgcgtatacacacgaccggtgctcgatttagtcgagctctctcgcggcacgaccggtgctcgatttagtcgagctctctcgcggcacgaccggtgctcgatttagtcgagctctctcgcgggcacgaccggtgctcgatttagcgagctctctcgcgggcacgaccggtgctcgatttagtgacatctcgcagttctgacggcgggctggacaaggcncatagnnnnnnnnnn

SEQ ID NO: 235044 - DNA, 116 bp, Homo sapiens
  misc_feature: GYAE6OF02GFGTT.53.82.H05.1.454.CMB.1.raw
  modified_base (91)..(91): a, c, t, g, unknown or other
  misc_feature (91)..(91): n is a, c, g, or t
  modified_base (114)..(116): a, c, t, g, unknown or other
  misc_feature (114)..(116): n is a, c, g, or t
tcagcgcgtatacacacgaccggtgctcgatttagtcgagctctctcgcgggcacgaccggtgctcgatttagtatctgatagttgggttnagcggcgtgcgaagacgcatagnnn

SEQ ID NO: 235045 - DNA, 148 bp, Homo sapiens
  misc_feature: GYAE6OF02IF75B.53.82.H05.1.454.CMB.1.raw
  modified_base (132)..(132): a, c, t, g, unknown or other
  misc_feature (132)..(132): n is a, c, g, or t
  modified_base (139)..(139): a, c, t, g, unknown or other
  misc_feature (139)..(139): n is a, c, g, or t
  modified_base (146)..(148): a, c, t, g, unknown or other
  misc_feature (146)..(148): n is a, c, g, or t
tcagcgcgtatacacacgaccggtgctcgatttagtcgagctctctcgcgggcacgaccggtgctcgatttagtagtgtagattcgcgggggatggcctccctcgagtctacagtgctctgagcgggctggnaaccggngcatagnnn

SEQ ID NO: 235046 - DNA, 147 bp, Homo sapiens
  misc_feature: GYAE6OF02IQXMM.53.82.H05.1.454.CMB.1.raw
  modified_base (142)..(147): a, c, t, g, unknown or other
  misc_feature (142)..(147): n is a, c, g, or t
tcagcgcgtatacacacgaccggtgctcgatttagtcgagctctctcgcgggcacgaccggtgctcgatttagtcgagctctctcgcggcacgaccggtgctcgatttagcagacgtctgagcggctggcaaggcgcatagnnnnnn

SEQ ID NO: 235047 - DNA, 288 bp, Homo sapiens
  misc_feature: GYAE6OF02I9N3A.53.82.H05.1.454.CMB.1.raw
  modified_base (230)..(230): a, c, t, g, unknown or other
  misc_feature (230)..(230): n is a, c, g, or t
  modified_base (250)..(250): a, c, t, g, unknown or other
  misc_feature (250)..(250): n is a, c, g, or t
  modified_base (274)..(288): a, c, t, g, unknown or other
  misc_feature (274)..(288): n is a, c, g, or t
tcagcgcgtatacacacgaccggtgctcgatttagtcgagctctctcgcgggcacgaccggtgctcgatttagtcgagctctctcgcgggaacaccggtgctcgatttagtcgagctctctcgcggcacgaccggtgctcgatttagtcgagctctctcgcgggcacgaccggtgctcgattttagcgagctctctcgcgggctacggaccggtgctcggattttaacgngcgtctacgatctctctagngcggctggagaacgcgcattagcnnnnnnnnnnnnnnn

SEQ ID NO: 235048 - DNA, 145 bp, Homo sapiens
  misc_feature: GYAE6OF02H2STY.53.82.H05.1.454.CMB.1.raw
  modified_base (123)..(123): a, c, t, g, unknown or other
  misc_feature (123)..(123): n is a, c, g, or t
  modified_base (144)..(145): a, c, t, g, unknown or other
  misc_feature (144)..(145): n is a, c, g, or t
tcagcgcgtatacacacgaccggtgctcgatttagtcgagctctctcgcgggcacgaccggtgctcgatttagtcgagctctctcgcgggcacgaccggtgctcgattttagcagacgtctgngcgggctggcaagcgcatagnn

SEQ ID NO: 235049 - DNA, 142 bp, Homo sapiens
  misc_feature: GYAE6OF02HN6VM.53.82.H05.1.454.CMB.1.raw
  modified_base (141)..(142): a, c, t, g, unknown or other
  misc_feature (141)..(142): n is a, c, g, or t
tcagcgcgtatacacacgaccggtgctcgatttagtcgagctctctcgcgggcacgaccggtgctcgatttagcgagacgcgcagggcacgaccggtgctcgatttagcagacgtctgagcgggctggcaaggcgcatagnn

SEQ ID NO: 235050 - DNA, 181 bp, Homo sapiens
  misc_feature: GYAE6OF02IE05M.53.82.H05.1.454.CMB.1.raw
  modified_base (179)..(181): a, c, t, g, unknown or other
  misc_feature (179)..(181): n is a, c, g, or t
tcagcgcgtatacacacgaccggtgctcgatttagtcgagctctctcgcggcacgaccggtgctcgatttagtcgagctctctcgcgggcacgaccggtgctcgatttagctctacgctcagggcacgaccggtgctcgatttagcagacgtctgacgcgggctggcaaggcgcatagnnn

SEQ ID NO: 235051 - DNA, 145 bp, Homo sapiens; identical to SEQ ID NO: 235007
  misc_feature: GYAE6OF02GJKG2.53.82.H05.1.454.CMB.1.raw
  modified_base (144)..(145): a, c, t, g, unknown or other
  misc_feature (144)..(145): n is a, c, g, or t

SEQ ID NO: 235052 - DNA, 276 bp, Homo sapiens
  misc_feature: GYAE6OF02GEQ2N.53.82.H05.1.454.CMB.1.raw
  modified_base (264)..(276): a, c, t, g, unknown or other
  misc_feature (264)..(276): n is a, c, g, or t
tcagcgcgtatacacacgaccggtgctcgatttagtcgagctctctcgcgggcacgaccggtgctcgatttagtcgagctctctcgcgggcacgaccggtgctcgatttagtcgagctctctcgcgggcacgaccggtgctcgatttagtcgagctctctcgcggcaccaccggtgctcgatttagtcgagctctctcgcggcacgacggtgctcgatttagtgacatctcgcagttcttgacgcgggctggcaaggcgcatgnnnnnnnnnnnnn

SEQ ID NO: 235053 - DNA, 147 bp, Homo sapiens
  misc_feature: GYAE6OF02JH1WH.53.82.H05.1.454.CMB.1.raw
  modified_base (119)..(119): a, c, t, g, unknown or other
  misc_feature (119)..(119): n is a, c, g, or t
  modified_base (141)..(147): a, c, t, g, unknown or other
  misc_feature (141)..(147): n is a, c, g, or t
tcagcgcgtatacacacgaccggtgctcgatttagtcgagctctctcgcgggcacgaccggtgctcgatttagctctacgctcagggcacgaccggtgctcgatttagcagacgtctgngcgggctggcaaggcgcatagnnnnnnn

SEQ ID NO: 235054 - DNA, 156 bp, Homo sapiens
  misc_feature: GYAE6OF02GM1SU.53.82.H05.1.454.CMB.1.raw
  modified_base (154)..(156): a, c, t, g, unknown or other
  misc_feature (154)..(156): n is a, c, g, or t
tcagcgcgtatacacacgaccggtgctcgatttagtcgagctctctcgcgggcacgaccggtgctcgatttagtcgagctctctcgcgggcacgaccggtgctcgatttagtgacatctcgcagttctttgagcgggctggcaaggcgcatagnnn

SEQ ID NO: 235055 - DNA, 197 bp, Homo sapiens
  misc_feature: GYAE6OF02IH0PB.53.82.H05.1.454.CMB.1.raw
  modified_base (193)..(197): a, c, t, g, unknown or other
  misc_feature (193)..(197): n is a, c, g, or t
tcagcgcgtatacacacgaccggtgctcgatttagtcgagctctctcgcgggcacgaccggtgctcgatttagtcgagctctctcgcgggcacgaccggtgctcgatttagtcgagctctctcgcgggcacgaccggtgctcgattttagtgacatctcgcagtttctgaggcggctggcgaaggcacatagnnnnn

SEQ ID NO: 235056 - DNA, 144 bp, Homo sapiens
  misc_feature: GYAE6OF02H3OZM.53.82.H05.1.454.CMB.1.raw
  modified_base (138)..(138): a, c, t, g, unknown or other
  misc_feature (138)..(138): n is a, c, g, or t
  modified_base (144)..(144): a, c, t, g, unknown or other
  misc_feature (144)..(144): n is a, c, g, or t
tcagcgcgtatacacacgaccggtgctcgatttagtcgagctctctcgcgggcacgaccggtgctcgatttagtagtgtagattcgcgggggatggcctccctcgagtctacagtgctctgagcgggctggcaaggcncatagn

SEQ ID NO: 235057 - DNA, 157 bp, Homo sapiens
  misc_feature: GYAE6OF02FLLM2.53.82.H05.1.454.CMB.1.raw
  modified_base (154)..(157): a, c, t, g, unknown or other
  misc_feature (154)..(157): n is a, c, g, or t
tcagcgcgtatacacacgaccggtgctcgatttagtcgagctctctcgcgggcacgaccggtgctcgatttagtcgagctctctcgcgggcacgaccggtgctcgatttagtgacatctcgcagttctttgagcgggctggcaaggcgcatagnnnn

SEQ ID NO: 235058 - DNA, 106 bp, Homo sapiens; identical to SEQ ID NO: 234929
  misc_feature: GYAE6OF02HA65G.53.82.H05.1.454.CMB.1.raw
  modified_base (106)..(106): a, c, t, g, unknown or other
  misc_feature (106)..(106): n is a, c, g, or t

SEQ ID NO: 235059 - DNA, 159 bp, Homo sapiens
  misc_feature: GYAE6OF02HR3OJ.53.82.H05.1.454.CMB.1.raw
  modified_base (155)..(159): a, c, t, g, unknown or other
  misc_feature (155)..(159): n is a, c, g, or t
tcagcgcgtatacacacgaccggtgctcgatttagtcgagctctctcgcgggcacgaccggtgctcgatttagtcgagctctctcgcgggcacgaccggtgctcgatttagcactcgcacgttgggtctgaggcggctggacgaaggcgcatagnnnnn

SEQ ID NO: 235060 - DNA, 657 bp, Homo sapiens
  misc_feature: GYAE6OF02FRK95.53.82.H05.1.454.CMB.1.raw
  modified_base (242)..(242): a, c, t, g, unknown or other
  misc_feature (242)..(242): n is a, c, g, or t
tcagcgcgtatacacacgaccggtgctcgattagtcgagctctctcgcgggcacgaccggtgctcgatttagtagtgtagattcgcggggagcttcagctgtggtagagaagacaggattcaggacaatctccagcatggccggcttccctctcctcctcaccctcctcactcactgtgcagggtcctgggcccagtctgtgctgactcagcccaccctcagcgtcgtcgggacccccgggnaggagggtccaccatctcctgttctggaagcacggtccaacagtcggaagtgtattttgtattcgtcggtaccagctcgcctcccgaggacgccgggaccccaaactcctactactttacgagtaatgatcgaggccggccctacgacggggttccctaggtacccgtattccgtcgttacggtcctaccgaagttccgtcggtccaacccgtcgaccgtccccgttccgtcggccctagtccgagggttccgcccgtccgggtaccgacgtagtcggacgtcttagtaactttacgtttacgttcggtacgtactacgggtactaaggttagggtacgtaccgtaacgtcggtaacccgttgggttacggggttacgggttacgggtttaccggttacgggttaacccgggggg

SEQ ID NO: 235061 - DNA, 147 bp, Homo sapiens
  misc_feature: GYAE6OF02I2ZWW.53.82.H05.1.454.CMB.1.raw
  modified_base (144)..(147): a, c, t, g, unknown or other
  misc_feature (144)..(147): n is a, c, g, or t
tcagcgcgtatacacacgaccggtgctcgatttagtcgagctctctcgcgggcacgaccggtgctcgatttagtagtgtagattcgcgggggatggcctccctcgagtctacagtgctctgagcgggctggcaaggcgcatagnnnn

SEQ ID NO: 235062 - DNA, 107 bp, Homo sapiens
  misc_feature: GYAE6OF02IIJHL.53.82.H05.1.454.CMB.1.raw
  modified_base (107)..(107): a, c, t, g, unknown or other
  misc_feature (107)..(107): n is a, c, g, or t
tcagcgcgtatacacacgaccggtgctcgatttagtcgagctctctcgcggtcacgaccggtgctcgatttagcagacgtctgtcgcgggctggcaaggcgcatagn

SEQ ID NO: 235063 - DNA, 188 bp, Homo sapiens
  misc_feature: GYAE6OF02HGWS5.53.82.H05.1.454.CMB.1.raw
  modified_base (184)..(188): a, c, t, g, unknown or other
  misc_feature (184)..(188): n is a, c, g, or t
tcagcgcgtatacacacgaccggtgctcgatttagtcgagctctctcgcgggcacgaccggtgctcgatttagtcgagctctctcgcgggcacgaccggtgctcgatttagtcgagctctctcgcgggcacgaccggtgctcgattttagcagacgtctgtcgcgggctggcaaggcgcatagnnnnn

SEQ ID NO: 235064 - DNA, 165 bp, Homo sapiens
  misc_feature: GYAE6OF02HC6OO.53.82.H05.1.454.CMB.1.raw
  modified_base (150)..(165): a, c, t, g, unknown or other
  misc_feature (150)..(165): n is a, c, g, or t
tcagcgcgtatacacacgaccggtgctcgatttagtcgagctctctcgcgggcacgaccggtgctcgatttagtcgagctctctcgcggcacgaccggtgctcgattttagctagccgacttcgaggcggctggacaaggcgacagtagnnnnnnnnnnnnnnnn

SEQ ID NO: 235065 - DNA, 672 bp, Homo sapiens
  misc_feature: GYAE6OF02JB8IC.53.82.H05.1.454.CMB.1.raw
  modified_base (241)..(241): a, c, t, g, unknown or other
  misc_feature (241)..(241): n is a, c, g, or t
  modified_base (556)..(556): a, c, t, g, unknown or other
  misc_feature (556)..(556): n is a, c, g, or t
tcagcgcgtatacacacgaccggtgctcgattagtcgagctctctcgcgggcacgaccggtgctcgatttagtagtgtagattcgcgggggagcttcagctgtggtagagaagacaggattcaggacaatctcagcatggccggcttccctctcctcctcaccctcctcactcactgtgcagggtcctgggcccagtctgtgctgactcagccaccctcagcgtcgtcgggacccccgggnacgaggtcaccatctcctgttcgtggaacgcaggtaccaacagtacggaagtgtattttgtattcgtacggtaccagtctcgtcctccagggacggccgggaccccaaaaccgtcctactagtttaacgaggtaactgactcgacgccgacctcggacgggtcccacgtaccgtaattccgtcgtcggtacctaccgtaacgtccgtcggaccaacccttacgaccggtaccccttcccgttacggacccttaacgtaccgaacggttccggtccccgttacccgggtccggtaacgtacgtacgggaaccggtntaaggtaacttttaacgtttaagttggtacgacgtagacgtaaggttacggggtaattacggacgtacggttaccgtagggtaagttcgggtagttacgggtttacgtacccgggg

SEQ ID NO: 235066 - DNA, 188 bp, Homo sapiens
  misc_feature: GYAE6OF02F0QDY.53.82.H05.1.454.CMB.1.raw
  modified_base (184)..(188): a, c, t, g, unknown or other
  misc_feature (184)..(188): n is a, c, g, or t
tcagcgcgtatacacacgaccggtgctcgatttagtcgagctctctcgcgggcacgaccggtgctcgatttagtagtgtagattccgcgggcacgaccggtgctcgatttagtagtgtagattccgcgggcacgaccggtgctcgatttagcagacgtctgtgcgggctggcaaggcgcatagnnnnn

SEQ ID NO: 235067 - DNA, 225 bp, Homo sapiens
  misc_feature: GYAE6OF02FZO31.53.82.H05.1.454.CMB.1.raw
  modified_base (216)..(225): a, c, t, g, unknown or other
  misc_feature (216)..(225): n is a, c, g, or t
tcagcgcgtatacacacgaccggtgctcgatttagtcgagctctctcgcgggcacgaccggtgctcgatttagtcgagctctctcgcgggcacgaccggtgctcgatttagctctacgctcagggcacgaccggtgctcgatttagctctacgctcgagggcacgaccggtgttcgatttagcagacgtctgtagcgggctggcaaggcgcatagnnnnnnnnnn

SEQ ID NO: 235068 - DNA, 199 bp, Homo sapiens
  misc_feature: GYAE6OF02FW17T.53.82.H05.1.454.CMB.1.raw
  modified_base (128)..(128): a, c, t, g, unknown or other
  misc_feature (128)..(128): n is a, c, g, or t
  modified_base (137)..(137): a, c, t, g, unknown or other
  misc_feature (137)..(137): n is a, c, g, or t
  modified_base (151)..(151): a, c, t, g, unknown or other
  misc_feature (151)..(151): n is a, c, g, or t
  modified_base (153)..(199): a, c, t, g, unknown or other
  misc_feature (153)..(199): n is a, c, g, or t
tcagcgcgtatacacacgaccggtgctcgatttagtcgagctctctcgcgggcacgaccggtgctcgatttagtcgagctctctcgcgggcacgaccggtgctcgatttagatctgatagttgggttngaggcggtngaacgaggcataangnnnnnnnnnnnnnnnnnnnnnnnnnnnnnnnnnnnnnnnnnnnnnnn

SEQ ID NO: 235069 - DNA, 119 bp, Homo sapiens
  misc_feature: GYAE6OF02JHD0U.53.82.H05.1.454.CMB.1.raw
  modified_base (107)..(119): a, c, t, g, unknown or other
  misc_feature (107)..(119): n is a, c, g, or t
tcagcgcgtatacacacgaccggtgctcgatttagtcgagctctctcgcgggcacgaccggtgctcgatttagcagacgtctgtcgcgggctggcaaggcgcatagnnnnnnnnnnnnn

SEQ ID NO: 235070 - DNA, 221 bp, Homo sapiens
  misc_feature: GYAE6OF02HZWHY.53.82.H05.1.454.CMB.1.raw
  modified_base (136)..(136): a, c, t, g, unknown or other
  misc_feature (136)..(136): n is a, c, g, or t
  modified_base (192)..(221): a, c, t, g, unknown or other
  misc_feature (192)..(221): n is a, c, g, or t
tcagcgcgtatacacacgaccggtgctcgatttagtcgagctctctcgcgggcacgaccggtgctcgatttagtcgagctctctcgcggcacgaccggtgctcgatttagcgagctctctcgcggcacgaccggtnctacgattttagacacgtgtagttaggggagcgggctagggcaagggcactatagnnnnnnnnnnnnnnnnnnnnnnnnnnnnnn

SEQ ID NO: 235071 - DNA, 157 bp, Homo sapiens
  misc_feature: GYAE6OF02IGF9D.53.82.H05.1.454.CMB.1.raw
  modified_base (138)..(138): a, c, t, g, unknown or other
  misc_feature (138)..(138): n is a, c, g, or t
  modified_base (144)..(157): a, c, t, g, unknown or other
  misc_feature (144)..(157): n is a, c, g, or t
tcagcgcgtatacacacgaccggtgctcgatttagtcgagctctctcgcgggcacgaccggtgctcgatttagtagtgtagattcgcgggggatggcctccctcgagtctacagtgctctgagcgggctggcaaggcncatagnnnnnnnnnnnnnn

SEQ ID NO: 235072 - DNA, 300 bp, Homo sapiens
  misc_feature: GYAE6OF02FKASG.53.82.H05.1.454.CMB.1.raw
  modified_base (231)..(231): a, c, t, g, unknown or other
  misc_feature (231)..(231): n is a, c, g, or t
  modified_base (267)..(267): a, c, t, g, unknown or other
  misc_feature (267)..(267): n is a, c, g, or t
  modified_base (271)..(300): a, c, t, g, unknown or other
  misc_feature (271)..(300): n is a, c, g, or t
tcagcgcgtatacacacgaccggtgctcgatttagtcgagctctctcgcgggcacgaccggtgctcgatttagtcgagctctctcgcgggcacgaccggtgctcgatttagtcgagctctctcgcgggcacgaccggtgctcgattttagtcgagctctctcgcgggtcaccaccggtgctcgatttaggtcgagctctctcgcgggcacggaccggtgcctcgatttagngacatctcgactagttcttgagcggctggacagcgnatgnnnnnnnnnnnnnnnnnnnnnnnnnnnnnn

SEQ ID NO: 235073 - DNA, 182 bp, Homo sapiens
  misc_feature: GYAE6OF02H2KAG.53.82.H05.1.454.CMB.1.raw
  modified_base (83)..(83): a, c, t, g, unknown or other
  misc_feature (83)..(83): n is a, c, g, or t
  modified_base (112)..(112): a, c, t, g, unknown or other
  misc_feature (112)..(112): n is a, c, g, or t
  modified_base (128)..(128): a, c, t, g, unknown or other
  misc_feature (128)..(128): n is a, c, g, or t
  modified_base (147)..(147): a, c, t, g, unknown or other
  misc_feature (147)..(147): n is a, c, g, or t
  modified_base (153)..(182): a, c, t, g, unknown or other
  misc_feature (153)..(182): n is a, c, g, or t
tcagcgcgtatacacacgaccggtgctcgatttagtcgagctctctcgcgggcacgaccggtgctcgatttagcgagctctcncgcgggacgaccggtgctcgatttagtancatactggttgggtcngagcggctggcgaaggtcnaagtgnnnnnnnnnnnnnnnnnnnnnnnnnnnnnn

SEQ ID NO: 235074 - DNA, 247 bp, Homo sapiens
  misc_feature: GYAE6OF02IA4SO.53.82.H05.1.454.CMB.1.raw
  modified_base (156)..(156): a, c, t, g, unknown or other
  misc_feature (156)..(156): n is a, c, g, or t
  modified_base (194)..(194): a, c, t, g, unknown or other
  misc_feature (194)..(194): n is a, c, g, or t
  modified_base (202)..(206): a, c, t, g, unknown or other
  misc_feature (202)..(206): n is a, c, g, or t
  modified_base (208)..(247): a, c, t, g, unknown or other
  misc_feature (208)..(247): n is a, c, g, or t
tcagcgcgtatacacacgaccggtgctcgatttagtcgagctctctcgcgggcacgaccggtgctcgatttagtcgagctcgtctcgcgggcacgaccggtgctcgattttagcgagctctcgtcgcgggcacggaccggtgctcgaattttaggnacattcctcgcagtttctttggcgggtctggcaaggcncaagtagnnnnncnnnnnnnnnnnnnnnnnnnnnnnnnnnnnnnnnnnnnnnn

SEQ ID NO: 235075 - DNA, 304 bp, Homo sapiens
  misc_feature: GYAE6OF02GDI1C.53.82.H05.1.454.CMB.1.raw
  modified_base (124)..(124): a, c, t, g, unknown or other
  misc_feature (124)..(124): n is a, c, g, or t
  modified_base (249)..(249): a, c, t, g, unknown or other
  misc_feature (249)..(249): n is a, c, g, or t
  modified_base (252)..(304): a, c, t, g, unknown or other
  misc_feature (252)..(304): n is a, c, g, or t
tcagcgcgtatacacacgaccggtgctcgatttagtcgagctctctcgcgggcacgaccggtgctcgatttagtcgagcctctctcgcgggcacgaccggtgctcgattttacgtgtagtcgtnttcgccggggacgtgaccctacccgttgacgttcgtacttaaggtgtcgtactgtacggcgggggacttgggacctacggtcgaacgtcttagatcgctcagagcgggcctaggcacggcgatanagnnnnnnnnnnnnnnnnnnnnnnnnnnnnnnnnnnnnnnnnnnnnnnnnnnnnn

SEQ ID NO: 235076 - DNA, 196 bp, Homo sapiens
  misc_feature: GYAE6OF02JP7F4.53.82.H05.1.454.CMB.1.raw
  modified_base (128)..(128): a, c, t, g, unknown or other
  misc_feature (128)..(128): n is a, c, g, or t
  modified_base (153)..(196): a, c, t, g, unknown or other
  misc_feature (153)..(196): n is a, c, g, or t
tcagcgcgtatacacacgaccggtgctcgatttagtcgagctctctcgcgggcacgaccggtgctcgatttagctctacgctccagggacgaccggtgctcgatttagtatctgataggttgggtttnagcgggctggcaaggcgcgataggnnnnnnnnnnnnnnnnnnnnnnnnnnnnnnnnnnnnnnnnnnnn

SEQ ID NO: 235077 - DNA, 198 bp, Homo sapiens
  misc_feature: GYAE6OF02FJKIA.53.82.H05.1.454.CMB.1.raw
  modified_base (183)..(198): a, c, t, g, unknown or other
  misc_feature (183)..(198): n is a, c, g, or t
tcagcgcgtatacacacgaccggtgctcgatttagtcgagctctctcgcgggcacgaccggtgctcgatttagtcgagctctctcgcgggcacgaccggtgctcgatttagtcgagctctctcgcgggcacgaccggtgctcgatttagcagacgtctgtcgcgggctggcaaggcgcatagnnnnnnnnnnnnnnnn

SEQ ID NO: 235078 - DNA, 192 bp, Homo sapiens
  misc_feature: GYAE6OF02GUUDN.53.82.H05.1.454.CMB.1.raw
  modified_base (179)..(192): a, c, t, g, unknown or other
  misc_feature (179)..(192): n is a, c, g, or t
tcagcgcgtatacacacgaccggtgctcgatttagtcgagctctctcgcgggcacgaccggtgctcgatttagtcgagctctctcgcgggcacgaccggtgctcgatttagtcgagctctctcgcgggagagccgccctcctctcgtactgcgctgagcgggctggcaaggcgcatagnnnnnnnnnnnnnn

SEQ ID NO: 235079 - DNA, 656 bp, Homo sapiens
  misc_feature: GYAE6OF01CH6X6.33.19.B08.1.454.CMB.1.raw
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (298)..(298): a, c, t, g, unknown or other
  misc_feature (298)..(298): n is a, c, g, or t
  modified_base (443)..(443): a, c, t, g, unknown or other
  misc_feature (443)..(443): n is a, c, g, or t
  modified_base (462)..(462): a, c, t, g, unknown or other
  misc_feature (462)..(462): n is a, c, g, or t
tcagtacacacactcacgaccggtgctcgatttagtgagtcagtaaagggaaagggggggtctcaggaggcagcgctctcaggacgtcaccaccatggcctggctctgctcctcctcaccctcctcactcagggcacgagggtcctgggcccagtctcgccctgactcacgcctccctccgcgtccggtctcctggacagtcagtcgccatctcctgcactggaaccagccgtgacgttggtgttataagtntgtctctgtaccaacngcaccaggacaaacgcccaatctagattangagtcactgacgcgcctcgacggtcctgactcgtcttctcgtcgtcctacgaagtcgtcgacaaccgtaccgcctaccctcgaccttatccgttacgcggcctccgaggctaggtagtagtcggagtctagttaattactacgtnaccgtagtccgtacgttancgacggaggtaccgtaacctaaacggttaaggtttacgggtacggttacgggaccggaaccgggtaacgtaaaccgggttaccggtacccggttaaaccgttaccggaacccgaaccggttaacccggaccgttcccgttccccggacccccgttacggaccctttaccgtccccgtttccccgggtacccccc

SEQ ID NO: 235080 - DNA, 726 bp, Homo sapiens
  misc_feature: GYAE6OF01EZ6TQ.33.19.B08.1.454.CMB.1.raw
tcagtacacacactcacgaccggtgctcgatttagtgagtcagtaaagggaaaggggggggtctcaggaggcagcgctctcaggacgtcaccaccatggcctgggctctgctcctcctcaccctcctcactcagggcacgagggtcctgggcccagtctcgccctgactcacgccctccctccgccgttccgggtctccgtggacagtcagtccgccatcctcctgccacgtacggaacccaggccgtggtaccggttgggttaggttaataagttatcgttcctccgtacggtaacccaacacgacccaacccgaggaaccaaaacccgaccccctaaacttcgttagtaattttagacggtacggtcacgtggacggtcccggtcccgtcggtaccgggttccctaggtacgttctccgttccgtccgtggtcctacgtacgtctacgaactaccgcccgtcctaccgcgtaccgtcgtcgtcgcctcgagctagacgtagtgggtatcgtattaatttacttacgtcgtacgttagtacgaaggtaccggaactaaccaaacctacttaacttccgttacggttacgggtacgggaacgaaccgggtaacctaaggtacctaccggttaaaccgtacgtaacgtcgaacccggtaccgtacgtaccccgtcccgtaccccggtacgtaccttaacccgttccgtttacccgtccccgtacccg

SEQ ID NO: 235081 - DNA, 759 bp, Homo sapiens
  misc_feature: GYAE6OF01DJJ12.33.19.B08.1.454.CMB.1.raw
  modified_base (502)..(502): a, c, t, g, unknown or other
  misc_feature (502)..(502): n is a, c, g, or t
tcagtacacacactcacgaccggtgctcgatttagtgagtcagtaagtggaaagggggggggtctcaggaggcagcgctctcaggacgtcaccaccatggcctgggctctgctcctcctcaccctcctcactcgagggcacagggtcctcgggccatctcgccctgactcacgccctccctcgccggtcgggtctcgtggacagtcacggtcgccatcctcgtcgcacgtcggaaaccgtacggccggttagtaccgggtttagggttacggttaaagttaaaggtacttggtcctaccgttacggtaaacccaacgacgacccaacccggtaacggaaccaaaacccgacccccctaaattcgttacgttaatttaacgtcggtacggttaccgactaggggaccggtccgtaccccggttacgggaaccgggtttccaggtacctcgtacttctcgtacggtctaccgtacgtacgcgtaaaccgacgacccggttaccncccgtagtaacctcgtcgtcgggtcgaccgtacggtacgtcgtaggacggtagtcgtacgtgttacgtagtttagtacacgtagtcgtcgttaagaccgttggaaccggtcgaacggtaacggtaacggttaaggttacgggttcgggtacgggacgggtaaaccgggtacgacggttcgaaccggtaccgttacggaaccggtcgaacccgtacggacccgtccgtaaccccggtcgtaccgtcctacgtcccccg

SEQ ID NO: 235082 - DNA, 570 bp, Homo sapiens
  misc_feature: GYAE6OF02IKNLL.33.19.B08.1.454.CMB.1.raw
  modified_base (232)..(232): a, c, t, g, unknown or other
  misc_feature (232)..(232): n is a, c, g, or t
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
  modified_base (353)..(353): a, c, t, g, unknown or other
  misc_feature (353)..(353): n is a, c, g, or t
  modified_base (366)..(366): a, c, t, g, unknown or other
  misc_feature (366)..(366): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
  modified_base (420)..(420): a, c, t, g, unknown or other
  misc_feature (420)..(420): n is a, c, g, or t
tcagtacacacactcacgaccggtgctcgatttagtgagtcagtaaagggaaaggggggggggtctcaggaggcagcgctctcaggacgtcaccaccatggcctggctctgctcctcctcaccctcctcactcagggcacgagggtcctgggcccagtctcgccctgactcagccctccctccgcgtccggtctccgtggacagtcagtcgccatctcctgcactggaaccngccgtgacgttggtgttataagtatgtctctgtacaacngcaccagacaaacgccccaaatctagtatttangaggtcatgagccgcctgacgggtcctgctcgtcttctctgctcagtcngacacgcgcctcngacatctcgtggctcgagctgagntgagntgtattagtactgactgtctcgtancgcgaggacgtacaacgttaaggtttagggtcggttcgggacggtaacgggaccgtaagggtcgtaccggttacgtaacggtccgaaccggtacccgaaggtcccgaccgtcccccggttaggtccctaccgttccttcccggtcccccg

SEQ ID NO: 235083 - DNA, 729 bp, Homo sapiens
  misc_feature: GYAE6OF01CFGYW.17.12.B01.1.454.CMB.1.raw
  modified_base (283)..(283): a, c, t, g, unknown or other
  misc_feature (283)..(283): n is a, c, g, or t
  modified_base (322)..(322): a, c, t, g, unknown or other
  misc_feature (322)..(322): n is a, c, g, or t
tcagcgtagactagcacgaccggtgctcgatttagtagtgtagatttagggttgggagtcggagtctcagtcaggacacagcgatggacatgagggtccccgcgtcagctcctgggctcctgctactctggctccgagctgccagagtcgtgacatccagatgaccagtctccatcctcctgtctcgcctctgtggggtctagacgtcaccatcacttggaccgacaagtcacggtacgttaaaactatttaaattggtatcagcaacgaaactcggaaaacncccagacctcctagactctctggtcgacactccactcgngacggtaagtcgccgtccagttcgacggttcaaggtcggacgtaggtcggaactcggtacgggactaacggttacttaccaattccgtcctaacctacttaccctaacccgtaccttacgtaccggaacccgtaaacccgtcgggttaaaggtaacttttcgggtaacgttaccgtaaaacgttttcccttaacctaacgtttacggtacctaaaacgtaccggttaacgtttaaccctaccgggttttacccccgtacggttcgttttaaccgggtttcggggaacccggtaaacggggggtaaccctaaaaggtttacggtaacggtaaacgttaccgaaaaccggtccgttagggtccgacccgttacgggaccttaaccctagtttcccgttacgtttccccg

SEQ ID NO: 235084 - DNA, 615 bp, Homo sapiens
  misc_feature: GYAE6OF01BRUSD.17.12.B01.1.454.CMB.1.raw
  modified_base (319)..(319): a, c, t, g, unknown or other
  misc_feature (319)..(319): n is a, c, g, or t
  modified_base (364)..(364): a, c, t, g, unknown or other
  misc_feature (364)..(364): n is a, c, g, or t
  modified_base (604)..(604): a, c, t, g, unknown or other
  misc_feature (604)..(604): n is a, c, g, or t
tcagcgtagactagcacgaccggtgctcgatttagtagtgtagatttgggtttagggagtcagtctcagtcaggaccacagcatggacatgagggtccccgcgtcaggctccgtggggctcctgctactctggctccgagctgccagatgtgacatccagatcgacccagtcctccactccctccctgtctcgcccttgtgggtgggggtacaggactcaccatctacttcggacccggaactaacgtcaacgggtaacctttaaaaaccttaattttaaagttggtactacgagacaaacgaaaccgtaggaaaaccncccaagaccctcctagacttctcgtggtcactactcctacttcgngacgtaagtcgaccgtcctagtcggtaggttcgaggtcggataggtggtactcggtagggaactaggtactttacaacttcaccactactccacctactcacacctaacgtggagtattgacatacttactactactgtaacaacgtagtacgttactacgttcccctgtacttacgttcgaccgtaacgggaactaagtagacgactaaccgaaagtcgtcgtagactcgacctacctnttcgtcttacg

SEQ ID NO: 235085 - DNA, 545 bp, Homo sapiens
  misc_feature: GYAE6OF01B2VF2.17.12.B01.1.454.CMB.1.raw
  modified_base (280)..(280): a, c, t, g, unknown or other
  misc_feature (280)..(280): n is a, c, g, or t
  modified_base (497)..(497): a, c, t, g, unknown or other
  misc_feature (497)..(497): n is a, c, g, or t
tcagcgtagactagcacgaccggtgctcgatttagtagtgtagatttgggtttagggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatggggcaaccctaacactggtgtcacagtgtcttcacccatcccgtccgggacagacttaccatcgaccacgaacctcctacaactaaacacagcctaacatggagttggaggtacgcctgacactctgaacgacgacgggtccgttctattacgtgtcgcgagacgtcccagactcgggngacgcccgtacggcgacggcggtcctttcggccgttcggtaccggggg

SEQ ID NO: 235086 - DNA, 695 bp, Homo sapiens
  misc_feature: GYAE6OF01DD6BB.17.12.B01.1.454.CMB.1.raw
  modified_base (214)..(214): a, c, t, g, unknown or other
  misc_feature (214)..(214): n is a, c, g, or t
  modified_base (485)..(485): a, c, t, g, unknown or other
  misc_feature (485)..(485): n is a, c, g, or t
tcagcgtagactagcacgaccggtgctcgatttagtagtgtagatttgggtttgtggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgnggggcctcagtgaaggtctcctgcaaggcttcgtggtactttcctaaccgttttaccctccttaatagttaactaccgtaacgtgggtcgccgccgacgggcccgtcgtacgggaaccaaccggtaccgtagggaggtacgggagttggggacgtacgggacccaaacccgtaacgacgtcggtcgtaccgaacgtcggtcttaccttaccgaacccacttccccgggtaccgggacacgtaccttaaccgagtacgaacccacgtaaccncctaacaaactaaaccacacaccttaacgagtaggagttggacgacggtcctaggacctagttacccgaggaccccgaacgtccgggtaccttacttacgtttcacggtcgacggtacggtaccgccccgtacggacgttccgggacgtaccggtaacccgtaccgggcccttagggccccgggtttacttacggtccggttaccggggg

SEQ ID NO: 235087 - DNA, 870 bp, Homo sapiens
  misc_feature: GYAE6OF01BLWSU.17.12.B01.1.454.CMB.1.raw
tcagcgtagactagcacgaccggtgctcgatttagtagtgtagatttaggggtttagggggactcaacaacccgacccagtctgtccgtctagaggaaaaccctggtggagcacagctccttcaccatggacttggacctggagactcctcttcttggtggccagcagtcctaactaagtcgccctacgtcccaggtgtcgacgcctagggtcgacgaggtcgtggggcttggaggtacgaagaagaccgtggggacctcgaggtagaaggtctacctgacgaggtcttacgtggtattcgacggtttacctcttactacgtataccaacgtgggtacgaccgacccgacgggtacccgtacgtacgggaaacctaaccggtacccttagggtaggtacgggaacgttggggaacgttacggggaacccgtaaaaccccgtaaacgaccgttacgggtacgtaccgtaacgtcggttacggtttacccttaccgaaccccgtagtttccccggaccggggaacctaacgggtaacccgtttaaccgagttaccggtaaacccgtaaccgtaaacccgttcccgtaaccgtaaccgttaaaccctaccgtaaccgtaccctaaacgtacgtagggtaacgttcgggaacggtacgtaccggtaaggtaacccgtacgttacccggtaccggaacccggtaacccgtacccggggtcccctttacgttaacccttaccggtacggtaccgtaccggaaacggttccccgtaccccgtaccggtaccgttaccccggaccggtaccgaaccccggttacggaccgtaccgggtcccgttacccgtttacggacccgtttcccggggaccgggg

SEQ ID NO: 235088 - DNA, 888 bp, Homo sapiens
  misc_feature: GYAE6OF01AI7KN.17.12.B01.1.454.CMB.1.raw
tcagcgtagactagcacgaccggtgctcgatttagtagtgtagattgggtttaggggactccaacaacctacagtcctgtcctctagagtaaaaccctgtgagcactagcctccgtcaccatggactcggacctcggagggactccctcgttcttcggtggctacgcaggctacaagtcgacccacgtcccaggtgcagcctggtgcgtagtcgtggggctggagggtcgaaggaacgccgtcggggtcctcgtagtcgaacggtcctccgtgaccgaaggtccttcgtggtacttcgaaccgttttaccttccgtatacggtatactaacgtgggtcgcgccgaacggtcccgtcgttcgggaacctaaccggtaccgttcgggtacggttacgggaacggttacgggggtaacgttcgggggaaacccgtaaaaccccgtaaacgtaaccggttgggtacgtccgtaacgtacggttcgttccgttacccgaacccgttaccgttcccggttacccggggtaacctaccggtaaccctttaccagttaccgaaccctaaccggtaacccttcccgtaacctaacgttaaacccgacgtaccgtacccgtaaaccgtaggtacgggttaacggtttacggaacggggtaccctaccggtacgtaaccgtacgttacccgtacggaacccggtaacccgtaccggggttcccttaacgtttaacgtttaccgtacggttccgaaccggtacggtaccccgttacccgaaccgggttaccgtaccccggggttacgaacccggttacccccgggtaaccgggaccgtaacccgggttccccgggttaccgttttaccggtaacccgggtttcccgggtaacccgggggg

SEQ ID NO: 235089 - DNA, 867 bp, Homo sapiens
  misc_feature: GYAE6OF01B1Z5Z.17.12.B01.1.454.CMB.1.raw
  modified_base (401)..(401): a, c, t, g, unknown or other
  misc_feature (401)..(401): n is a, c, g, or t
tcagcgtagactagcacgaccggtgctcgatttagtagtgtagatttagggtttgggggactcaacaaccacatctgtcctctagacgtaaaaccctgtgagacacagctacctcacctagtggtactcggtacctgggaggtatcctcttacttggtcggcagcgagctacgaacgtcgcccactccgaggtgcgaggtccgtgggtagccgtaggttccgtgggggtccttcggaacgggttagaaacggtaacggtcccggttgggggacccttacgtaggttacgtaacgggtttcctccgttcgaccgtaacgggtcctttacgtcggtacttccgtaccggtttaccgttacgtacgttacgtacgtacgaacggttggcgtacgcgacggccgngtacggactacggtaccgtggaggtcggtagtcgggtaacgtccgggtaacctaaacccgttaagaccggttcggtctaccgaacggtaggtccgttacctacctaaccgtacgttcccggtaccgggtaacacgttaccttacgtagtaccgtaacccgaacgtacccgtacccgtaacctaaacgtaaacctacccgaacgtacccgtatacggttagggtaacggttaggaacgggtactaccgtacgtacgtacgtctaacggaaccggtaccggtacccggtccggttacttacggttaccgttaggtaccgttaccggtacggtacccgttacccgtaaccggtacccggttacccggtaaccgggtacccgtacccgggttaccgggttacccgtacccgggtttacccccggggttacccgtttcgggttaacccgttcccgggggtaaccccggggg

SEQ ID NO: 235090 - DNA, 683 bp, Homo sapiens
  misc_feature: GYAE6OF01CKYOS.17.12.B01.1.454.CMB.1.raw
  modified_base (292)..(292): a, c, t, g, unknown or other
  misc_feature (292)..(292): n is a, c, g, or t
  modified_base (306)..(306): a, c, t, g, unknown or other
  misc_feature (306)..(306): n is a, c, g, or t
  modified_base (512)..(512): a, c, t, g, unknown or other
  misc_feature (512)..(512): n is a, c, g, or t
  modified_base (528)..(528): a, c, t, g, unknown or other
  misc_feature (528)..(528): n is a, c, g, or t
tcagcgtagactagcacgaccggtgctcgatttagtagtgtagatttgtgtttgggactcaacaaccacatctgtcctctagagaaaaccctgtgagcacagctcctcaccatggactggacctggaggatcctcttcttggtggcagcagctacaagtgcccactcccgaggtgcagctggtgcagtcgtggggctgaggtgaagagccgtggggcctcgagtgaacggtctcctgcaaggcttacgtggtattcgacgttttacctccgttatacgtatcgaactgggtnccgtccaggcccgntacggacaacgctgagtggatgggactgggacccaaaccgtaacacgttcggtacgtacctacgtaggttcgttacctttacccgaaccctacgttcccgtacccggggaacctacggtaccctttaaccgacttacgacccaacgtaaccctacctaaccgtaactaaacactacgacctaacagtacggtagttaggaacggtnacccgttgaaaccgtntaccgtaaggacccggaccgtacccggttaccgttccttaagtttccgtcggtcgacggtacgaccttacccgaacggttcctaccgggtcgaccggttaccccgtacgggcctacgggtaccccgggttttcctcggttaacccgttcccgggg

SEQ ID NO: 235091 - DNA, 911 bp, Homo sapiens
  misc_feature: GYAE6OF01BSBYC.17.12.B01.1.454.CMB.1.raw
tcagcgtagactagcacgaccggtgctcgatttagtagtgtagatttgggcttggggactcaacaaccacatctgtcctctagagaaaaccctgtgagcacagctcctcaccagtggactggacctggaggatcctcttcgttggtggcagcagctacaagtcgcccactcccgaggtcgcgagcgtgggtgacgagtcgtggggctaggagggtagaaggaacggtccgtggggcccttacgaggttacggtaacggttccttccgtaggacgtaacggtcgtttacgtggtaccttttaccgttaacccggtttttacccttacccgttaattaacggttacttaaccgtaacggttcggggtacgacccggtacccgacggggtcccgtaccggtaaccgggaacccgtaaaccggtaccggtagggtaacgggttacggggaaggttacgggggtaacggttaaccggggtaaaccccgtaaaaccccggttaaccgtacgggttacgggtacgtaccgttaaccgaggtttacccgtttaccgttacccccgtaacccgtacgttaccccgggtaccgggaaaccctaccggttaacccttaaccgtacgttaaccggaaaccccgttaaccgtacccctttaccgaaacccctaaaggtaaaccccctacggtaaacccgtaccttaacggtacggttaggggttaaccggtgggaaccggtaccgtacttacggaactgttaacccgacggaccgacccgtcccgggttacttaactttacgtacgttcgtacggacgtacgtaaccccgtccgaaaccggttccggtaccgggtacgacccgttaccccggtcggtccggacccggttacccggtttccgtttacgggccgggtttaccgggg

SEQ ID NO: 235092 - DNA, 762 bp, Homo sapiens
  misc_feature: GYAE6OF01ELC4H.17.12.B01.1.454.CMB.1.raw
  modified_base (175)..(175): a, c, t, g, unknown or other
  misc_feature (175)..(175): n is a, c, g, or t
tcagcgtagactagcacgaccggtgctcgatttagtagtgtagatttggggtttaggggactcaacaaccacatctgtcctctagagaaaaccctgtgagcacagctcctcaccatggactggacctggaggatcctcttcttggtggcagcagctacagtgcccactccaggtncagctggtgcagtcgtggggctggaggtgaagaagccgtggggcctcgaggtgaacggtcctcctagcgaaggtctttcgtggtactttcgtaccgttttaccctccttaatagttactaccgtaaacgttggggttcgccgtaccgacggggcccgtcgtacggggaaccaaaccggtacctgggaaggtgggaggttggggacgttcgggggaacctaaaccccgttaacgacgttacgggttccgtaccgaacgtcggtttcgttacccttccaaccccgtacgttccccggtccggggaacctacggttaaccttaccacgttcgaaccctaccgtaccttaccctacaaattaaacccacgacgtaccctacgagttacggggtagttacggaacggtacgcccgtagaaccttgtacggtacgaacccgtaaccggtacccgggtaccgtttacttacgtttaacggtcggtacggtacggacggtccctacccgacggttaccgtccgggtacggaaccgaccggtacgggaccacggggttcccgttacgttttaccgaccggtttccgggaccggggg

SEQ ID NO: 235093 - DNA, 568 bp, Homo sapiens
  misc_feature: GYAE6OF02G27RX.17.12.B01.1.454.CMB.1.raw
  modified_base (430)..(430): a, c, t, g, unknown or other
  misc_feature (430)..(430): n is a, c, g, or t
tcagcgtagactagcacgaccggtgctcgatttagtagtgtagatttaggggtttaggggggagtcgacgtctcagttcaggtaccaccacgcatggacatgagggtccccgcgtcaggctaccgtgggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaacgccccagacctcctgatctctggtgcatccactctgcgaagtggcgtccatcgagttcagtgcagtggatcgtgggacagatttcaatctacaccatcaccactctgacacctgagtatgtgacatctactactgtacaanagtagttactacgttcccctcgtctacttttcggaccgtacggggtaaccctaaggttacgaacggtaactaaccgtaaaccggtaacgttacggtaggtacgttacggacctaacctacgttaccttaggtttaccc

SEQ ID NO: 235094 - DNA, 518 bp, Homo sapiens
  misc_feature: GYAE6OF02GW2LK.17.12.B01.1.454.CMB.1.raw
tcagcgtagactagcacgaccggtgctcgatttagtagtgtagatttaggggtttaggggggagtcgacgtctcagttcaggtaccaccacgcatggacatgagggtccccgcgtcaggctaccgtggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatcgtgggacagatttcaatctcacatcaccactctgcaacctgagattgtgcaatctactactgtacaacagtagttacacgtttcccctcgtcctacgttttcggaccgagggaccaagttgagatacaaacgaactgtgctgccaccatctgtcc

SEQ ID NO: 235095 - DNA, 652 bp, Homo sapiens
  misc_feature: GYAE6OF02I11GN.17.12.B01.1.454.CMB.1.raw
  modified_base (329)..(329): a, c, t, g, unknown or other
  misc_feature (329)..(329): n is a, c, g, or t
  modified_base (376)..(376): a, c, t, g, unknown or other
  misc_feature (376)..(376): n is a, c, g, or t
  modified_base (390)..(390): a, c, t, g, unknown or other
  misc_feature (390)..(390): n is a, c, g, or t
tcagcgtagactagcacgaccggtgctcgatttagtagtgtagatttgggtttaggggggagtcaaggtcctaacagtccaggacgacagccatggacatgagggtccccgctccagctcctggggcctccgtgctactccttggctccggaactgccagatggtgaccatcccagatgacccagtctccagtcctccctgtctgcctcgtggtgggggtcagagtcacgatcacttgaccggacagtcgacggcgttaaaacctatttaaattggtatcagcaagtaaaccgtggaaaacgcccccaggacccctcgtagaattcctntgggtgcgtagtcccgactctggcgaagtcggcgtccatcgagttcngtgcaggtgatcgngggacagtattcaactctacaccataccaccactctacgaccaaccgtgaggtattcgtcgtactaattcctaacttacgtagtacctaacgtaggtaacgttacctacgtttccccgtacgtaccgttacgttttccggacccggttaaagggtaacccgttaggttacggaacggtaacgttaaccggaaaaccggtacgttcggtaccgggtcgttacggtaccgtacccgtagttccgttacggttcccgtttaaccg

SEQ ID NO: 235096 - DNA, 786 bp, Homo sapiens
  misc_feature: GYAE6OF02IBC10.17.12.B01.1.454.CMB.1.raw
  modified_base (208)..(208): a, c, t, g, unknown or other
  misc_feature (208)..(208): n is a, c, g, or t
  modified_base (218)..(218): a, c, t, g, unknown or other
  misc_feature (218)..(218): n is a, c, g, or t
tcagcgtagactagcacgaccggtgctcgattttagtagtgtagatttggtttcggggacggtcaacaaccaacagtctgtcctcgtagagaaaaccctagtgaggctacagctccctcgacctatggttaccttggtaccgttggaggtacttccgtctttctttcggttgggcacgcggagcttacgagtgcccacctccaggtcncagcctggtncagtcgtgggcgtgaggtggaacgaacgccttggggaccttcgaggttgaacggtcgtcctggctaaggtttccttcctaggtaacgtttactaaccgttttaccttaccttattacggttaactcaaccgtgggtagccgaccgaggccgccttcggacaaccgtacctgtagtttggaggtcgggacgttcggggacgtaaccccggtaacacgtcggtgttcacgtagtcgtccgttccgacccgtagtccgtacgggactacgtaccttaccactacgtaacccacgaaccttccctaacctaactaaaccgaccgtaacgccccgttaagaacgtttggacggtttcggaacgggttacgttacccttaggacctaattccgaggaaaccgtacgtaaccggtcccgttaacttaacttttaccgtgtttaacgccgggttaacggaccggtttacccggaacggttacggttacccgggtacggtaaccgtaccccgttaaacgggtacctacgggttacccgggttaccgtttttacgaaccccgtttcggtaaccggggg

SEQ ID NO: 235097 - DNA, 803 bp, Homo sapiens
  misc_feature: GYAE6OF02H7U1Q.17.12.B01.1.454.CMB.1.raw
  modified_base (289)..(289): a, c, t, g, unknown or other
  misc_feature (289)..(289): n is a, c, g, or t
tcagcgtagactagcacgaccggtgctcgatttagtagtgtagatttagggtttagggggactcaacaaccacatctcgtccctcctagagaaaaccctgtgagcacaggctccgtcaccgagtggactggacctggaggatcctcttcttggtggcagcagctacaagtgcccactcccaggtgcagctggtgcagtctggggctgaggtgaagaagctggggcctcagtgaaggtctcctgcaggcttctggatttcacgtttacctcctatagtatcaactgggtncgccaggccgctggacacgcctgagtggatgggagtgggaccgaaccctaacgacgtggtcgtcacgagtcgtcttccaaccctagtcccgtccggggacaaggtaccttaacccatacgaacccaccgtaacctcccgtaccaaacgttaaaaccaactaacgccctaactacgttacgggtaacggtttacggaagggtacgtacccttagggaaacctaacgttacccggttacggaaacccgggtaacccgaacccgggggtaacccgttttaccgttaaaacgtttttaacccgttagggttaccggaccggggttaaacggtacccgggtttaacccccccggaaacgggttacccgggtttaccccggggttacgggtaaaacccccgggttacccggttaaaccccggggggacccggtaaacccgggggtttcccccggggttacccccggtttttttacgggtaaccccccgggtttttttccggtaacccccggggggggggg

SEQ ID NO: 235098 - DNA, 538 bp, Homo sapiens
  misc_feature: GYAE6OF02IF004.17.12.B01.1.454.CMB.1.raw
  modified_base (331)..(331): a, c, t, g, unknown or other
  misc_feature (331)..(331): n is a, c, g, or t
  modified_base (424)..(424): a, c, t, g, unknown or other
  misc_feature (424)..(424): n is a, c, g, or t
tcagcgtagactagcacgaccggtgctcgatttagtagtgtagatttgggtttgtggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaanactggtgtcacagtgtcttcacccatcctcgggacagacttaccatgaccacgaacctcctaccataaacacacgcctacatggagttgaggngctgacatcagacgacacggccgtcttactactgtcgcgagtacgtcccaacggtactccggtagacgtacccgtacgggtccacggtccggtcccgttttaggaccgttcggg

SEQ ID NO: 235099 - DNA, 650 bp, Homo sapiens
  misc_feature: GYAE6OF02F8MH3.17.12.B01.1.454.CMB.1.raw
tcagcgtagactagcacgaccggtgctcgattttagtagtgtagatttagggtttagggggactcaacaaccacattctcgtcctcgtaagagaaaaccctgtcgagcacagctcctcaccatggactggacctggaggactcctcttcttggtggcaagcagctacaagtcgcccactcccaggtcgcagctggtgcgaggtactgggctcgaggtgaagaagccgtgggcctcgagtgaaggtctcctgcaaggtcttctggacttcgacgtttacctacttatagtactcgaacctgggtgccgtcccaggcccgtcgtggaaccgaaccgacctggaacggtcggaagtcggggatcggggtaccaaacccctaacgacgttgggtcgtacacgtagtcgttcgttcacccgtatccgtccgggacacgtaccttaccgatcgaccacgaacctccgtaccataaaccacgtacgaccctaactacgttaggacgtttagaacggtactcctgaacctagttcgtagaaccgtacgtaccggtccgttacttacgttaccgtcggtacgtcgacgtacgtcccgaagtacgttaccggtacgtcgtacccgtggcgacgtccggtcctttgtaccttcggtacggg

SEQ ID NO: 235100 - DNA, 675 bp, Homo sapiens
  misc_feature: GYAE6OF02FVV2N.17.12.B01.1.454.CMB.1.raw
tcagcgtagactagcacgaccggtgctcgattttagtagtgtagatttagggtttggggactcggaacaaccacatcctgtcctcgtagagaaaacccttgtgacgcacacgctcctcaccatcggacttcggtacctggagggacttcctccttacttggttggcctaggacgagcctacgaacgtgcccactcccgaggtgccagctggtcgcagtctgggctgagtgaagagcgtgggtcctcagtgaacggtctcctgacgtaaggcttcgtggactttcgacgtttacctccgtactagtactcgaacgtgggtcgtcgccaaggcccgtacttcgggacaaccggtaccgttgacggttagggacgtggggaacttcggggaccgtaaccccttaacgacgttgggtacgtaccactacggtcgtacctttaccaccccgtagtccctaccgggaacaacggtaccgtttaccactacgaaccacggtaactccctacactaaacactacgccgtaacacgagagttacgagtacgtcctaggacactctacgacgtacgaccggccgtacgttaactacgtagtacgagagtacgtcctacggtacgtaccggtaggtactaccggtacgacgtacgtcccggtcctttcgaccgttccggtaccggg

SEQ ID NO: 235101 - DNA, 770 bp, Homo sapiens
  misc_feature: GYAE6OF02FKEX6.17.12.B01.1.454.CMB.1.raw
  modified_base (194)..(194): a, c, t, g, unknown or other
  misc_feature (194)..(194): n is a, c, g, or t
  modified_base (678)..(678): a, c, t, g, unknown or other
  misc_feature (678)..(678): n is a, c, g, or t
tcagcgtagactagcacgaccggtgctcgatttagtagtgtagatttagggtttggggacgtcaacaaccacgatctgtcctctagagaaaaccctgtgagcacagctcctcaccatggactggacctggaggatcctcttcttggtggcagccagctaccaagtcgcccactcccaggtgccagcctgggtcncagttctggggctgaggtacgaagaaacggccgtcggggtccgtcagtgtaaggtccgtcctcggtgaacggtacgttctgggtacttaccgtaccgttacccttcgtactagtacgttcaaccgtgggtcggccacccggtacggaccggtcctacggtaccgaaccgtaacccgtggacggtacggtagttcgggagttacggggaccgtaaaccccgtaaccaaccgtgggtgttccaaaccgtaggttggttaccctttacccgaacccctacggtaccccgttacccgggggaacctaaaccggttaaccttaaccccttaacgacccggtaacccgtaaacccgtaaccctaccccgtaacccttaaacgaaaacccttaaccgaacgtacccttaaccgagttacggtaaggttcggaggtaccggaccgtgaactacgtctacggaacgaccgaccggtccgttactacgtttacncgtaggcgaggtaccgaccgaccgtacgtccggtacggaccgccggtacccggagtaccggccggtaccctttggtaccgttcgggtacggg

SEQ ID NO: 235102 - DNA, 793 bp, Homo sapiens
  misc_feature: GYAE6OF02ILRNS.17.12.B01.1.454.CMB.1.raw
tcagcgtagactagcacgaccggtgctcgatttagtagtgtagatttgggtttgtggactcaacaaccacatctgtcctctagagaaaaccctgtgagcacagctcctcaccatggactggacctggaggatcctcttcttggtggcagcagctacaagtgcccactcccaggtgcagctggtcgcagtcgtggggctgaggtgaagaagccgtgggcctcgagtgaaggtctctgcaggcttctggacttcacgtttacctcctattagtactcaacgttgggtacgccgacccgaggcccgtgtacgggaaccaacggtacctggaaggtgggagtcggggtagttaccggggaaccgtaaaccccttaacggaccgttggggttacgtacgtaaccggtaggttccgttaccgttttacccaaccccgtacgttccccggtacccggggaaactaaccgggtaaccctttaaccgacttaccgaacccgtaaaccggtaaacccttcccccgttaacccaaataaaacccgtaaccgaaccgtaccccgttaagtagtacggggtacgtttacgggaacgggttaccgaccgttacggaaccttacggtcccttaggaacccggaaccgttacccgggaccgttttcttaaacgtttaccgtaggttaaccgaccggtacggtaccgtcccccggtaacggtacccggttaccgggtgtaacccggtcccgggtaaccggtccggtaacggttccccgggttacttttcccggtaccggtttccccgggg

SEQ ID NO: 235103 - DNA, 540 bp, Homo sapiens
  misc_feature: GYAE6OF01CAULS.37.61.F06.1.454.CMB.1.raw
tcagtagtgtagatcacgaccggtgctcgatttagctacgctctaagggaaagggaagactgacggtccccaggagttcaggtgctgggcacggtgggcatgtgtgagttttgtcacaagatttgggctcaactctcctgtgcagcctctggattcacctttaatacctattggatgagttgggtccgccaggttccagggaaggggctggagtgggtggccaacataaagcaagatggaagtgagaaatactatgtggactctgtgaagggccgattcaccatctccagagacaacgcccagaactcattgtatctgcaaatgaacagactgagagccgaggacacggctgtgtattactgtgcgagagaggaggcgattagtgtaatggctgggccttctactactactactacatggacgtctgggcaagggaccacggtcaccgtctcctcacgcctccaccaacggcccatccggtccttcccccgtcggccaccctccctcccaacgacgccacctcgtcgggggccacgacgg

SEQ ID NO: 235104 - DNA, 539 bp, Homo sapiens
  misc_feature: GYAE6OF01EBL12.37.61.F06.1.454.CMB.1.raw
tcagtagtgtagatcacgaccggtgctcgatttagctacgctctaagggaaaggggaagactgacggtcccccaggagttcaggtgctgggcacggtgggcatgtgtgagttttgtcacaagatttgggctcaactctcctgtgcagcctctggattcacctttaatacctattggatgagttgggtccgccaggttccagggaaggggctggagtgggtggccaacataaagcaagatggaagtgagaaatactatgtggactctgtgaaggccgattcaccatctcagagacaacgcccagaactcattgtatctgcaaatgaacagactgagagccgaggacacggctgtgtattactgtgcgagagaggagcgattagtgtaaatggctgggccttctactactactactacatggacgtctggggcaaagggaccacggtcaccgtctcctcacgcctccaccaacggcccactccggtccttcccccgtcggccaccctcctacccaagacgcacctcgtcggggcacgacgg

SEQ ID NO: 235105 - DNA, 545 bp, Homo sapiens
  misc_feature: GYAE6OF01EOS3Q.37.61.F06.1.454.CMB.1.raw
tcagtagtgtagatcacgaccggtgctcgatttagctacgctctaagggaaaggggaagactgacggtcccccaggagttcaggtgctgggcacggtgggcatgtgtgagttttgtcacaagatttgggctcaactctcctgtgcagcctctggattcacctttaatacctattggatgagttgggtccgccaggttccaggaaaggggctggagtgggtggccaacataaagcaagatggaagtgagaaatactatgtggactctgtgaagggccgattcaccatctccagagacaacgccccagaactcattgtatctgcaaatgaacagactgagagccgaggacacggctgtgtattactgtgcgagagaggaggcgattagtgtaaatggctgggccttctactactactactacatggacgtctgggcaagggaccacggtcaccgtctcctcacgcctccaccaacggcccactccggtccttcccccgtcggccacccctccctcccaacgacgccaccctcgtcggggcacgacgg

SEQ ID NO: 235106 - DNA, 651 bp, Homo sapiens
  misc_feature: GYAE6OF01CLPXU.37.61.F06.1.454.CMB.1.raw
  modified_base (301)..(301): a, c, t, g, unknown or other
  misc_feature (301)..(301): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (311)..(312): a, c, t, g, unknown or other
  misc_feature (311)..(312): n is a, c, g, or t
  modified_base (314)..(315): a, c, t, g, unknown or other
  misc_feature (314)..(315): n is a, c, g, or t
  modified_base (317)..(317): a, c, t, g, unknown or other
  misc_feature (317)..(317): n is a, c, g, or t
  modified_base (320)..(321): a, c, t, g, unknown or other
  misc_feature (320)..(321): n is a, c, g, or t
  modified_base (323)..(323): a, c, t, g, unknown or other
  misc_feature (323)..(323): n is a, c, g, or t
  modified_base (328)..(328): a, c, t, g, unknown or other
  misc_feature (328)..(328): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccaggggaaggggctggagtgggtggccaacataaagcaagatggaagtgagaaatactatgtggactctgtgaagggccgattcaccatctcaagacacacncanacncatnntnnanaannanagacngagcgacgagacgacgctgtattactacgtggtcgacgagaggagggaggacgtaagttagtaagtaagtggtcggtcggtccttacgtaacttactaactactactagtacggtacgtcgggtacgggaacggaacgggacccgtacggtacccgtacccgttccctacccgtcgacccgtaccctacccgaacccggaccgggacccctacggttccccggttccccttccccccggtcggtaccccctacccccgttcccctaaccgaacgaccgtacccgtacccgttccggggtaccggggaccaccggtacccgggg

SEQ ID NO: 235107 - DNA, 541 bp, Homo sapiens
  misc_feature: GYAE6OF01BTQDQ.37.61.F06.1.454.CMB.1.raw
  modified_base (366)..(366): a, c, t, g, unknown or other
  misc_feature (366)..(366): n is a, c, g, or t
  modified_base (535)..(535): a, c, t, g, unknown or other
  misc_feature (535)..(535): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagattttgggctcaactctcctgtgcagcctctggattcacctttaatacctattggatgagttgggtccgccaggttccagggaaggggctggagtgggtggccaacataaagcaagatgggaagtgagaaatactatgtggactctgtgaaggccgattcaccatctccagagacaacgcccagaactcattgtatctgacaaatgaacagactgagagccgaggacacggctgtgtattacngtgcgagagaggagcgattagtagtaagtggcgtggtccttctactactactactacatggacgtcgtgggcaagggaccgacggtccaccgtctcctcacgcctccaccgacggccctacgtccgtcctccccgtcgccaccctcctccacgacgcacctcgcgggcncgacgg

SEQ ID NO: 235108 - DNA, 565 bp, Homo sapiens
  misc_feature: GYAE6OF01CG9SF.37.61.F06.1.454.CMB.1.raw
tcagtagtgtagatcacgaccggtgctcgatttagctacgctctaagggaaaggggaagactgacggtcccccaggagttcaggtgctgggcacggtgggcatgtgtgagttttgtcacaagatttgggctcaactctcctgtgcagcctctggattcacctttaatacctattggatgagttgggtccgccaggttccaggggaaggggctggagtgggtggccaacataaaagcaaagatggaagtgaagaaatactatgtggactctgtgaagggccgattcaccatctccagagacaacgcccagaactcattgatctgcaaatgaacagactgagagccgaggacacggctgtgtattactgtgcgagagaggaggcgattagtagtaaagtggcgtgggtccttctactactactactacatggacgtcgtggggacaagggaccacggtccaccgtcctcctcacgccctccaccgaacgggcccagtccgtaccttcccccgtcggtcccacccctccctacccgaagacgaccaccctcgtcggggccacgaccgg

SEQ ID NO: 235109 - DNA, 586 bp, Homo sapiens
  misc_feature: GYAE6OF01BGZXL.37.61.F06.1.454.CMB.1.raw
tcagtagtgtagatcacgaccggtgctcgatttagctacgctctaagggaaaggggaagactgacggtccccccaggagttcaggtgctgggcacggtgggcatgtgtgagttttgtcacaagattttgggctcaactctcctgtgcagcctctggattcacctttaatacctattggatgagttgggtccgccaggttccaggggaaggggctggagtgggtggccaacataaagcaagatggaagtgagaaatactatgtggactctgtgaagggccgattcaccatctccagagacaacgcccagaactcattgtatctgacaaatgaacagactgagagccgaggacacggctgtgtattactgtgcgagagaggaggcgtagttagtagtaagtggcgtgggtccttctaactactactactacagtggacgtcgtgggacgaacgggaccgacggtccaccgtcctcctcacgcctcccaccgaacggcccacgttccggtcccttcccccgtcggccctacccctcccgtacccaacggaccgtacccgacccgttccggtcggggccaccggaccggg

SEQ ID NO: 235110 - DNA, 572 bp, Homo sapiens
  misc_feature: GYAE6OF01CAZ0S.37.61.F06.1.454.CMB.1.raw
  modified_base (224)..(224): a, c, t, g, unknown or other
  misc_feature (224)..(224): n is a, c, g, or t
  modified_base (346)..(346): a, c, t, g, unknown or other
  misc_feature (346)..(346): n is a, c, g, or t
  modified_base (357)..(357): a, c, t, g, unknown or other
  misc_feature (357)..(357): n is a, c, g, or t
tcagtagtgtagatcacgaccggtgctcgatttagctacgctctaagggaaaggggaagactgacggtcccccaggagttcaggtgctgggcacggtgggcatgtgtgagttttgtcacaagatttgggctcaactctcctgtgcagcctctggattcacctttaatacctattggatgagttgggtccgccaggttccagggagggctggagtgggtgccaanataaagcaagatggaagtgagaaatactatgtggactctgtgaagggccgattcaccatctccagagacaacgccagaactcattgatctgacaaatgaacagactgagagcgagacacggntgtgtattacngtgcgagagaggaggcgtattagtagtaaagtggcgtggcttctactactactactacagtcgacgtcgtagggacgaaacggaccgacggtacaccgtcctacctcacgcctccaccgaaccggcccacgttcccggtcccttcccccgtcggtaccctaccctccctacccgaacgaccgaccaacccttccggtacggggccgaccgacggg

SEQ ID NO: 235111 - DNA, 579 bp, Homo sapiens
  misc_feature: GYAE6OF01DGN4Y.37.61.F06.1.454.CMB.1.raw
  modified_base (483)..(483): a, c, t, g, unknown or other
  misc_feature (483)..(483): n is a, c, g, or t
  modified_base (534)..(534): a, c, t, g, unknown or other
  misc_feature (534)..(534): n is a, c, g, or t
  modified_base (572)..(572): a, c, t, g, unknown or other
  misc_feature (572)..(572): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagattttgggctcaactctcctgtgcagcctctggattcacctttaatacctattggatgagttgggtccgccaggttccagggaaggggctggagtgggtggccaacataaagcaagatggaagtgagaaatactatgtggactctgtgaagggccgattcaccatctccagagacaacgcccagaactcattgtatctgcaaatgaaacagactgagagccgaggacacggctgtgtattacgtgtgcgaggagaggaggtcgattagtagtaaatggacgtgggccttctactacttactactacatggacgtcgtggggacgaaacgggaccgacggtaccaccgtctcccttcgacnccctacccaccgaacgggcccctagtcccggtaccttcccccgtcggcccnccccttcccacccaacgacgccacctccggtcggggcncgaccgg

SEQ ID NO: 235112 - DNA, 595 bp, Homo sapiens
  misc_feature: GYAE6OF01C33SZ.37.61.F06.1.454.CMB.1.raw
  modified_base (361)..(361): a, c, t, g, unknown or other
  misc_feature (361)..(361): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagattttgggctcaactctcctgtgcagcctctggtttcatctttagcaactacgccatgagctgggtccgccaggctccgagggaaggggctggagtgggtctcaggtattactggtagtggtaataccgcatactacgcagactccgtgacgggccggttcaccgtctccagagacaattccaagaatacggtctatctaggaaatgaacagcctagagagccgaggacacggccctntatactgtgcgagagatcagacggagtatagcagcagctctgactacgtgggaccacggaccctggtcctaccgtcctcctcacgccctaccgaaccgaacgggcccacgttccggtcccttacccccgtggaccctcccctcctacccgaagaccgaccacccgtccggtcggggaccaccgaccggacccgggcccgtcggggtccctcggcccgtgggtccgtaaaccggg

SEQ ID NO: 235113 - DNA, 605 bp, Homo sapiens
  misc_feature: GYAE6OF01BTA5C.37.61.F06.1.454.CMB.1.raw
  modified_base (560)..(560): a, c, t, g, unknown or other
  misc_feature (560)..(560): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccagggaagggctggagtgggtggccaacatacgagggaggtggtggtacgaaaaactatgtggactctgtgcggggccgattcaccatctccagagacaacgaccaaaaactcactgtatctgcaaatggacggcctgagatccggaggacacggctgtgtattattgtgcgagagtatttagactaactaaagtttcgagtgacgtggtatgatgtcttatgataccggtggggacccaaggggaccctagtcggtaccaccggttcttccttcacgtccctacccaacccgaacggggtcccctagttcccggttcccttccccccgtggccccgtcccctgccctcccgacgggaccncccacccgtccgagacgccacgacggcccggtcccgtgggtcccg

SEQ ID NO: 235114 - DNA, 584 bp, Homo sapiens
  misc_feature: GYAE6OF01CRRER.37.61.F06.1.454.CMB.1.raw
  modified_base (289)..(289): a, c, t, g, unknown or other
  misc_feature (289)..(289): n is a, c, g, or t
  modified_base (370)..(370): a, c, t, g, unknown or other
  misc_feature (370)..(370): n is a, c, g, or t
  modified_base (533)..(533): a, c, t, g, unknown or other
  misc_feature (533)..(533): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcaccttttaatacctattggatgagttgggtccgccaggttccagggaagggctggagtgggtggccaacataaagcaaagatggaagtgagaaatactatgtggactctgtgaagggccattcaccatcnccagagacaacgccagaactcattgtatctgactaaatcgaacagactgagacgccggaggacacggctggtagtattacnggtgacgagaggaggaggcgtaattagtagtaaagtggcgtcgggtccttacgtactactactaactacagtggacgtcgtagggacgaacgggaccgacggtaccaccgtcctcctcacgcctaccgaccgacggccacgtccgtccctccccgtcgtcccnccctcccgtaccaacgaccgcctacccgtcggtcggggccacggtacccgg

SEQ ID NO: 235115 - DNA, 587 bp, Homo sapiens
  misc_feature: GYAE6OF01DGCBE.37.61.F06.1.454.CMB.1.raw
  modified_base (469)..(469): a, c, t, g, unknown or other
  misc_feature (469)..(469): n is a, c, g, or t
tcagtagtgtagatcacgaccggtgctcgatttagctacgctctaagggaaaggggaagactgacggtccccccaggagttcaggtgctgggcacggtgggcatgtgtgagtttttgtcacaagatttgggctcaactctcctgtgcagcctctggattcacctttaatacctattggatgagttgggtccgccaggctccgagggaaggggctggaggtggggtggccaacataaaagcgagatggaagcgaagaaatactaatggtggactctgtggaggggccgattcacatctccacagacaacgaccaagaaatactaattctttttagactaaatgaactagtctgagagtcgaggacacggccatgtattactgtacgagagaacagacgttgggacgagggaccctggtcaccgtcctcctcacgcctaccaccgaacggcccagtccgtcccttccccgnggcccgtcctcgtcctccgaggacgcctaccgtccgagacgccacgacggccggccgtcgggctcggccgtggtaccgaacggtaccttaccgttcactacctaccacgtcgtacggg

SEQ ID NO: 235116 - DNA, 793 bp, Homo sapiens
  misc_feature: GYAE6OF01DM3TA.37.61.F06.1.454.CMB.1.raw
  modified_base (327)..(327): a, c, t, g, unknown or other
  misc_feature (327)..(327): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagattttgggctcaactctcctgtgcagcctctggattcacctttaatacctattggatgagttgggtccgccaggttccaggggaaggggctggagtgggtggccaaacaataaagcaaagatggaagtgaagaaatactatgtaggactctgtgaagggccgattcaccatctccagacgacaacgcaagaactccgagcatcngacaaatgaacagtctgagagaccggaggactacggctttaagttacttacgtcgcggtacgaaggaagaacgggacgtcggggtcggttttacggaccgtacggtacggggaccgtaacggggtaacccgttcgggtacccgtaacccgttcctacccgttccgaaccgtaccccgttacccgaaaccccggaaacgggtaccccccgtaacggtttccccggggttaccccgttttcccccccgggttccggggtaccccgttccccccggttacgtccccggttaaccccggaacggggtaccccgtacccgtaacccccggtccggaaccggaccggtaacccgaacccggtaacccgggccccggggtacccccggttcgggggtaccccgtcgggtacccccggttacgggttaacccgaaaccgggtttaaccccttaaccgttaccccggttaaaccc

SEQ ID NO: 235117 - DNA, 596 bp, Homo sapiens
  misc_feature: GYAE6OF01ANYES.37.61.F06.1.454.CMB.1.raw
  modified_base (377)..(377): a, c, t, g, unknown or other
  misc_feature (377)..(377): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagattttgggctcaactctcctgtgcagcctctggattcacctttaatacctattggatgagttgggtccgccaggttccagggaagggctggagtgggtggccaacataaagcaagatggaagtgagaaatactatgtggactctgtgaagggccgattcaccatctccagagacaacgcccagactcattgtatctgcaaatgaacagactgagagccgaggacacggctgtgtattactgtgcgagaggaggnggtacgattaggtagtaagtggtcgtgggtccttgtactactactactactagtcggacgtcggtcgggacgtaaacgggacccgtaccggtaccgacccgtcctcctccgaccgtcctaccccgaccgaaccgggccctacgtcccgttcccgtcccccgtcggcccaccccgtcccacccgaacgccgtccacccgttccgcggggccacgaccggg

SEQ ID NO: 235118 - DNA, 618 bp, Homo sapiens
  misc_feature: GYAE6OF01D4G5T.37.61.F06.1.454.CMB.1.raw
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccagggaagggctggagtgggtggccaacataaagcaagatggaagtgagaaatactatgtggactcgtgtggaacgggccgattccaacctatctaccagagaccaacgcccaagaactcattgtatctgacaaatgaacagactgagacgccgagacacggctgtagtattactggtgacgagaggaggaggtacgtagtttaaggtagtaaagtcggcgtacggtaccttacgttaactacttactactacgtacgtggtacgtcgtacggggacgaacgggaccgacggtaccgaccgtcctcctaccgacgtccctaccgaccgaacggccaccgttccgtcccttccccgtcggtaccctacccctccctacccgaagacccgacctacccgtggccgggccaccggacccggg

SEQ ID NO: 235119 - DNA, 562 bp, Homo sapiens
  misc_feature: GYAE6OF01DANQ8.37.61.F06.1.454.CMB.1.raw
  modified_base (329)..(329): a, c, t, g, unknown or other
  misc_feature (329)..(329): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagattttgggctcaactctcctgtgcagcctctggattcacctttaatacctattggatgagttgggtccgccaggttccaggggaaggggctggagtgggtggccaacataaagcaagatggaagtgagaaatactatgtggactctgtgaagggccgattcaccatctccagagacaacgcccagaactcattgtatctgcaaatnaacagactgaagagccgaggcacggctgtgtattactgtgcgagagaggaggcgagttagtagtaatggctgggccttctactactaactactacatggacgtcgtgggacaagggaccgacggtccgaccgtctccctcacgccctccaccgaacgggaccccagtcccggtccttcccccgtcgccctacccctccctcccaacgcgtccacctcgtcggggcacgaccgg

SEQ ID NO: 235120 - DNA, 558 bp, Homo sapiens
  misc_feature: GYAE6OF01EYQRT.37.61.F06.1.454.CMB.1.raw
  modified_base (325)..(325): a, c, t, g, unknown or other
  misc_feature (325)..(325): n is a, c, g, or t
  modified_base (360)..(360): a, c, t, g, unknown or other
  misc_feature (360)..(360): n is a, c, g, or t
  modified_base (373)..(373): a, c, t, g, unknown or other
  misc_feature (373)..(373): n is a, c, g, or t
tcagtagtgtagatcacgaccggtgctcgatttagctacgctctaagggaaaggggaagactgacggtcccccaggagttcaggtgctgggcacggtgggcatgtgtgagttttgtcacaagatttgggctcaactctcctgtgcagcctctggattcacctttaatacctattggatgagttggtccgccaggttccagggaagggctggagtgggtggccaacataaagcaagatggaagtgagaaatactatgtggactctgtgaaggccgattcaccatctcagagacaacgcccagaactcattgatctgcaaatgaacngactgagagccgaggacacgggctgtgtattacgngtgcgagagaggngcgaattagtgtaaatggctgggccttctactactactactacatggacgtcgtaggggcaaacgggaccgaacggtccaaccggtctcccgttcaacgccctaccaccgaacgggcccacgtccggtccttcccccgtcggtcccaccctccctccaacgcgcaccctcgtcggggcacgacgg

SEQ ID NO: 235121 - DNA, 564 bp, Homo sapiens
  misc_feature: GYAE6OF01BO0YZ.37.61.F06.1.454.CMB.1.raw
  modified_base (557)..(557): a, c, t, g, unknown or other
  misc_feature (557)..(557): n is a, c, g, or t
tcagtagtgtagatcacgaccggtgctcgatttagctacgctctaagggaaaggggaagactgacggtccccccaggagttcaggtgctgggcacggtgggcatgtgtgagtttttgtcacaagattttgggctcaactctcctgtgcagcctctggattcacctttaatacctattggatgagttgggtccgccaggttccagggaaggggctggagtgggtggccaacataaaagcaaagatggaagtgaagaaatactatgtggactctgtgaagggccgattcaccatctccagagacaacgcccagaactcattgtatctgacaaatgaacagactgagagccgagacacggctgtgtattactgtgacgagaggaggaggcgattagtagtaatggcgtggcttctactactactactactatggcgtcgtagggacgaagggaccgacggtccgaccgtctacctcacgcctaccaccgacggcccacgtccgttccttccccgtcgtcctacccctcctacccaacgacgccacccgtacgtcggggcncgaccgg

SEQ ID NO: 235122 - DNA, 554 bp, Homo sapiens
  misc_feature: GYAE6OF01A4P7T.37.61.F06.1.454.CMB.1.raw
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccagggaagggctggagtgggtggccaacataaagcaagatggaagtgagaaatactatgtggactctgtgaagggccgattcaccatctccagagacaacgcccagaactcattgtatctgcaaatgaacagactgagagccgaggacacggctgtgtatactgtgcgagagaggagcgattagtagtaaatggcgtggcttctactactactactacatgacgtcgtgggacgaagggaccacggtcaccgtctcctcacgcctaccgaccaacggcccagtccgtcccgttccccgtcggcccacccctccctacccgaacgacgtaccaccgtacgtcggggccacgaccgg

SEQ ID NO: 235123 - DNA, 582 bp, Homo sapiens
  misc_feature: GYAE6OF01AQVBF.37.61.F06.1.454.CMB.1.raw
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccaggggaaggggctgggagtgggtggccaaacataaagcaaagatggaagtgagaaatactatgtggactctgtgaagggccgattcaccatctccagagacaacgcccagaactcattgatctgcaaatgaacagactgagagccgaggacacggntgtgtattacngtgcgagagaggaggcgtagttagtgtaaagtggcgtgggtccttctactactactactacagtggacgtcgtgggacgaagggaccgacggtccgacccgttcctcctccacgtccctacccaccgaacgggccctacgtcccggtcccttcccccgtcggtcccacccctccctcccaacgacgccctaccctaccgtcggggccacgaccgg

SEQ ID NO: 235124 - DNA, 690 bp, Homo sapiens
  misc_feature: GYAE6OF01CH6PR.37.61.F06.1.454.CMB.1.raw
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccaggggaaggggctgggagtgggtggccaaacataaagcaaagataggaagtgaagaaatactatggtggacttcgtggtaggaaacggggccgtaattccaacctattcctaccgaaggaacgaaccaaccggaccccaaggtaaaccttctaagttttcgtaacttccgtaggaacctaaaagttacgaaaaccgaagtaaccgtaggaacgaacggaccggaaggaaccgacgggtcgttaggtagttaactttacgtggtggacggaaggtagggaggacggtacgtaagtttaggtagtaagtggtacgtcggtccttactactactactactactagtgacgtcgtagggacgaaggactacgacgtacctaccgtcctcctaccgacgtccctacccgaccgacggtcccacgtcccgtcccgtccccgtcgaccctaccccgtccctacccacgaccgaccaccgccggtcggggctaccggg

SEQ ID NO: 235125 - DNA, 568 bp, Homo sapiens
  misc_feature: GYAE6OF01DYC81.37.61.F06.1.454.CMB.1.raw
  modified_base (562)..(562): a, c, t, g, unknown or other
  misc_feature (562)..(562): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagattttgggctcaactctcctgtgcagcctctggattcacctttaatacctattggatgagttgggtccgccaggttccagggaagggctggagtgggtggccaacataaagcaagatggaagtgagaaatactatgtggactctgtgaagggccattcaccatctccagagacaacgcccagaactcattgatctgacaaatgaacagactgagagccgaggacacggctgtgtattactgtgcgagagaggagcgtaagttagtagttaaagtgggcgtgggtcctttacgtactactactactacatggacgtcgtgggacgaagggaccacggtccaccgtctcctcacgccctaccgaccaacggcccacgtccggtaccttcccccgtcggcccacccctccctacccgaacgacgccacctcggtcggggccncgacgg

SEQ ID NO: 235126 - DNA, 809 bp, Homo sapiens
  misc_feature: GYAE6OF01EF8VG.37.61.F06.1.454.CMB.1.raw
tcagtagtgtagatcacgaccggtgctcgatttagctacgctctaagggaaaggggaagactgacggtccccccaggagttcaggtgctgggcacggtgggcatgtgtgagttttgtcacaagtatttgggctcaactctcctgtgcagcctctggattcacctttaatacctattggatgagttgggtccgccgaggttccgaaggggaaggggctgggaggtgggtacggaccaaacgataaaaggcaaaaggagttaggggaaagtaggaaagtaaaaattacgtagttggtaggaccttgtaggtaggaaacggggtcccgtaatttacccaccctaacgttcctaccgaaggaacgaacccaaacccggcccccgtaaaaggtaaaccttccgtaattttacggtaacctcgttacgaactaaaacgttgaaaaccacggtaagtcggaaacgggacggaacccggaacgggtaaccgaaccggttcttacggttaagtttaacttacggttgacggaacggaaggtagggaacgggacgtacgtaagttaaggttaagtaacggtggtacgtacggtccttactactaacgtactacaagtgtacgtcggtacggagggtaccgaacggtccgtacgtccgaccgttcctaccgtacgtaccacccgtaccgaccggaacccggtccctaccggttccccgttacccgttcccccgtaccggtaccctaacccccgttcccgtaaccgaccggtacccgtacccgtaccccggtgggttacccgggaccgtaccggcccgggg

SEQ ID NO: 235127 - DNA, 761 bp, Homo sapiens
  misc_feature: GYAE6OF01B84WU.37.61.F06.1.454.CMB.1.raw
  modified_base (120)..(120): a, c, t, g, unknown or other
  misc_feature (120)..(120): n is a, c, g, or t
  modified_base (152)..(152): a, c, t, g, unknown or other
  misc_feature (152)..(152): n is a, c, g, or t
  modified_base (224)..(224): a, c, t, g, unknown or other
  misc_feature (224)..(224): n is a, c, g, or t
  modified_base (330)..(330): a, c, t, g, unknown or other
  misc_feature (330)..(330): n is a, c, g, or t
  modified_base (474)..(474): a, c, t, g, unknown or other
  misc_feature (474)..(474): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcanaagtatttgggctcaactctctgtgcagcctntggattcacctttaatacctattggatgagttgggtccgcgaggtccgaggggaaggggctgggaggtgggngaccaacataaagcaaagtagtaggaaagtagaagaaatactagtggtggactctggtaggaacgggcctattcactatctacaagacacaaccgccaagaacctnatttcgattccagtaacaaaagtcaaacgaacgacgtaggaacgcggaacccggaaggaaccgtacggtcttaggttaagttacttaggtaggtcggaggaggaaaggaaggggacggacgttaagttaaggtaaggttaaagngggtacgttcgggtaccctttactaacctaactacgttaactactaggttacggaaccggttacggaacggggaacggaaacgggtacccgtacccgggtacgtaaccccgttcctacccgtacgtaaccgaccctaccccgaaccggaaccgggtccctaaccggttcccggttaccccgtaccccccggttcgggacccccttaaacccccgtcccgttaaacccgaaggacccgtacccggtaacccggttcgggaacccggggccctaacccgggacccgggg

SEQ ID NO: 235128 - DNA, 576 bp, Homo sapiens
  misc_feature: GYAE6OF01AY3BQ.37.61.F06.1.454.CMB.1.raw
  modified_base (193)..(193): a, c, t, g, unknown or other
  misc_feature (193)..(193): n is a, c, g, or t
tcagtagtgtagatcacgaccggtgctcgatttagctacgctctaagggaaaggggaaggactgacggtccccccaggagttcaggtgctgggcacggtgggcatgtgtgagttttgtcacaagattttgggctcaactctcctgtgcagcctctggattcacctttaatacctattggatgagttgggtccnccaggttccagggaagggctggagtgggtgccaacataaagcaagatggaagtgagaaatactatgtggactctgtgaaggccattcaccatctaccagagacaacgccaagaactcattgtatctgacaaatcgaaacagactgagacgccgaggacacggctgtgtaattacgtggtgcgaggagaggagtacgtattagtagtaatggcgtgggtccttctactactactactacagttgacgtcgtacgggacaagggaccacggtactaccgtcctcctcgactccctaccaccgacgggcccacgtaccggtccttccccgtcggcctaccccgtccttacccgaacgacgtacccaccgtcgcgggccacgaccgg

SEQ ID NO: 235129 - DNA, 601 bp, Homo sapiens
  misc_feature: GYAE6OF01E09Z2.37.61.F06.1.454.CMB.1.raw
  modified_base (593)..(593): a, c, t, g, unknown or other
  misc_feature (593)..(593): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagattttgggctcaactctcctgtgcagcctctggattcacctttaatacctattggatgagttgggtccgccaggttccagggaagggctggagtgggtggccaacataaagcaaagatgggaagtgagaaatactatgtggactcgtgtgaagggccgattcaccatctccagacgacaaccgcccagaactcattgtatctgacaaatgaacagactgagagccgaggacacggctggtgtattacgtgtgcgagaggaggaggcgtagttagtagtaagtggtcgtcggtccttctacctactactactacagtacggtacgtcgtgggacgaacgggaccgacggtcctaccgtcctaccgtcgtacgaccctaccgaaccgaaccggtaccctacgttcccgtcccgttcccccgtcggtccctacccctccctacccgaacgaccgcctacccgtcgcggggccncgtaccgg

SEQ ID NO: 235130 - DNA, 565 bp, Homo sapiens
  misc_feature: GYAE6OF01B4JU8.37.61.F06.1.454.CMB.1.raw
  modified_base (557)..(557): a, c, t, g, unknown or other
  misc_feature (557)..(557): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccagggaaggggctggagtgggtggccaacataaagcaagatggaagtgagaaatactatgtggactctgtgaagggccgattcaccatctccagagacaacgcccagaactcattgtatctgacaaatgaacagactgagagccgaggacacggctgtgtattactgtgcgagagaggaggcgtattagtagtaagtggctgggtcttctactactactactactatgacgtcgtgggacgaacgggaccgacggtacgaccgtctccgtcacgcctaccaccgaacggcccacgtccgtccgttcccccgtcggtcccacccctccctacccaacgacgtccaccgtcgtcggggcncgtaccgg

SEQ ID NO: 235131 - DNA, 550 bp, Homo sapiens
  misc_feature: GYAE6OF01ETWDQ.37.61.F06.1.454.CMB.1.raw
  modified_base (316)..(316): a, c, t, g, unknown or other
  misc_feature (316)..(316): n is a, c, g, or t
  modified_base (535)..(535): a, c, t, g, unknown or other
  misc_feature (535)..(535): n is a, c, g, or t
  modified_base (543)..(543): a, c, t, g, unknown or other
  misc_feature (543)..(543): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttggtccgccaggttccagggaagggctggagtgggtggccaacataaagcaagatggaagtgagaaatactatgtggactctgtgaagggccgattcaccatctccagagacaacgcccagaactcattgtanctgcaaatgaacagactgagagccgaggacacggctgtgtatactgtgcgagagaggaggcgatttagtagtaaagtggcgtgggtccttctactactactactacatgacgtcgtgggacgaaggaccacggtcaccgtcctcctcacgccctccaccaacggcccactccggtacctccccgtcgccaccctccctaccaacgacgccacccgtacncggggccncgaccgg

SEQ ID NO: 235132 - DNA, 569 bp, Homo sapiens
  misc_feature: GYAE6OF01A0B7U.37.61.F06.1.454.CMB.1.raw
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
  modified_base (331)..(331): a, c, t, g, unknown or other
  misc_feature (331)..(331): n is a, c, g, or t
  modified_base (377)..(377): a, c, t, g, unknown or other
  misc_feature (377)..(377): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccgagggaaggggctgggagtgggtggccaacataaagcaagatggaagtgagaaatactatgtggactcgtgtgaagggccattcacatcncaganacacgccagaactcattgtatctgacaaatgaaacngactgagagccgaggacacggctgtagtatactgtgcgagagaggngacgtagttagtagtaagtggcgtcgggtcctttactaacttactactactactagtcggtacgtcgtagggtacgaacgggtaccacggtccgaccgtctaccgtcgcgccctaccgaccgaacggccctagtccgtccttccccgtcgcccaccctccaccgaagacgcaccgtcggcgggccacgccgg

SEQ ID NO: 235133 - DNA, 698 bp, Homo sapiens
  misc_feature: GYAE6OF01CC1CQ.37.61.F06.1.454.CMB.1.raw
  modified_base (452)..(452): a, c, t, g, unknown or other
  misc_feature (452)..(452): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgtagttgggtccgccaggttccgaggggaaggggctgggagtgggtggaccaaacataaagcaaagagtaggaagtgaagaaatactagtgtggactcgtgtaggaacgggtcctattaccaacctattcctaccgaaggaacgaaccaacccgccccaagtaaacctctaagtttcgtaatctagaacaaatgaaacagactagacgaacgccggaaggacacggtcgtaggttagttactttacgtggtaggacgaaggaaggaggacggngtaagttagtagtaagtggtcgtcggtccttactaactactaactactacgagtcggtacgtcggtagggaacgaacgggaccgacggtacctaccgtcctaccctacgaccgtaccctacccgacccggaaccgggccctaccgttacccggttcccctttaccccccgcggtaccccctacccccgttcccacccgaacgtaccgtacccacccggttcgggtcgggcccgaccggtacccggg

SEQ ID NO: 235134 - DNA, 730 bp, Homo sapiens
  misc_feature: GYAE6OF01BAAXE.37.61.F06.1.454.CMB.1.raw
  modified_base (229)..(229): a, c, t, g, unknown or other
  misc_feature (229)..(229): n is a, c, g, or t
  modified_base (417)..(417): a, c, t, g, unknown or other
  misc_feature (417)..(417): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttggtccgccaggttccgaggggaagggctggagtgggtggccaaanaataaagcaaagagtaggaagtagaagtaatactagtgtaggactcgtgtaggaacggccgtattccaccatcctaccaggaacaccaaccgcccaagaactctacgttgtaactctagaactaaaagtacgaaacgagaactggaagacgaccggaagacgacggtctaggtacttaacgtttacgnggtagacgggtaaggacggaagggtacgtagtaagtttaagtaagttaaaggtggtacgttcggtacctttacttaacgtaacttaactaacgtaactacgtcggtaacgtcggtacgggaaccggtaacggaccgtaccggtaccgtcccgttacctcccgttaccgaccgtccctacccgaccggtaaccggccctaccgttcccgttaccccgttacccccggtccgtacccctaccccgttccccgaaccgtaaaccgacccgtacccgtacccggtaccggtccgggggaccctccggtaccccgggg

SEQ ID NO: 235135 - DNA, 577 bp, Homo sapiens
  misc_feature: GYAE6OF01E4R34.37.61.F06.1.454.CMB.1.raw
  modified_base (295)..(295): a, c, t, g, unknown or other
  misc_feature (295)..(295): n is a, c, g, or t
  modified_base (364)..(364): a, c, t, g, unknown or other
  misc_feature (364)..(364): n is a, c, g, or t
  modified_base (470)..(470): a, c, t, g, unknown or other
  misc_feature (470)..(470): n is a, c, g, or t
tcagtagtgtagatcacgaccggtgctcgatttagctacgctctaagggaaaggggaagactgacggtccccccaggagttcaggtgctgggcacggtgggcatgtgtgagtttttgtcacaagatttgggctcaactctcctgtgcagcctctggattcacctttaatacctattggatgagttgggtccgccaggttccagggaaggggctggagtgggtggccaacataaagcaagatggaagtgagaaatactatgtggactctgtgaagggccgattcaccatctcaganacaacgcccagaactcattgtatctgcaaatgaacagactgagagccgaggacacggctgtgtattacngtgcgagagaggaggcgtattagtagtaagtggctgggtccttctactactactactacagtgacgtcgtgggacgaaggaccgacggtcgaccgtcctccgtacncgccctaccgaccgaacggcccacgtcccggtcccgttccccccgtcgtccccacccctcccgtcccgaacgaccgacccgtaccctccggcggggccacgaccggg

SEQ ID NO: 235136 - DNA, 702 bp, Homo sapiens
  misc_feature: GYAE6OF01DNN28.37.61.F06.1.454.CMB.1.raw
tcagtagtgtagatcacgaccggtgctcgatttagctacgctctaagggaaaggggaagactgacggtccccccaggagttcaggtgctgggcacggtgggcatgtgtgagttttgtcacaagattttgggctcaactctcctgtgcagcctctggattcacctttaatacctattggatgagttgggtccgccaggttccagggaagggctggagtgggtggccaacataaagcaagatggaagtgaagaaatactatgtggactctgtgaagggccgattcaccatctccagagacaacgcccagaactcattgtatctgacaaatgaaacagactgaagagccgaggcacggctgtgtattactgtgcgagaggaggaggtctagtttagtagttaagtaggtcgtgggtaccctttacgttaacttaacttaacttaccttaacgtaagttacgggtaaccggtcggttacgggggtaaccgtaaacggggaacccgtaaccgggttaccgaacccggttacccttacccgtaccgaccgtacccgttacccgacccgaaccgggtacccctacgtcccgggtttccctttaccccccggttaccggtacccgtacccccgttccccgttaacccgaaacgaacccggtacccgtaaccccgttaccggttaccggggggaccaccggtaacccgggg

SEQ ID NO: 235137 - DNA, 755 bp, Homo sapiens
  misc_feature: GYAE6OF01CUAX5.37.61.F06.1.454.CMB.1.raw
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccgaggggaaggggctgggagtggggtggccaacataaagcaagatggaagtgaagaatactatggtggactctggtaggaacggggccgtattccaacctatacctccgaagacgaaccaaaccgcccaacgtaaccttacagtttacgtacttccgtagaactaaagtacgaaaactagaacgtaggaacggaacggacccggaacggaccgaaccgggtcgtttaggtacgtttaactttacgtgggtacggaacggaagggagggtaacggggtaacggtacgttaaggtttaaggtaggtaaagtcggtacgtacgggtacccttacgttaacttacgtaacctactacgtacggtacggtacggtacggtacggggaacgtaaacgggacccgtaccgggtacctacccggtcctacccgtacgacccgtaccctacccgaccggtaccggtcccgtaccgttcccggttccccttccccgccggacccctacccctcccgtacccgaccgaccgtaccctaccggtccggtacgggcctacggacccggg

SEQ ID NO: 235138 - DNA, 618 bp, Homo sapiens
  misc_feature: GYAE6OF01BCHRG.37.61.F06.1.454.CMB.1.raw
  modified_base (191)..(191): a, c, t, g, unknown or other
  misc_feature (191)..(191): n is a, c, g, or t
  modified_base (386)..(386): a, c, t, g, unknown or other
  misc_feature (386)..(386): n is a, c, g, or t
  modified_base (606)..(606): a, c, t, g, unknown or other
  misc_feature (606)..(606): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccnccaggttccaggggagggctggagtgggtggccaacataaagcaaagatggaagtgaagaaatactatgtggactctgtgaaggccgattcaccatctcagagaccaacgcccagaactcattgtatctgacaaatgaaacagactaggaaggacgaccggaaggacacggcgtaggtgttatttacgtggtcgngaagaggaggaggacgtagtttaggtagtaagtggcgttggtccttactacttaactactactacgagtcggacgtcgtacggggacgaagggacccgtacggttacccgtctacctccgtacgcccgtaccgaccgaacggcccacgtccgtccgttacccccgtcgccctacccctccctaccgaaccgtacgcccgtaaccgtccggtacgggaccncgcggtcccggg

SEQ ID NO: 235139 - DNA, 728 bp, Homo sapiens
  misc_feature: GYAE6OF01CNZUR.37.61.F06.1.454.CMB.1.raw
tcagtagtgtagatcacgaccggtgctcgatttagctacgctctaagggaaaggggaagactgacggtcccccaggagttcaggtgctgggcacggtgggcatgtgtgagttttgtcacaagatttgggctcaactctcctgtgcagcctctggattcacctttaatacctattggatgagttgggtccgccaggttccaaggggaaggggctggagtgggtggccaaacataaagcaaagataggaagtgaagaaatactatggtggactctgtaggaacgggccattcaacctattcctaccagaagaaccaaccgacccaagaacctctaattcgtaactctgaacaaatagaacagactaggagacggaccgtaaggaccacgggtctaggtagtagtttactggtaggacgaagtacggaggggagacggttattaagggtaagttaacggtggtcgttacgggtcctttaccgttaacttaactaaccttacgtactacgttacggtacggtaccggtaggggaaccgtaaacgggacccgtacgggtacctacccgttacgtaccctacgaccgtacccctaacccgtacccggaaccgggtcccgtacgttaccccggttccccgttacccccgtccggtacccctacccccttccccgtaaccgaaccggaccggtaccctacccgtaccgggtccggggaccgacccggtacccgggg

SEQ ID NO: 235140 - DNA, 736 bp, Homo sapiens
  misc_feature: GYAE6OF01C696R.37.61.F06.1.454.CMB.1.raw
  modified_base (357)..(357): a, c, t, g, unknown or other
  misc_feature (357)..(357): n is a, c, g, or t
  modified_base (377)..(377): a, c, t, g, unknown or other
  misc_feature (377)..(377): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagattttgggctcaactctcctgtgcagcctctggattcacctttaatacctattggatgagttgggtccgccaggttccgaggggaaggggctgggaggtggggtcgaccaacaataagcaagatgggaagtgaagaaattactagtggtggactcgtggtagaacggggccctattaccacctatcctaccgaagaacgaccaaccgccaagtaacctctagtttgtatcgtanaacaaagtcaaacgagtacnggaaggacgaccggaacggaccgacggtcgttggttagttactttaggtggtacggacggaggaacgggaagggtacggtacgtaaggttttaaggtaaggttaacggtcgggtacgtccggttacctttacgttaaccttaaccttactaaccgtagtacgtcggacgtcgggtacgggaacgaaccgggaccgtacggtacccgtacccgttcctaccgtaccgtacctcccgacccgacccggtaccggcccttacggttccccgtccccgttccccgccggtaccccctaccccgttcccgaaccaccggacccgcccgttacccggtacggggtaccgggccgtcgggccccgg

SEQ ID NO: 235141 - DNA, 766 bp, Homo sapiens
  misc_feature: GYAE6OF01DUAQT.37.61.F06.1.454.CMB.1.raw
  modified_base (163)..(163): a, c, t, g, unknown or other
  misc_feature (163)..(163): n is a, c, g, or t
  modified_base (186)..(186): a, c, t, g, unknown or other
  misc_feature (186)..(186): n is a, c, g, or t
  modified_base (214)..(214): a, c, t, g, unknown or other
  misc_feature (214)..(214): n is a, c, g, or t
  modified_base (350)..(350): a, c, t, g, unknown or other
  misc_feature (350)..(350): n is a, c, g, or t
tcagtagtgtagatcacgaccggtgctcgatttagctacgctctaagggaaaggggaagactgacggtccccccaggagttcaggtgctgggcacggtggcatgtgtgagttttgcacaagatttggctcaactctctgtgcagcctgtgattctactttaanacctagttggatgagttcggccncgaggtccgagggagggctggagtgggngaccaagataaagcaagagtaggagtgaagaatctagtggtaggtactgtggtgaacgggccaattccacgtatcctcgaagacgacaaccgccaaaggtactctagtttgactcgtagaacgtaaatcgaaacgnggtacgtagaacggaccggaccggtaaagcccgtaggtacttagggtatttaacgttcgtgggtacgaacgggaacggagggacgggtaacgggtacgtttaaggtttaaggtaacggttaaggtacgggtccggttacgggttaccctttaacgtaaccttaaccgttaaccgttaccgttaacgtacggtacgggtaccggttacgggtaacggggtaacgaaacggggtacccgtaaccgggttaccctaaccggttacccgtaccgtaccgtacccgacccgttaaccgaacccggtaccgggtacccttaccggttacccggttaccccgttcccggcccgtacccgtacccccttccgaaccgaacgtccgtaccgaccggttacggaccggggtccaccggtacccggg

SEQ ID NO: 235142 - DNA, 830 bp, Homo sapiens
  misc_feature: GYAE6OF01C3AEN.37.61.F06.1.454.CMB.1.raw
tcagtagtgtagatcacgaccggtgctcgatttagctacgctctaagggaaaggggaagactgacggtccccccaggagttcaggtgctgggcacggtgggcatgtgtgagttttgtcacaagattttgggctcaactctcctgtgcagcctctggattcacctttaatacctattggatgagttgggtccgcaggttccgaggggaaggggctgggagtgggtggaccaacataaagcaaagatagggaagtgaagaaatactagtggtaggacttcgtggtacggaacggggacccgtatttaccaaccctattaccctaccgaaggaaccggaaccaaaccccggccccaaaggtaaaccttctaagtttgtaacttccgtagtaacctaaaagtcgaaaacgagtacgtaggaacggaacgaccggaaggaccgaccgggtcttaggtagttaacgtttacgtagggtacggacggaggtaagggacggggtaaggtacggtaagtttaaggtaaggttaaaggtcgggtacggttcgggttacccttacgttaaccttaaccttaaccgttaaccgtacgttacggtacgggtaccgggttacgggtaggggaaccgtaaaggggtctaccggtaaccgggtacctaccccggttacttacccgtccgaaccgtacccctacccgaacccggtaaccggggtcccctaccggttccccggttacccccgttcccccggtacccggaccccttaccccccgtacccgtaacccgaacggtaccccgaccgttacccggtacccgggtcggggaacccgtacccggg

SEQ ID NO: 235143 - DNA, 871 bp, Homo sapiens
  misc_feature: GYAE6OF01C015W.37.61.F06.1.454.CMB.1.raw
tcagtagtgtagatcacgaccggtgctcgatttagctacgctctaagggaaaggggaagactgaccggtccccccaggagttcaggtgctgggcacggtgggcatgtgtgagttttgtcacaagtatttgggctcaactctctgtgcagcctctgattctacctttaatacctattggatgtaggttcgggtccgccgtaggttaccggaagggggaacggggtcgtgggagggttggggtcggaccaaacaagtaaagacaaaggagtagggaagtagaaagtaaatacgtagtggtaggtacttcgtaggtagggaacgggtaccgtaacttaccgaacctaatcccgtaaccgaaggaacgaacccgaaacccggccccaaaacgtaaccttctaaggtttataaccttcgtaacggaactaaagtaacgtaaaccgtaacgacgtaagggaaccggacggaacccgggtaacgggaaacccgtacgggtaccgtttaggttaacgtttaaacggttttacggttaccgggtagggaacgggtaaaggggtaaaggggtaaacggggggtacggtaacggttaaaggtttttaaggggttaaacgggttaaacgggttacggggttaccggggtttaccggtttacccggtttaacttaacccgtttaaccgttaaccttaacgtaacgtacgtacgggtacgtcggtaacgggaacgtaacgggaccgtacgtacctaacctcgtacctccgtacaccgtacccaccgaacccggaccgtacccgtaccgttacccgttccccgtaccccgcgacccctcccgtacccgtacgacgacctcccgacccgtcgggacggactacccgg

SEQ ID NO: 235144 - DNA, 669 bp, Homo sapiens
  misc_feature: GYAE6OF01CXBOF.37.61.F06.1.454.CMB.1.raw
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttggcagctttgccatgagctgggtccgccaggcctccgaggggaaggggctggaatgggtctcgagcctatttagtagtaggtggtggaagcacgtactacgctgaccgtccgtaggaacgggtccggttccgccctctccagacgacaactccaacaacacgctgtctctcgactaacttaacagcctgaagagacgaggacgaacggtctaagtacttatgtacggacggaaagggtacgggtctaaggcgtaagtcgccgtacggtacctacctacttactagtagtcgggacgttcggtacggggacgaaaggtacgtcggaccggtaccgtacccgtcttacccgtacgaccgtcccgtacccgaaccggtaccggacccgtacgtcccggttacccttccccgtccgacccctaccccgtcctaccggaacgccggtaccctaccggtcccgggtacgggaccctaccgacggacccggtccgcggggtccgttaccgg

SEQ ID NO: 235145 - DNA, 598 bp, Homo sapiens
  misc_feature: GYAE6OF01EZLZ7.37.61.F06.1.454.CMB.1.raw
  modified_base (334)..(334): a, c, t, g, unknown or other
  misc_feature (334)..(334): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccagggaaggggctggagtgggtggccaaacataaagcaagatggaagtgagaaatactatgtggactctgtgaagggccattcaccatctccagagacaacgcccagaactcattgtatctagacaaatcgaacnggactgagagccgaggacacggctgtgtattacgtgtcgacgaagagaggaggcgtaagtttagtagtaaagtggcgtgggtccttactactactactactactatcggacgtcggtgggacgaaacgggaccacggtccgacccgtcctccgtcacgccctaccaccgacggcccgacgttaccggtcccttcccccgtcggtacccaccccttccctacccgaacgaccgtaccacccgtcggtacggggccaccgaccggg

SEQ ID NO: 235146 - DNA, 761 bp, Homo sapiens
  misc_feature: GYAE6OF01D8707.37.61.F06.1.454.CMB.1.raw
  modified_base (364)..(364): a, c, t, g, unknown or other
  misc_feature (364)..(364): n is a, c, g, or t
  modified_base (394)..(394): a, c, t, g, unknown or other
  misc_feature (394)..(394): n is a, c, g, or t
  modified_base (405)..(405): a, c, t, g, unknown or other
  misc_feature (405)..(405): n is a, c, g, or t
tcagtagtgtagatcacgaccggtgctcgatttagctacgctctaagggaaagggaagactgacggtccccccaggagttcaggtgctgggcacggtgggcatgtgtgagttttgcacaagtatttgggctcaactctctgtgcagccttctggtacttcctaacctttaataccgttagttggatggtaggtttcgggtccccgaccgtagggtttccggaagggggaacgggggtcgttagggagggttcgggggtcgggaacccaaacgaagttaaaacgcgaaaggtagtagggtaagtagaaacgtaaacttataagttcggtaggtactcgtagtagggaacggtcctatccgaactntccgacagacgaaccacgacctaagacctntcgttagtacncgtacgaactaagagaactagaacgtagaaccggagacccggaaggtacgaccggttagtagtagttaaacttcggtagtacgagggaaaggacgggtacggtaggtttcgggtacccggtttacgtaccggtacgggtacggaccgtacggtaccggttcgtacccggtactcccgtaccgtacgaccccgtacgtaacccacgggaccgtaccctacggttcccgttccctcccggccgtccccgctcggtccctacggacctacggcccttaccgcgagaacccgtcaacccggtcggcccgtcggtacggcgtcggtaccgttacggaaccgtcctacgtaccttaacccgg

SEQ ID NO: 235147 - DNA, 632 bp, Homo sapiens
  misc_feature: GYAE6OF01CVAED.37.61.F06.1.454.CMB.1.raw
  modified_base (260)..(260): a, c, t, g, unknown or other
  misc_feature (260)..(260): n is a, c, g, or t
  modified_base (333)..(333): a, c, t, g, unknown or other
  misc_feature (333)..(333): n is a, c, g, or t
  modified_base (369)..(369): a, c, t, g, unknown or other
  misc_feature (369)..(369): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttggtccgccaggttccagggaggggctggagtgggtggccaacataaagcaaagatggaagtgaagaaatactatgnggactctgtgaacgggccattcaccatctaccagagacaacgccagaactcattgatctgacaaaatgaaacngactgagacgcgaagacacggctgtagtatttacgngtgcgagaggagggagcgtaagttagtagtaaagtggtacgttcgggtaccttacttaacgttactaacctactactagtacggtacgtcggtacgggacgaaacggggcccgacggtaccacccggtccttacccgtccgaccgtccctacccgaccgaaccgggccctaccgtcccggttcccttcccccgtcggcccctaccccgtccctacccgaaccgacgtacccacccgtaccggtcgggaccgaccgtacccggg

SEQ ID NO: 235148 - DNA, 987 bp, Homo sapiens
  misc_feature: GYAE6OF01COIS6.37.61.F06.1.454.CMB.1.raw
tcagtagtgtagatcacgaccggtgctcgatttagctacgctctaagggaaaggggaagactgacggtccccccaggagttcaggtgctgggcacggtgggcatgtgtgtagttttgtcacaagtattttgggctcaactctcctgtgcagcctctggacttctacctttaatacctattggatgtaggttcgggtccgccgtacggttaccgaagggggaaggggcgtgggtaggttggggtcggaccgaaacaagtaaaacgacaaaggtagtagggtaaagttggaaagtaaaacttacgttaagttggtacggtacttcgttaggtacgggaacggggtaccgttacttaccaaccgtacttcctaccgaacggaaacggaacccgaaccgaccccgtaaacgtaaccgttaactacgtttacgttaacttaccgtacgtaacgtaaaacgtaacggtaaaaccgagtaaacgtaaggaacggaaccgggaccgggaaacggaacccggtaccggttaacggtttcggttaacggttacgtttaccggttaggtacggaacggtaacgggtaagggggtaaggggaacggttaccggttaaagggttttaggttaaaacgggttaaacgggttcggggttaccgggtttacggggtttacccccttttaacgtttaacccgttaaaccgtttaaaccgttaaccttaacggtaacgggttaccgggttaccggggttaccgggtaaccggggtaaaccgggaaaccggggtaccccggttaaccgggtacccgtaacccccgttcctaccccgtacggtacccctacccggtaaccccgaaccggtaacccggtccctacccggtttcccggtcccctttcccccggtaccgtcccccgtaacccccgttcccgtaaacccgaacggtaccccgtcccgaacccgggttcgggtaccccgggtaccggacccggtacccgggg

SEQ ID NO: 235149 - DNA, 555 bp, Homo sapiens
  misc_feature: GYAE6OF01BL9J4.37.61.F06.1.454.CMB.1.raw
  modified_base (359)..(359): a, c, t, g, unknown or other
  misc_feature (359)..(359): n is a, c, g, or t
  modified_base (473)..(473): a, c, t, g, unknown or other
  misc_feature (473)..(473): n is a, c, g, or t
  modified_base (548)..(548): a, c, t, g, unknown or other
  misc_feature (548)..(548): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagattttgggctcaactctcctgtgcagcctctggattcaccttttaatacctattggatgagttgggtccgccaggttccagggagggctggagtgggtggccaacataaagcaaagatggaagtgaagaaatactatgtggactctgtgaagggccgattcaccatctccagagacaacgcccagaactcattgatctgacaaatgaacagactgagagccgaggacacggctgtntatactgtgcgagagaggaggcgtaattagtagtaagtggcgtggtccttctaactactactactacagtggacgtcgtgggacgaacgggaccacggtccaccgtctccgtcncgcctccgaccacggcccacgtccgtcccttccccgtcgcctaccctcccaccaacgacgccaccgtcgcgggcncgaccgg

SEQ ID NO: 235150 - DNA, 809 bp, Homo sapiens
  misc_feature: GYAE6OF01C3J2B.37.61.F06.1.454.CMB.1.raw
  modified_base (191)..(191): a, c, t, g, unknown or other
  misc_feature (191)..(191): n is a, c, g, or t
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagctctggattctacctttaatacctattggatgagtttgggccncgaggttccaggggaagggctggaggtgggnggacccaaanaagtaaaagcgaaagtagtaggaagtggaataaaatactatgtaggactgtagtcggaacggggcctatttccaacctattccgacccgaagacggaaacctaacccgcccaagtaaaccttccaatttcgtaattccagacctaaaatggaaaacacggtaactggaacggacgaccggaaacggaacccgtggtaccgtttgggtatttaaaattttaccgtggttacggacgaaagggaagggttagggggaaacggttcgtaaagttttacgtaaggttaaaaggttgggtaacggttcgggtccttttaaccggttaacctttaacttaaaccttaactaacctaaggtacgggttacggtccggttaggggaaccgaaacgggaacccgtaccgggtaccgtaacccgttccgtacccgttccgaccgtacccctacccgacccgaaacccgggtcccgaccgttccccgttcccgttaccccccggtcggacccccgttaccccctcccgttaaccccgaacggtccgtacccgtacccgtggtcccgggaacgtcccggaaccccgggg

SEQ ID NO: 235151 - DNA, 635 bp, Homo sapiens
  misc_feature: GYAE6OF01C7QXJ.37.61.F06.1.454.CMB.1.raw
  modified_base (299)..(299): a, c, t, g, unknown or other
  misc_feature (299)..(299): n is a, c, g, or t
  modified_base (302)..(302): a, c, t, g, unknown or other
  misc_feature (302)..(302): n is a, c, g, or t
  modified_base (307)..(307): a, c, t, g, unknown or other
  misc_feature (307)..(307): n is a, c, g, or t
  modified_base (325)..(326): a, c, t, g, unknown or other
  misc_feature (325)..(326): n is a, c, g, or t
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (346)..(346): a, c, t, g, unknown or other
  misc_feature (346)..(346): n is a, c, g, or t
  modified_base (360)..(360): a, c, t, g, unknown or other
  misc_feature (360)..(360): n is a, c, g, or t
  modified_base (373)..(373): a, c, t, g, unknown or other
  misc_feature (373)..(373): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctctgtgcagcctctggattcacctttaatacctattggatgagttggtccgccgaggttccgaggggtaaggggctgggaggtgggtcggaccaacaagtaaaagcaaagagtaggaagtgaagtaaatactatggtgacgtctggtagagggcatcgacntcncaganacacgccagaactcattnntcagactaancgaanagacngaagacgcgagacngacgtgatagtcngtcgagagtagaggagacgtagtagtagtaagtggcgtacggtccttacgtacttaactactaacgtacgtagtacggtacgtcggtacgggaacgaaacgggtacccgaacggtccgtaccgtcccgtacctcgaacccgtccgtaacccgaccggaaaccgtcccgtacggtcccgttaccccgtccccgtcgaccccctacccgtccctacccgaacgccgtacccgtaccggttccggcggtaccgacccggtccggg

SEQ ID NO: 235152 - DNA, 552 bp, Homo sapiens
  misc_feature: GYAE6OF01B5Y6B.37.61.F06.1.454.CMB.1.raw
  modified_base (220)..(220): a, c, t, g, unknown or other
  misc_feature (220)..(220): n is a, c, g, or t
  modified_base (343)..(343): a, c, t, g, unknown or other
  misc_feature (343)..(343): n is a, c, g, or t
  modified_base (357)..(357): a, c, t, g, unknown or other
  misc_feature (357)..(357): n is a, c, g, or t
  modified_base (464)..(464): a, c, t, g, unknown or other
  misc_feature (464)..(464): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctctgtgcagcctctggattcacctttaatacctattggatgagttggtccgccaggttccaggagggctggagtggtgcaanataaagcaagatggaagtgagaaatactatgtggactctgtgaaggccattcacatctcagacgacaacgccagaactcattgatctgacaaatgaacagactgagagccgaaggactacggntgtagtatttacgngtgcgagaggaggaggtcgaatttagtagtaaagtggcgtggtccttctactactactatacatgacgtcgtgggacaagggaccacggtccaccgtctacctcacncctaccaccgaacggccacgtccgtcccttccccgtcgacctccctcctaccgaacgacgtaccaccgtcgtcggggccgtacgacgg

SEQ ID NO: 235153 - DNA, 614 bp, Homo sapiens
  misc_feature: GYAE6OF01A0SL6.37.61.F06.1.454.CMB.1.raw
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (329)..(329): a, c, t, g, unknown or other
  misc_feature (329)..(329): n is a, c, g, or t
  modified_base (353)..(353): a, c, t, g, unknown or other
  misc_feature (353)..(353): n is a, c, g, or t
  modified_base (367)..(367): a, c, t, g, unknown or other
  misc_feature (367)..(367): n is a, c, g, or t
  modified_base (605)..(605): a, c, t, g, unknown or other
  misc_feature (605)..(605): n is a, c, g, or t
tcagtagtgtagatcacgaccggtgctcgatttagctacgctctaagggaaagggagactgacggtccccccaggagttcaggtgctgggcacggtgggcatggtgtgagtttttgtcacaagattttgggcctcaactctcctgtgcagcctctggattcacctttaatacctattggatgagttgggtccgcctaggttccagggaagggctggagtgggtggccaacataaagcaagatggaagtgaagaatactatgtagacttctgtgaaggccattcacatcncaganacacgccagaactcattcgtatctgacaatgaacngactgagacgccgagaccgacggnttgtagtattacgngtcgacgagtaggaggagtacgtagttagtagtaatggcgtcggtccttactacttactactaacacgtagtaggacgtacgcgggacgaacgggaccgtacggtacctaacccgtccgtcctacgaccgtcccgtaccgaccgaaccggtacccgtacgttcccgtacccttcccccgtcgtaccccacccgtcccgtacccgaacgaccgtacccgtacccgtacggcgggtaccncgtaccggg

SEQ ID NO: 235154 - DNA, 658 bp, Homo sapiens
  misc_feature: GYAE6OF01C0JMX.37.61.F06.1.454.CMB.1.raw
  modified_base (166)..(166): a, c, t, g, unknown or other
  misc_feature (166)..(166): n is a, c, g, or t
  modified_base (187)..(187): a, c, t, g, unknown or other
  misc_feature (187)..(187): n is a, c, g, or t
  modified_base (214)..(214): a, c, t, g, unknown or other
  misc_feature (214)..(214): n is a, c, g, or t
  modified_base (220)..(220): a, c, t, g, unknown or other
  misc_feature (220)..(220): n is a, c, g, or t
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
  modified_base (344)..(344): a, c, t, g, unknown or other
  misc_feature (344)..(344): n is a, c, g, or t
  modified_base (546)..(546): a, c, t, g, unknown or other
  misc_feature (546)..(546): n is a, c, g, or t
  modified_base (596)..(596): a, c, t, g, unknown or other
  misc_feature (596)..(596): n is a, c, g, or t
tcagtagtgtagatcacgaccggtgctcgatttagctacgctctaagggaaaggggaagactgacggtcccccaggagttcaggtgctgggcacggtgggcatgtgtgagttttgcacaagatttgggctcaactctcctgtgcagcctctggattcacctttaanactattggatgagtgggtccncaggttcgagggagggctggagtgggngccaanataagcaagntggaatggaanaatactatggaggtcttcgttagaggacggctactacactacgttccagaagacaaccgaaccgaccaactaactacctagtttactactcgtacaacgtaanaacgaagactaggacgaaggcggaacggtaacgcggtaacggtgttagtagttaacgttcgaacggtgaaggtaggaggtaggaggagttaagttagtaagtaagtcggtacggtacgttacctataccgtaactaactagtacgtacgtaggtacgacggtacggaacgacggaccgtacgtaccgtaccgtctaccgtcnccgtaccacgacggaacccgtctaccgtcccggttaccgtcccgtacccncctaccccgttcaaccgacgacccgtaaccgtccggtaggaccgggtccaacggtaccccgg

SEQ ID NO: 235155 - DNA, 648 bp, Homo sapiens
  misc_feature: GYAE6OF01C05NT.37.61.F06.1.454.CMB.1.raw
  modified_base (263)..(263): a, c, t, g, unknown or other
  misc_feature (263)..(263): n is a, c, g, or t
  modified_base (518)..(518): a, c, t, g, unknown or other
  misc_feature (518)..(518): n is a, c, g, or t
  modified_base (525)..(525): a, c, t, g, unknown or other
  misc_feature (525)..(525): n is a, c, g, or t
  modified_base (622)..(622): a, c, t, g, unknown or other
  misc_feature (622)..(622): n is a, c, g, or t
  modified_base (639)..(639): a, c, t, g, unknown or other
  misc_feature (639)..(639): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttcgggtccgccaggttccgagggaagggctggagtgggtgccaacataaagcaagagtaggaagtgaagaatactagtgnggtactcgtaggtaggaacgggtccagttaccacctatcctaccgagagaaccaaccgcccgagaaacctctaagtttacgtaatctaggaactaaatacggaaacagtacgtgaacgacggacgaacggaacgcgggactttaggtagtttaacttaaccgtggtacggacggaaagacgggaaggacgggtataggtttaagtagtaaagtcggtacgtcggtcttacctaactactaactactacagtacgnggtacgngggacgaacggtcacggtctaccgtctccgtacacgtccctaccgacgaccgcctacgtccgtccctcccgtcgaccctaccgcctaccgaggaccncgacccgtggcgggacncggcccggg

SEQ ID NO: 235156 - DNA, 760 bp, Homo sapiens
  misc_feature: GYAE6OF01EPN3I.37.61.F06.1.454.CMB.1.raw
tcagtagtgtagatcacgaccggtgctcgatttagctacgctctaagggaaaggggaagactgacggtccccccaggagttcaggtgctgggcacggtgggcatgtgttgagtttttgtcacaagatttgggctcaactctcctgtgcagcctctggattctacctttggcagtctttgccatgagcgtgggtccgcaggctccgaggggagggctaggatgggtctcagacctattagtagtaggtggtaggaacgcacgttacacgtcgtgaccgtcggtaggaccgggtcccggttccgccctcgtaccgagtacgaacctaacctacccaaaaccgaaccgaccgtccgttacggttcctaccgtacgtaaccaaacctttaacgccgtccgtaaggacgtaaggaaccggacggaaccgaccgggttaccgttaattaacgttacggtaggtaacgggaacggtaaaggggtaccggtacgtacggtacgtacggtacgtacccgttacggttaaccctaccgtattaaccgtagttacgtcgggtaccggtcggtaacggggaacgtaacggtacgtccggtaccggtacgtacccgttccgtcctacgaccgtaccccaccgtaaccgggaccgtcccgtacgttcccgttacccgtcccggtacgtcccctacccgtaccaccgtacgcgcccgtaccggtcgggaccgggacctaccggtaccggtcccgggtcccggtggtccgtcccgg

SEQ ID NO: 235157 - DNA, 721 bp, Homo sapiens
  misc_feature: GYAE6OF01AU843.37.61.F06.1.454.CMB.1.raw
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctcgtggattcctaccttttaactaccttagtttgggattggtaggtttggggtcccgccgtacgggttccgaagggggaagggggctgggaggtggggtcggaccaaacaataaaagcaaagagtacgggaagtaggaagaaaatactagtggtaggacttcgtggtagaaacggggtccattccacctatcctaccgagaacgaccaaaccgccccaaagacttctagttagtacttctaggaccaaaagtacgtaaaccagtacgtagacgacggaccggaggaccgacgggtcttggtagttactttacgtggtaggacggtaaggaagggtaggggcgtacgttaaggttagtacggtaagtcggtcgtacgggtccttacgtactactacttactactagtacggcgtagtcgggaacgaacggaccgacggtaccgtaccggtacctcctcgacctcctacccgaccgaccgacctacgtcccgttcccgtacccccgtcgaccccaccctcccgtacccgacgtaccgtacccgtcccgaccggtcgggccgtacggtacccgg

SEQ ID NO: 235158 - DNA, 852 bp, Homo sapiens
  misc_feature: GYAE6OF01EAXP6.37.61.F06.1.454.CMB.1.raw
  modified_base (191)..(191): a, c, t, g, unknown or other
  misc_feature (191)..(191): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccnccaggttccgagggagggctggagtgggtggccaacataaagcaaggatggaagtgaagaaatactatgtggactcgtgtgaagggccattcaccatctccagagacacgcccagaactcgatttgtactctagacaaaatcgaaaccagtaaccgtgaagacgacccggaaggtaaccaccgggtcgttggttacgttaagtttacgtagggtgaccgggaagaacgggaagggaacgggtcgtaaagttttaaggtaggttaaacggttgggtaccggttacggggtcccttttaaccgttaaccgtttaaacctttaaccgttaaccgttaaccgttaacggtacgggttaaacccgggttccggttaacgggggggaaacccgtaaaaccgggggaacccggttaacccgggttacccgtaaccccggttacgttacccccgttaccggtaacccgttcccccgttaacccccgaaacccgggtaaacccggggtacccccttaaccggttaccccgggtttcccccgtttacccccccggttaccggggaccccccttaaaccccccgttcccccgttaacccgtaaaccgggacccgtaaccccgttaacccgttcccggggttacggggggaccccgaacgggtaaccccgggg

SEQ ID NO: 235159 - DNA, 827 bp, Homo sapiens
  misc_feature: GYAE6OF01BC2YY.37.61.F06.1.454.CMB.1.raw
tcagtagtgtagatcacgaccggtgctcgatttagctacgctctaagggaaagggggaagactgacggtccccccaggagttcaggtgctgggcacggtgggcatgtgtgagtttttgtcacaagtattttgggctcaactctcctgtgcagcctctggattcacctttaatacctattggatgagttgggtccgccaggttccgaggggaaggggctgggaggtggggtggaccaacataaagcaagatggaagtgaagaaatactatggtggactcgtggtaggaagggccattccacctactctccaggacacccgaaccgcccaagtaacctctaatttgtaatctaggaccaaaagtcgaaaaccgagtaacgtacggaacgaacggcccggaaagggtacccgacgggtcctttagggttagtttaactttacgtagggtcggtacggaaagggtacgggaaggggtaggtaaccggttaagttttaagggttaacggttaaaggttcggtacgggttcgggttaccctttacccgttaaccttacgttaaccttaaccgttaactaacggttacggtaccggtacggggtacgggtaaaccggaaaccggggtacccgtaaccggttcccgtaaccccggttcctccccgtacctaccgtaccccgtacccgtaaccccggaacccggtccccgtacggttccccgtaccccgtttcccccgtacccgggtacccctacccccctaccggtacccaaaccgggtacccgaccccgttacccggttacccgggtcggggacccgtaccgggtaccccgggg

SEQ ID NO: 235160 - DNA, 600 bp, Homo sapiens
  misc_feature: GYAE6OF01EPXTZ.37.61.F06.1.454.CMB.1.raw
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
  modified_base (351)..(351): a, c, t, g, unknown or other
  misc_feature (351)..(351): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcaccttttaatacctattggatgagttgggtccgccaggttccagggagggctggagtgggtggccaacataaagcaagataggaagtgaagaaatactatgtggactctgtgaagggcctattcaccatcncaganacacgcccagactcattgtatctgacaaatgaacagactgagagccgagacacggntgtntatcngtgcgagagaggagctagttagtagtaagtggtcgtcggtccttactaactactactactactagtggtacgtcggtagggacgaaacgggacccgtacggtcctaacccgtcctcctacgaccgtccctacccgaccgaaccgggcctaccgttccggtccccttcccccgtcggtacccctacccctccctacccgaaacgaccgtacccgaccgtccggcggggccacggtaccggg

SEQ ID NO: 235161 - DNA, 844 bp, Homo sapiens
  misc_feature: GYAE6OF01BUSHY.37.61.F06.1.454.CMB.1.raw
tcagtagtgtagatcacgaccggtgctcgatttagctacgctctaagggaaaggggaagactgacggtccccccaggagttcaggtgctgggcacggtgggcatgtgtgagttttgtcacaagattttgggctcaactctcctgtgcagcctctggattcacctttaatacctattggatgagttggtccgccaggttccagggaagggctggagtgggtggccaacaagtaaagacaaagagtaggaagtagaagaaatactagtgtaggtactcgtaggtaggaacgggccgtacttccgacctactccgtaccaagaaccgaaccgaaccgacccccgtaaggtaaacctctaagtttacgttaacttccgtacgtaactaaacgtacgaaacaaggtaacctaggacggaacgggacccggaacgggtaacccgaaccggggtcgtttaggttacggtttaactttacggttggtacggacggagggtaagggaaggggaggtacgttaagtttaaggttaacggtaagttcgggtccggttcggttaccctttacgttaaccgttaaccgttaacttacctaacgtaggtacgggttaacggtcgggtaacggggaaccgaaaccgggtaccggtacccggtaccgtaccccgttcccgtaccctaccggaccgtacccctaccgaaccccggaaccggtccccgtaaccgttcccccggttaaccccgtttccccccggtacggtaccccccttacccccggttccccctaacccgaaacccggtacccgtacccgtaccccgttaggggtacccggggaccctaccgggaccccggg

SEQ ID NO: 235162 - DNA, 860 bp, Homo sapiens
  misc_feature: GYAE6OF01AZCTV.37.61.F06.1.454.CMB.1.raw
  modified_base (389)..(389): a, c, t, g, unknown or other
  misc_feature (389)..(389): n is a, c, g, or t
tcagtagtgtagatcacgaccggtgctcgatttagctacgctctaagggaaaggggaagactgacggtcccccaggagttcaggtgctgggcacggtgggcatgtgtgagttttgtcacaagatttgggctcaactctcctgtgcagcctctggattcacctttaatacctattggatgagttggtccgctaggttccgaggggaagggctggagtgggtctcgaggttattacgtggtagtaggtaactaccgctaacgtacctaacgcaagtaccgttccggtggaccggggtccgttccaaccgttctacccgaagacgaacctaactttcccgaaaagtaacgttaccggttactaagtccgtaagggaaaacttcggaaaaccncggtcctaggaacggaccggtcccggaagggtacccacccgggtccccttagttaaacgtttccgtggttacgacggtaaaggacgtaacgtcggaaaggtacggtaagttactaggccaggcaacgtccgttacgtacggtaccgttacgggtaccgggtaccccgtaacccgggtaacccgtcgggtaccctacccggttcctcccgtaccgaccgtaccccaccgaacccggtaccggacccttacgttccccggttaccccgttacccccggtcgttacccccgaccccgtttaacccgtacccgaacgggtacccgtacccgttacccgggtaccggggtaccggggaacccgtacccggaccggggtcccccgggtacccggggttaccgggtcccggtttaccgggtaccgggttacccgggttaaaccggaaacccggttaaccccgttaccgttaaccccgg

SEQ ID NO: 235163 - DNA, 618 bp, Homo sapiens
  misc_feature: GYAE6OF01BXUZZ.37.61.F06.1.454.CMB.1.raw
  modified_base (263)..(263): a, c, t, g, unknown or other
  misc_feature (263)..(263): n is a, c, g, or t
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (341)..(341): a, c, t, g, unknown or other
  misc_feature (341)..(341): n is a, c, g, or t
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
  modified_base (602)..(602): a, c, t, g, unknown or other
  misc_feature (602)..(602): n is a, c, g, or t
tcagtagtgtagatcacgaccggtgctcgatttagctacgctctaagggaaaggggaagactgacggtcccccaggagttcaggtgctgggcacggtgggcatgtgtgagttttgtcacaagatttgggctaaactctcctgtgcagcctctggattcacctttaatacctattggatgagttgggtccgccaggttccagggaagggctggagtgggtgccaacataaagcaagatggaagtgagaaatactatgtggactntgtagagggccattcaccatctcagnacacgccagactnattgtatctgacaatgaacagactagagacgcgaggacncggctgtagtattcgngtgacgagaggaggnggcgtaagttgtaacgtaagtggcgtgggtcctttacgtacttaccgtaactacgtactagttcgggacgttcggtaggggaccgaaacgggtacccgtacgtctacccgtctccctcgaccgccctaccgaaccgacggtccctacgttccggtaccccttccccgtacggacccctaccccgtcccgtaccgaacggtaccaccccgtaccgtccgggtacgggaccncggacccggtcccggg

SEQ ID NO: 235164 - DNA, 678 bp, Homo sapiens
  misc_feature: GYAE6OF01D1IQO.37.61.F06.1.454.CMB.1.raw
  modified_base (504)..(504): a, c, t, g, unknown or other
  misc_feature (504)..(504): n is a, c, g, or t
  modified_base (666)..(666): a, c, t, g, unknown or other
  misc_feature (666)..(666): n is a, c, g, or t
tcagtagtgtagatcacgaccggtgctcgatttagctacgctctaagggaaagggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccgagggaggggctggaggtgggtggccaacaagtaaagcaagataggaagtgaagaaatactatggtggactcgtgtaggaagggcctattccaccatcctacagacgaccaaccgcccaagaactcatttgtactcgtagactaaagtagaacagactaggaacgacggaccggaaggaccgacgggtcttaggtagttaactttacgtggtacgacggtaaggaagggaaggggtacggtacgttaagttaggttaagttaaggtggtacgtcggtaccttactaacttaactactactacngtacggacgtcggagggacgaacgggaccgacggtacctaccgtctccgtacaccgtccctaccgaccgaaccggtaccctcgttcccggttccccttcccgtcccgtaccctaccccgtcccacccgaacgccgtacccgacccgtacgggccggggaccnccggtacccggg

SEQ ID NO: 235165 - DNA, 858 bp, Homo sapiens
  misc_feature: GYAE6OF01DI6O4.37.61.F06.1.454.CMB.1.raw
  modified_base (246)..(246): a, c, t, g, unknown or other
  misc_feature (246)..(246): n is a, c, g, or t
tcagtagtgtagatcacgaccggtgctcgatttagctacgctctaagggaaaggggaagactgaccggtccccccaggagttcaggtgctggggcacggtgggcatgtgtgtagtttttgtcacaagattttgggctcaactctcctgtgcagcctctggattctaacctttaatacctattggatgaggttcgggtccgccaggttccgaggggaaggggcgtgggaggtggggtcggacccaanaataaagcaaagagtaggaagtgaagaaatactatggtggactcgtgtaggaacgggccgtattccaaccctattcctaccaaggtaacaccaaacccggcccaaagtaaacctcttaatttaggtaactcgtagaacctaaaagtacgaaaacgacgaacgtaggaaacggtaccggacccggaaaggacccgaacgggtcgttaggttcgtttaacgtttacgtcgggtaggaacggagggaaaggacgggggtaagacggttaagtttaaggttaacggttaaacggtcgggtacggttcgggttaccctttacccttaaccgtttaaccttaaaccgttaaccttaaccgtaacggttaccgggtaacccgggttcgggtacgggggaaaccggaaaccggggtaaccccgtaccggtaacccgttaccccggtacccttaccccgtacctaccgccccgttaaccccacccgggaaacccggaccccgtacgttcccccgggtttccccttcccccggttaccggaccccttaccccccgtaccctaacccgtaacggacccgtccctaaccggtcccgggtacggggaccctacgggaccccgggg

SEQ ID NO: 235166 - DNA, 649 bp, Homo sapiens
  misc_feature: GYAE6OF01B7P3Y.37.61.F06.1.454.CMB.1.raw
  modified_base (318)..(318): a, c, t, g, unknown or other
  misc_feature (318)..(318): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattctacctttaatacctattggatgtaggttcgggtccgccaggttccgaggggaaggggctgggagtgggtggccaacataaagcaagatggaagtgaagaaatactagtgtggactcgtggtggaaggcctatccaccatcctcagacgaccaacgccanactcattgatctagacaaatgaacagtacgtgaacgacgacccggaaggacgacggtcgttagtacgttattacgtggtcgacggagagggacggacggtagtaagttagtaagtaagtggcgtcggtccttactacttaactactactacagtcggtacgtggtacgggacgaaccgggtaccgacgtaccgtacccgtcctccgtaccaccgtccctaccgaccgaaccggtccctaccgtcccggttccccgttccccgccgtacccctacccctcccgtaccgaaccgccgtacccgtacccggtccgggcgggccgaccggccggg

SEQ ID NO: 235167 - DNA, 864 bp, Homo sapiens
  misc_feature: GYAE6OF01ECVAZ.37.61.F06.1.454.CMB.1.raw
tcagtagtgtagatcacgaccggtgctcgatttagctacgctctaagggaaagggaagactgacggtccccccaggagttcaggtgctgggcacggtgggcatgtgtgtagttttgtcacaagtatttggctcaactctcctgtgcagcctgtgattctacctttaataccttagttgatgtaggttcgggtccgccgtaggttccgaaggggtaacgggcgtagggaggtggggtacgacctaaacaagtaaagacgaaagtagtaggaagtagaaagaaatacgtagtggtacggtacttcgtaggtacggaacgggtccgttaacttaccaacccgtacttccgaaccgaaggaacgaaacccgaaccccgtaccccgtaaacggtaaaccttaccgtaacgttttacgtaaccgttccgttaacgaaacggtaaaatacggaaaaccgaaaggttaaccgagaacggaacggtaccgggaaaccggaaccggtacggtagttacggttagtttaacgtccgtttaggcggaacggtaaggacgggtaaggggaacggtacgttaaggttttaaggtaacgttaagggtacggtacggttacggttaccctttaacttaaccgttaaccttaacgtaaccgtacgtacgttacgggtaccgttcgggtaacggggaacgtaaccgggtaccgtacggtaccgtacccggtcctacccgtaccgtaccgtccccgaacccgtacccggtaccgggtccctaccgggttcccgttccccgttaccccgccggttaccccgtacccctccgaacccgtacgacccgttaccgaccggtaccggtcgggacctccgggacccggg

SEQ ID NO: 235168 - DNA, 863 bp, Homo sapiens
  misc_feature: GYAE6OF01CMS4Z.37.61.F06.1.454.CMB.1.raw
  modified_base (301)..(301): a, c, t, g, unknown or other
  misc_feature (301)..(301): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattctacctttaatacctattggatgtaggttgggtccgccgtaggttccagggggaagggggcgttgggaggtggggtcggaccaaacaagtaaaagacaaggagtagggaagtggaagtaaatactagtggtggactcgttggngggaaacgggccgtattccacctaattcctaccgagacgtaaccaaccgccccaagtaaacctcgtaagtttgtaacttcgtacgaactaaaatggaaaacctagaacgtagaacggacgaccggaacgggtacacgggtcgttgtagttacttacgtggtgacggagtaggaagggtcggtactagtttaggtaagtaaggtcggtacggttcggttccctttaactaacgttacctaacgttaaccgtactacggtttacgggtaccgttaccggggtagggggtaaacccgaaaacggggtacccccggtaacgggttaccccgttaacccggttccccgttaccccgtaccggaaccccgttcccccggttaaccccgaaccccgggtaaacccggggttcccccgtaccgggttcccccgggtttacccccttccccccggggttcgaaccccccgttaacccccccgtttcccgaaacccgggtaaccgtaccccgggcccgttaaaccccgggtcgggggtaaaccccggggccgttaaacccgggccccggggg

SEQ ID NO: 235169 - DNA, 825 bp, Homo sapiens
  misc_feature: GYAE6OF01EMI89.37.61.F06.1.454.CMB.1.raw
  modified_base (145)..(145): a, c, t, g, unknown or other
  misc_feature (145)..(145): n is a, c, g, or t
  modified_base (358)..(358): a, c, t, g, unknown or other
  misc_feature (358)..(358): n is a, c, g, or t
tcagtagtgtagatcacgaccggtgctcgatttagctacgctctaagggaaaggggaagactgacggtcccccaggagttcaggtgctgggcacggtgggcatgtgtgtagttttgtcacaagatttgggctcaactctcctgtncagcctcgtggtacttctacctttggctagtctttgccgatgacgtctcgggtccgcctaggcctccgaggggtaagggctagggacgtgggtctcgagcctagttagtagtaggtggtgaagtctaacgtaccttacggctacgacgtccggttaggaacggggtcccgttccgcccttcgtaccgaagtacgaacctaacctacccgaaanaccgtaccggtcgttacgttcctacgtacgtaacctaaacgttaacgccgtaccgtaggaacgacggaacggtacggacctacggacttaacttacttacgtggtacgaacgggtaacggtaacgggttactacggacgagggtttccgtaccgttccggtaacccttacccgtaacttacgtaagttacgtacggtaccgtacgggtacgggtaaccgtaaacggtacgtccggtacggtaccgtccgttacccgtcgtacccgaccgttacccgaccccgtaacccggggaaccggttaccccttaaccggttccccggtttaccccgttccccggtaaccgtccccgtacccccgttaccgtaacccgaaacgtacccgggtacccctaacccggggtcgggttaccggggaccccgtacgggtacccggtccccgggttacccgggtcggccccggttacggg

SEQ ID NO: 235170 - DNA, 689 bp, Homo sapiens
  misc_feature: GYAE6OF01EKROP.37.61.F06.1.454.CMB.1.raw
  modified_base (509)..(509): a, c, t, g, unknown or other
  misc_feature (509)..(509): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagattttgggctcaactctcctgtgcagcctctggattcacctttaatacctattggatgagttgggtccgcctaggttccgaggggaaggggctgggaggtgggtggccaaacataaagcaagatggaagtgaagaaactatatgtggactctggtagaagggccgtattccacctatcctaccgaagacgaccaacgccccaagtaacctcaactttgtactctacgaactaaaatcgaaacaagacgtagaagggacgacccgggaacggaaccgacgggtctagtacgttaattacgtggtggacggaggagggaggacggacgtaagtttaaggtacgtaaggtgggcgttacgggtcccttagttacctacttactactacngtacggcgtcggtacggggaacaacgggaccgacggtcccacccgtcctacctaccgcgaccctacccgaaccgaccggacccgtaccgtaccccggttcccgttcccccgtcgaccccacccctcctaacccgacgtaccgacccctaccggtaccgggtcggacccgacggacccggg

SEQ ID NO: 235171 - DNA, 861 bp, Homo sapiens
  misc_feature: GYAE6OF01ET7QY.37.61.F06.1.454.CMB.1.raw
  modified_base (148)..(148): a, c, t, g, unknown or other
  misc_feature (148)..(148): n is a, c, g, or t
  modified_base (365)..(365): a, c, t, g, unknown or other
  misc_feature (365)..(365): n is a, c, g, or t
  modified_base (409)..(409): a, c, t, g, unknown or other
  misc_feature (409)..(409): n is a, c, g, or t
tcagtagtgtagatcacgaccggtgctcgatttagctacgctctaagggaaagggaagactgacggtccccccaggagttcaggtgctgggcacggtgggcatgtgtgtagttttgtcacaagtatttgggctcactctcctgtgacncgtcctcgtgtacttactaaccttttaactaccgttattaggatggtaggttcggggtcccaccggtacggttccggaaggggtaacggggtcgtgggacgggtcggggtacggaccaaacgaataaacggacgaaagagtaggtaacggtaagaaagtaaattaccgttagtggtacggtaccttcgtaggaggaacgggccttacgttccaaccnttacccgcgaaacggacgtaacccgaacctacccgaagtaaccncttacggttgttaatacccgttagaaactaagacggaaactacggtacaaggaacgacgaacccgggtacgaacggtaccggtttacggttaattaacttcggtgtaacccgggaggaacggaacgggaggggtaccgtaaaagggtttacgttaaaggttaacggttaaggtcgggtaccggttaccgttacccgttacttaaaccgttacctttaaccgttaaaccgttagtacggacggttaccgtacgggttacgggaaaccggtacggtaaccctacggtacccgttaaccgtccttccgaaccgttccgtaccccaccgaacccggtccgacccggttacccgttacccggttaccccgtcccccgtaccgtacccctcccccgtaccgtaaccgaccgtacccgttacgcccggttaggggccggaccgtacccggtccccgggg

SEQ ID NO: 235172 - DNA, 771 bp, Homo sapiens
  misc_feature: GYAE6OF01EK05Q.37.61.F06.1.454.CMB.1.raw
  modified_base (312)..(312): a, c, t, g, unknown or other
  misc_feature (312)..(312): n is a, c, g, or t
tcagtagtgtagatcacgaccggtgctcgatttagctacgctctaagggaaaggggaagactgacggtccccccaggagttcaggtgctgggcacggtgggcatgtgtgagtttttgtcacaagattttgggctcaactctcctgtgcagcctctggattcacctttaatacctattgatgagttggtccgccgaggttccgaggggaaggggcgtgggaggtgggtggaccaacaagtaaagcaaagagtggaagtagaagaaatactagtggtaggtactcgtgtaggaacgggccgtattcaccatccncagacgacaaccgcccaagaacctcattgtatctagaataaatagaaacagactgaaggacgaccggacggaacgcggtactaggttagttattacgtggtaggtacggaaggagggaacgggacggtaacgttaagtttaaggttaaggttaaacggtgggtacggttacgggtaccctttaccgtaaccgttaacttaaccgttaactaacgtaagtacggtaccggttacggtaacggggaaccgtaaacgggtacccgtaccgggtacccgtaacccgttcccgttacccgtaccgtaccgaccccgtaccccaaccccgggacccggtacccctaccgggttcccgttaccccgttcccccggtccggacccccttaccccgtaccccttaacccgaaccggtaacccgaccccgtaacccgttccggggaccgggaccgacccggtacccggg

SEQ ID NO: 235173 - DNA, 666 bp, Homo sapiens
  misc_feature: GYAE6OF01CB8ZM.37.61.F06.1.454.CMB.1.raw
  modified_base (166)..(166): a, c, t, g, unknown or other
  misc_feature (166)..(166): n is a, c, g, or t
  modified_base (189)..(189): a, c, t, g, unknown or other
  misc_feature (189)..(189): n is a, c, g, or t
  modified_base (367)..(367): a, c, t, g, unknown or other
  misc_feature (367)..(367): n is a, c, g, or t
  modified_base (394)..(394): a, c, t, g, unknown or other
  misc_feature (394)..(394): n is a, c, g, or t
  modified_base (404)..(404): a, c, t, g, unknown or other
  misc_feature (404)..(404): n is a, c, g, or t
  modified_base (414)..(414): a, c, t, g, unknown or other
  misc_feature (414)..(414): n is a, c, g, or t
  modified_base (534)..(534): a, c, t, g, unknown or other
  misc_feature (534)..(534): n is a, c, g, or t
  modified_base (601)..(601): a, c, t, g, unknown or other
  misc_feature (601)..(601): n is a, c, g, or t
  modified_base (612)..(612): a, c, t, g, unknown or other
  misc_feature (612)..(612): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctctgtgcagcctctggattcactttaanacctattggatgagttgggtccnccaggttccgagggagggctgggagtgggtcggccaagataaagcaagtatggaagtgaacgaaattactagttgcggaccttgtaggtaggaaccggggtcctaatttccacctaatccggtaccaaggacacaaccgcccagaaactcaattgaattcagacaatgaaacgtaacngagacgccgaggactacggcttaggtnttatacgtgnggacgaaggngaacggtaggcgtaattagtacgtaaagtggcgtgggttacccttataactacgttaactacctagagttaggacgttacgtaggggacgaaacgggaccctacgggacctaccgttccncccgttaccgacgcccgtaaccccaccgaacgggtcccctacgtcccggttcccctttcccccgggnggttccccccnccggtccgcccgtaaccgcgggaacaccccgttaccgtacccggcgaagccccg

SEQ ID NO: 235174 - DNA, 856 bp, Homo sapiens
  misc_feature: GYAE6OF01AMOML.37.61.F06.1.454.CMB.1.raw
tcagtagtgtagatcacgaccggtgctcgatttagctacgctctaagggaaaggggaagactgaccggtccccccaggagttcaggtgcgtgggcacgggtgggcatggtgtggtagtttttgcaacaagtatttgggctcaactctcctgtgcagcctctggtattcctaactttaatacctagttgattgtaggttcggtccgcgtacggttccgaaggggacgggctagggaggtggggtcgacctaagaataagacaaggagtaggaacgtagaagtaacgtactagtgtacgacgttgtggaggaacgggtcctataccacgtatcctacgaagacgaaccacccggtacccacgtaactcttaagttctaacgtcgtaccgtaaccgtaaagtaccgaagtacggaactggaaacggacgggacccgaacggaccgtacggtctttggtaggtttaactcggtaaggcggtaagacggggtagggaggtcgtaaagtacgttagggttaacggtacggtagggtccggtacgttaccctttaaccgtaacgtaaccgaagtttaacccgaggttaacggttaccgggtacggttcccggggaacggggtaacccgggtaaccgggttaaccgtaccgggttaccgtaaccccgggtccgttccgtaaaccccggttcccgaaacccgttccccggaaccgggtaacccgtaccggttcccggtttcccccgttaccccggttacccccggtaccgttaccccctaccccggtaccctaacccggtaactttcccccgggaaaccgttccgggtaacggggggtccccgaaccgtccgggtaaccccgggg

SEQ ID NO: 235175 - DNA, 725 bp, Homo sapiens
  misc_feature: GYAE6OF01EL3EZ.37.61.F06.1.454.CMB.1.raw
  modified_base (335)..(335): a, c, t, g, unknown or other
  misc_feature (335)..(335): n is a, c, g, or t
  modified_base (398)..(398): a, c, t, g, unknown or other
  misc_feature (398)..(398): n is a, c, g, or t
tcagtagtgtagatcacgaccggtgctcgatttagctacgctctaagggaaagggaagactgacggtccccccaggagttcaggtgctgggcacggtgggcatgtgtgagttttgtcacaagatttggctcaactctcctgtgcagcctctggattcactttaatacctattggatgagttggtccgcctaggtccgagggagggctggagtgggtggccaacataaagcaagagtaggaagtgaagtaaatactagtggtggacttcgtagtcggaagggtccagttcaacctagttcctaccgagacgaccaacgcccaagactcattgtacnctgacaagtcgaaactagctaggaacgacgtaccgaaggacacggcttggtactactttacgngtacggacgaagacggtaggaacggtacgtaagtttaggtagtaaagtcggtacggtacgggtcctttacgtaaccttaccgtaacttacctacgtaacgttggaccgttacggtacggggtaaccgaaccgggtaccaccgggtccctaacccggtcccgttaccgttaccgcctacccgtaccccgaccggtaacccgggtccctaaccgggttacccgttccccgtttacccccggtacggtccccgtaccccgttccccgacccgtaaaccggtaccgtccgttaccccgtaccggtccggggaccctacggtaaccccgggg

SEQ ID NO: 235176 - DNA, 634 bp, Homo sapiens
  misc_feature: GYAE6OF01AKGPX.37.61.F06.1.454.CMB.1.raw
  modified_base (313)..(313): a, c, t, g, unknown or other
  misc_feature (313)..(313): n is a, c, g, or t
  modified_base (367)..(367): a, c, t, g, unknown or other
  misc_feature (367)..(367): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttggtccgcaggttcagggagggctggaggtgggtgccaacataaacgcaagatggaagtgaagaatactagtgtggactcgtgtagacggcgaattccactatctcagacgacacgccagaactctattnatctgataaactgtaaaccagtactggacgacgcggacgacgtacggcgtggtnttacttcgtggttgcgagaggaggaggcgtagttagtagtaagtggtgtcgggtcttctactactactacgtactagtcgacgtcggtcgggaacgaacgggaccgacggtaccgtaccgtcctccgtacaccgtccctaccgaacccggacgggtaccctacgttcccggttcccgttcccccgttcggccccaccccgttaccccgtaccgtaacggtacccgtaccctaccccggtagggccggggtacgtaccggtacccggg

SEQ ID NO: 235177 - DNA, 902 bp, Homo sapiens
  misc_feature: GYAE6OF01B01BF.37.61.F06.1.454.CMB.1.raw
  modified_base (196)..(196): a, c, t, g, unknown or other
  misc_feature (196)..(196): n is a, c, g, or t
  modified_base (296)..(296): a, c, t, g, unknown or other
  misc_feature (296)..(296): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagtatttgggctcaactcctcctgtgcagcctctggattctactttaataccttattggatggagttcgggtccncgtaggttcgaggggagggctggagtggattcgggactatctctctatgtggagacctaacctactactaacccgtcctagaagagtcgagtcgacatanacgagtacgaccgacgtaccaaacgtacctagttcctaccgtagaacgtccgttaggtagtttccgtaggtaccggaccgtacccggcgaaccggtaaccggtacccgggtaccgtacgtttaacgttacgttcggtacggtaccggtaaggtacccggttccggtaccccgtaagttaccgtaacccgtacggtcccgtttaccggtttccccgttacccgtacccgttacgtttacggtttacctttttacgggttaacgtttaccgttacccgggggtttacggggaaacccggggttaaacgggttaaaccgttaaaccgggtttaccggttacccggtaaccccgtttacccgtttaccccgtttcccggtaaccggttaccccctaccccggtaaacccccgggaaccggggttcccccgttaaccgttccccgggtttaccccctttaaccccggtccgggtaacccctcccccgtttaacccgtacccgtaaaccggtaccggtacccttacccggttaccgggcccggggttaaccaaccgggtcccggtaacccggtcccgggttacgggtaccctcccgggttaccggtaacggg

SEQ ID NO: 235178 - DNA, 655 bp, Homo sapiens
  misc_feature: GYAE6OF01BC5A5.37.61.F06.1.454.CMB.1.raw
  modified_base (340)..(340): a, c, t, g, unknown or other
  misc_feature (340)..(340): n is a, c, g, or t
  modified_base (362)..(362): a, c, t, g, unknown or other
  misc_feature (362)..(362): n is a, c, g, or t
  modified_base (488)..(488): a, c, t, g, unknown or other
  misc_feature (488)..(488): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcaccttttggcagtctttgccatgagcgtgggtccgccaggctccggaaggggagggcgtaggaagtcgggtctcgagaccgtatttaggtagtaggtggtaggaacgcgtacgtaccgtacgcgtgaccgtccggtaggaacgggtccgttccgccctctaccagacacaactccaacacncgctcgtctctgactaactacncgcgtgagacgacgacgacgacgtacgtatatacgtgtaggacggaagggtacgtctaggcgtagtccgcgttacggtcctaccctactactagtacgtacggactgggacggtacgaacggtacncgtaccggtaccaccgtctccacaccgaccctacccgaccggaccggtaccctcggtccccgttcccgttccccgcgtacccctacccgtccctaacgaccggacctacccggccgttaccgggccgggaccacggtcccggacccggtccggtcggtccggtccgg

SEQ ID NO: 235179 - DNA, 760 bp, Homo sapiens
  misc_feature: GYAE6OF01BGZP7.37.61.F06.1.454.CMB.1.raw
  modified_base (124)..(124): a, c, t, g, unknown or other
  misc_feature (124)..(124): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagntttgggctcaactctcctgtgcagcctctggattcaaccttttaatacctagttaggatgaggtttcggggtcccgccgtacggtttccgaagggggaaggggcgtgggaggttggggtcggaccaaacgaataaaggacaaaggagtaggaacgtgaagaaatactagtggtggacttcgtggtaggaacgggtcctagttccaaccgacttcctaccgagacgaaccaccggacccaagaactctattggtaactcgtagaccaaatcgaaacgacgtagtacggaaggtacgaccggaacgggacgtaccgggtcgtaggttactacgtttactggtagacggtaggaggtaggacggtgttaagttagtacgtaagtcggtaccgttaggggttacccttacgttaacgttaccttaacgtaacgttaacgtagtacgggtacgtacgggtacgggaaccgtaacgggaccgtacggtacccgtaccgttccctcgtacccacgtaccctaccgaaccggtaccgaccctacgtcccggttccccgtccccgtcgacccccttacccgcccctaacccggacacccggttacccgacccgtaccgggtaccgggaccgtccgggtacccggg

SEQ ID NO: 235180 - DNA, 549 bp, Homo sapiens
  misc_feature: GYAE6OF02F8DS2.37.61.F06.1.454.CMB.1.raw
tcagtagtgtagatcacgaccggtgctcgatttagctacgctctaagggaaaggggaagactgacggtcccccaggagttcaggtgctgggcacggtgggcatgtgtgagttttgtcacaagatttgggctcaactctcctgtgcagcctctggattcacctttaatacctattggatgagttgggtccgccaggttccagggaaggggctggagtgggtggccaacataaagcaagatggaagtgagaaatactatgtggactctgtgaagggccgattcaccatctccagagacaacgcccagaactcattgtatctgcaaatgaacagactgagagccgaggacacggctgtgtatttactgtgcgagagaggaggcgaattagtgtaaatggctgggccttctactactactactacatggacgtcgtgggcaaagggaccacggtcaccgtctcctcacgcctccaccaacgggcccagtccggtccttccccgtcggccaccctccctcccaacgacgccaccctccgtcggggccacgacgg

SEQ ID NO: 235181 - DNA, 539 bp, Homo sapiens
  misc_feature: GYAE6OF02JEVAE.37.61.F06.1.454.CMB.1.raw
  modified_base (362)..(362): a, c, t, g, unknown or other
  misc_feature (362)..(362): n is a, c, g, or t
  modified_base (524)..(524): a, c, t, g, unknown or other
  misc_feature (524)..(524): n is a, c, g, or t
tcagtagtgtagatcacgaccggtgctcgatttagctacgctctaagggaaagggaagactgacggtcccccaggagttcaggtgctgggcacggtgggcatgtgtgagttttgtcacaagatttgggctcaactctcctgtgcagcctctggattcacctttaatacctattggatgagttgggtccgccaggttccagggaaggggctggagtgggtggccaacataaagcaagatggaagtgagaaatactatgtggactctgtgaagggccgattcaccatctccagagacaacgcccagaactcattgtatctgcaaatgaacagactgagagccgaggacacggctgtgtattacngtgcgagagaggaggcgattagtgtaaatggctgggccttctactactactactacatggacgtctggggcaaagggaccacggtcaccgtctcctcacgcctccaccaagggcccatccgtcttcccccgtggccaccctcctcccaacgacgccacctcncggggtccacgacgg

SEQ ID NO: 235182 - DNA, 433 bp, Homo sapiens
  misc_feature: GYAE6OF02GG32F.37.61.F06.1.454.CMB.1.raw
  modified_base (429)..(433): a, c, t, g, unknown or other
  misc_feature (429)..(433): n is a, c, g, or t
tcagtagtgtagatcacgaccggtgctcgatttagctacgctctaagggaaagggctggagtgggtggccaacataaagcaagatggaagtgagaaatactatgtggactctgtgaagggccgattcaccatctccagagacaacgcccagaactcattgtatctgcaaatgaacagactgagagccgaggacacggctgtgtatcactgtgcgaaccaagggggtttggagatgcagctggagggtgatggttttgatttatggggccaagggacaatggtcaccgtctcttcagcctccaccaagggcccatcggtcttcccctggcaccctcctccaagagcacctctgggggcacagcggcctgggctgcctggtcaaggactacttccatctacactactgagcgggctggcaaggcgcatagnnnnn

SEQ ID NO: 235183 - DNA, 541 bp, Homo sapiens
  misc_feature: GYAE6OF02JGLHI.37.61.F06.1.454.CMB.1.raw
  modified_base (363)..(363): a, c, t, g, unknown or other
  misc_feature (363)..(363): n is a, c, g, or t
tcagtagtgtagatcacgaccggtgctcgatttagctacgctctaagggaaagggaagactgacggtcccccaggagttcaggtgctgggcacggtgggcatgtgtgagttttgtcacaagatttgggctcaactctcctgtgcagcctctggattcacctttaatacctattggatgagttgggtccgccaggttccagggaaggggctggagtgggtggccaacataaagcaagatggaagtgagaaatactatgtggactctgtgaagggccgattcaccatctccagagacaacgcccagaactcattgtatctgcaaatgaaacagactgagagccgaggacacggctgtgtattacngtgcgagagaggaggcgaattagtgtaaatggcgtgggccttctactactactactacatggacgtctgggacaaagggaccacggtcaccgtctcctcacgcctccaccaacggcccatcggtcctccccgtcggccaccctccctccaacgacgccacctcgtcggggcacgacgg

SEQ ID NO: 235184 - DNA, 597 bp, Homo sapiens
  misc_feature: GYAE6OF02G3URE.37.61.F06.1.454.CMB.1.raw
  modified_base (406)..(406): a, c, t, g, unknown or other
  misc_feature (406)..(406): n is a, c, g, or t
  modified_base (514)..(514): a, c, t, g, unknown or other
  misc_feature (514)..(514): n is a, c, g, or t
tcagtagtgtagatcacgaccggtgctcgatttagctacgctctaagggaaaggggaaggactggacggtcccccacggtagtttcaggtgcttgggcacggtggggcagtgtgtgacgttttgtcacaagatttgggctcaactctcctgtgcagcctctggattcacctttaatacctattggatgagttgggttccgccaggttccagggaaggggtctggagtgggtgtaccaacataaagcaagatggaagtgagtaatactatggtgggactctggtcgaagggccgagttcaccatctccagacgaccaacggcccaagaaccttcgaattgtaactccttagactaaaatgaaacagactgaacgaggcccgaggacacggctaggtcgtaagtttcngtgcgtaagagagggagcgatttagtaggtaaatggtacgtagggtccttacgtactacttactaactactatcggacgtcgtggggacaaagggccagtccacgtcncctcagcctcaccaaggcccaatccgtccttccctggccctaccctcctaccgaagacgccacctcgtacggggccagaccgg

SEQ ID NO: 235185 - DNA, 670 bp, Homo sapiens
  misc_feature: GYAE6OF02G6K7K.37.61.F06.1.454.CMB.1.raw
tcagtagtgtagatcacgaccggtgctcgatttagctacgctctaagggaaagggggaagactgacggtcccccaggaggttcacggtgcctgggactaccggtgggctatgttggtgagttttgtcacaagatttagggctcaacgtctcctgtgcgagtccgtctggattcaccgttttaatacctattggtatggagttcgggtccgccaggttccaggggaaggggctggaggtggggtggccgaacggataaaagtcgaaacgatcggaaggtggacgaaatactatgtcggacttcgtgtgaacgggtccgcgttcacctatccttccagagactattaccaagagcacgtctcgtagtctcgacgaaagtgaacgaggtccgtggacgtgaccgaaggaacacggaccctaagtactttaagttacgtagacgtaaagtggtagggggagtgggggactaacggtccgtcggacgttttgacttacgtggggacagggacgcccgtggtacaaccgttctccgtcgacgtcctccgaaccaagggcccagtccggtccttaccccgaggccgaccctcgccgtccgtaggtcgtaccgtaccgtaccggaagaacggtaccgagacggtccgggtacccgtgggccgttcggcccgttacggg

SEQ ID NO: 235186 - DNA, 562 bp, Homo sapiens
  misc_feature: GYAE6OF02I8UUQ.37.61.F06.1.454.CMB.1.raw
  modified_base (364)..(364): a, c, t, g, unknown or other
  misc_feature (364)..(364): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccagggaaggggctggagtgggtggccaacataaagcaagatggaagtgagaaatactatgtggactctgtgaagggccgattcaccatctccagagacaacgcccagaactcattgtatctgcaaatgaacagactgagagccgaggacacggctgtgtattacngtgcgagagaggaggcgtaagttagtagtaaagtggcgtgggtccttctactactactactacagtgacgtcgtgggacgaaacgggaccacggtcaccgtctcctcgacgcctaccaccgaacggacccacgtccggtccttccccgtcggcccacccgtccaccgaacgacgccgaccgtcgtcggggcacgacgg

SEQ ID NO: 235187 - DNA, 540 bp, Homo sapiens
  misc_feature: GYAE6OF02I3CEK.37.61.F06.1.454.CMB.1.raw
  modified_base (517)..(517): a, c, t, g, unknown or other
  misc_feature (517)..(517): n is a, c, g, or t
tcagtagtgtagatcacgaccggtgctcgatttagctacgctctaagggaaaggggaagactgacggtccccccacggagttcaggtgctgggcacggtgggcatgtgtgagttttgtcacaagatttgggctcaactctcctgtgcagcctctggattcacctttaatacctattggatgagttgggtccgccaggttccagggaaggggctggagtgggtggccaacataaagcaagatggaagtgagaaatactatgtggactctgtgaagggccgattcaccatctccagagacaacgcccagaactcattgtatctgcaaatgaacagactgagagccgaggacacggctgtgtattactgtgcgagagaggaggcgattagtgtaaatggctggcttctactactactactacatgacgtcgtgggcaaagggaccacggtcaccgtcctcctcacgcctccaccaacggccactccgtccttccccgtcggccaccctcctccaacgacncaccctcgtcggggcaccgacgg

SEQ ID NO: 235188 - DNA, 558 bp, Homo sapiens
  misc_feature: GYAE6OF02I91LY.37.61.F06.1.454.CMB.1.raw
  modified_base (365)..(365): a, c, t, g, unknown or other
  misc_feature (365)..(365): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccagggaaggggctggagtgggtggccaacataaagcaagatggaagtgagaaatactatgtggactctgtgaagggccgattcaccatctccagagacaacgcccagaactcattgtatctgcaaatgaacagactgagagccgaggacacgggctgtgtattacnggtgcgagagaggaggcgattagtagtaaatggctgggccttctactactactactacatgacgtcgtgggcaagggaccacggtcaccgtctcctcacgcctccaccgaacggcccacgtccggtccttcccccgtcggtccctaccccgtccctcccaacgacgcctacccgtcgtcggggccacgaccgg

SEQ ID NO: 235189 - DNA, 565 bp, Homo sapiens
  misc_feature: GYAE6OF02ITMW7.37.61.F06.1.454.CMB.1.raw
  modified_base (369)..(369): a, c, t, g, unknown or other
  misc_feature (369)..(369): n is a, c, g, or t
  modified_base (385)..(385): a, c, t, g, unknown or other
  misc_feature (385)..(385): n is a, c, g, or t
  modified_base (405)..(405): a, c, t, g, unknown or other
  misc_feature (405)..(405): n is a, c, g, or t
tcagtagtgtagatcacgaccggtgctcgatttagctacgctctaagggaaaggggaagactgacggtcccccaggagttcaggtgctgggcacggtgggcatgtgtgagttttgtcacaagatttgggctcaactctcctgtgcagcctctggattcacctttaatacctattggatgagttgggtccgccaggttccaggggaaggggctggagtgggtggccaacataaagcaagatggaagtgagaaatactatgtggactctgtgaagggccgattcaccatctccagagacaacgcccagaactcattgtatctgcaaatgaaacagactgaagagccggaggacacgggctggtgtattacngtgacgtagagagggnggcgattagtagtaaatggntgggccttctactacttactactacattggacgttcgtggggacaaacgggaccgacggtcaccgtcgtcctcacgcctccaccgaacggcccacgtcggtccttccccgtcggccacccgtcctacccaagacgccaccgtccgtacggggcacgacgg

SEQ ID NO: 235190 - DNA, 569 bp, Homo sapiens
  misc_feature: GYAE6OF02F47I0.37.61.F06.1.454.CMB.1.raw
tcagtagtgtagatcacgaccggtgctcgatttagctacgctctaagggaaaggggaagactgacggtccacccaggagttcaggtgctgggcacggtgggcatgtgtgagttttgtcacaagatttgggctcaactctcctgtgcagcctctggattcacctttaatacctattggatgagttgggtccgccaggttccagggaagggctggagtgggtggccaacataaagcaagatggaagtgagaaatactatgtggactctgtgaaggccattcaccatctccagagacaacgcccagaactcattgatctgcaaatgaacagactgagagccgaggacacggctggtgtattactgtgcgagagaggaggcgattagtagtaaatggcgtgggccttctactactactactacatgacgtcgtgggacaaagggacccgacggtaccaccgtcctcctcacgccctccaaccaacgggcccacgtccggtccgttcccccgtcggtccctaccccgtccctacccgaacgaccgaccgtacccgtcggtccggggaccaccgg

SEQ ID NO: 235191 - DNA, 559 bp, Homo sapiens
  misc_feature: GYAE6OF02GTSEU.37.61.F06.1.454.CMB.1.raw
  modified_base (363)..(363): a, c, t, g, unknown or other
  misc_feature (363)..(363): n is a, c, g, or t
tcagtagtgtagatcacgaccggtgctcgatttagctacgctctaagggaaaggggaagactgacggccccccaggagttcaggtgctgggcacggtgggcatgtgtgagttttgtcacaagatttgggctcaactctcctgtgcagcctctggattcacctttaatacctattggatgagttgggtccgccaggttccagggaaggggctggagtgggtggccaacataaagcaagatggaagtgagaaatactatgtggactctgtgaagggccgattcaccatctccagagacaacgcccagaactcattgtatctgcaaatgaacagactgagagccgaggacacggctgtgtattacngtgcgagagagggaggcgattagtagtaaagtggcgtgggccttctactactactactacatgacgtcgtgggacgaacgggaccgacggtccaccgtctcctcacgcctccaccgaacggcccagtccgtccttccccgtcggccctacccctccctacccaacgacgccacccgtccggtcggggccacgacgg

SEQ ID NO: 235192 - DNA, 630 bp, Homo sapiens
  misc_feature: GYAE6OF02GETSR.37.61.F06.1.454.CMB.1.raw
  modified_base (265)..(265): a, c, t, g, unknown or other
  misc_feature (265)..(265): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccagggagggctggagtgggtggccaacataaagcaagatggaagtgagaaatactatgtggactcngtgaaggccgattcaccatctccagagacaacgcccagaactcattgtatctgacaaatgaacagactgagagccgaggacacggctgtgtattacgtgtgcgagaggaggaggcgaagtttagtagtaaagtggtcgtcgggtccttacgtactacgtaacttactactagtacggtacgtcggttacgggacgaaacgggaccgaaccggtccgtacccgttccgtaccctaccgaccgtaccctacccgaaccgaaccgggacccaccgttacccggttcccgttcccccgtcggtacccctacccctcccctacccgtaacgaccgaccgtacccgtccggtacggggccaccggtaccgg

SEQ ID NO: 235193 - DNA, 575 bp, Homo sapiens
  misc_feature: GYAE6OF02IK3UR.37.61.F06.1.454.CMB.1.raw
  modified_base (351)..(351): a, c, t, g, unknown or other
  misc_feature (351)..(351): n is a, c, g, or t
tcagtagtgtagatcacgaccggtgctcgatttagctacgctctaaggaagggaggactggacggtaccccgaggagttcaggtgctgggcacggtgggcatgtgtgagttttgtcacaagattttgggctcaactctcctgtgcagcctctggattcaccttttaatacctattggatgagttgggtccgccaggttccagggaagggctggagtgggtgccaacataaagcaagatggaagtgagaaatactatgtggactctgtgaaggccgattcaccatctccagagacaacgcccaagaactcattgtatctagacaatgaacagactgagagccgagacacggntgtgtattatgtgcgagagaggaggcgtattagtagtaagtggcgtgggtcttctactactactactacatggacgtcgtagggcgaaacgggaccgacggtacgaccgtcgtcctcacgccctccacccgaacgggaccctacgtccggttacccttcccccgtcggcccaccccttccctaccgaaacgacgcctacccgtccggtacggggccacgaccgg

SEQ ID NO: 235194 - DNA, 572 bp, Homo sapiens
  misc_feature: GYAE6OF02HHQDN.37.61.F06.1.454.CMB.1.raw
  modified_base (290)..(290): a, c, t, g, unknown or other
  misc_feature (290)..(290): n is a, c, g, or t
  modified_base (367)..(367): a, c, t, g, unknown or other
  misc_feature (367)..(367): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccaggggaaggggctggagtgggtggccaacataaagcaagatggaagtgaagaaatactatgtggactctgtgaaggccgattcaccatcnccagagacaacgcccagaactcattgtatctgacaaatgaacagactgagagccgaggacacggctgtgtatttacngtgcgagagagggagcgatttagtagtaagtggtcgtggtcttctactactactactactatcggacgtcgtgggacgaaagggaccgacggtaccgaccgtcgtcctcgacgcctccaccgaacgggcccacgtccgtccttcccccgtcggcctacccctcccgtacccaacgacgccaccgtccggtcggggccacgaccgg

SEQ ID NO: 235195 - DNA, 640 bp, Homo sapiens
  misc_feature: GYAE6OF02JBDPW.37.61.F06.1.454.CMB.1.raw
  modified_base (296)..(296): a, c, t, g, unknown or other
  misc_feature (296)..(296): n is a, c, g, or t
  modified_base (320)..(320): a, c, t, g, unknown or other
  misc_feature (320)..(320): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccagggaaggggctggagtgggtggccaacataaagcaaagatggaagtgaagaaatactatgtggactctgtgaagggccgattcaccatctcaganacaacgcccagaactcattgatcngacaaatgaaacagactgagagccgaaggacacggctgtcgtattacgtggtgacgagaggaggagggcgaagtttaaggtagttaaaagtggtacgtcgggtccttacgtaacgttaacttaacctaacttacgaagttacggaccgttacgtcggggacaaacgggtaaccgacgggtcctaacccgtcgtacctaccgacgcccttacccgaccgaacggacccgacgtaccggttaccttccccccgtcggtaccctccccgtacctacccgaacgtaccgaccacccgtaccggtcggggtaccaccgtaccggg

SEQ ID NO: 235196 - DNA, 567 bp, Homo sapiens
  misc_feature: GYAE6OF02FMERV.37.61.F06.1.454.CMB.1.raw
  modified_base (338)..(338): a, c, t, g, unknown or other
  misc_feature (338)..(338): n is a, c, g, or t
  modified_base (402)..(402): a, c, t, g, unknown or other
  misc_feature (402)..(402): n is a, c, g, or t
tcagtagtgtagatcacgaccggtgctcgatttagctacgctctaagggaaaggggaagactgacggtccccccaggagttcaggtgctgggcacggcgggcatgtgtgagttttgtcacaagatttgggctcaactctcctgtgcagcctctggattcacctttaatacctattggatgagttgggtccgccaggttccagggaaggggctggagtgggtggccaacataaagcaagatggaagtgagaaatactatgtggactctgtgaagggccgattcacatctccagagacaacgcccagaactcattgtatctgcaaatgaacagactgagngccgaggacacgggctggtgtattactggtgacgagaggaggaggcgagttagtagtaaatggngtgggtcttctactactactactacatggacgtcgtggggacgaacgggaccgacggtcaccgtctcctcacgcctccaccgaacgggcccacgtccgtccttcccccgtcggccctacccctccctacccgaacgacgccaccgtcgtcggggaccacgaccgg

SEQ ID NO: 235197 - DNA, 572 bp, Homo sapiens
  misc_feature: GYAE6OF02G9B38.37.61.F06.1.454.CMB.1.raw
  modified_base (371)..(371): a, c, t, g, unknown or other
  misc_feature (371)..(371): n is a, c, g, or t
  modified_base (383)..(383): a, c, t, g, unknown or other
  misc_feature (383)..(383): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagattttgggctcaactctcctgtgcagcctctggattcacctttaatacctattggatgagttgggtccgccaggttccagggaaggggctggagtgggtggccaaacataaaagcaaagatggaagtgaagaaatactatgtggactctgtgaagggccgattcaccatctccagagacaacgcccagaactcattgtatctgcaaatgaaacagactgagagccgaggacacgggctgtgtattacngtgcagagaggnggcattagtagtaaatggctgggccttctactactactactacatgacgtcgtagggacgaaagggaccgacggtcaccgttcctccgtcacgccctacccgaccgaacgggcccacgtccggtccttcccccgtcggccctacccgtccctacccgaagacgaccacccttcgtcggggccacgacgg

SEQ ID NO: 235198 - DNA, 574 bp, Homo sapiens
  misc_feature: GYAE6OF02FLQQA.37.61.F06.1.454.CMB.1.raw
  modified_base (257)..(257): a, c, t, g, unknown or other
  misc_feature (257)..(257): n is a, c, g, or t
  modified_base (399)..(399): a, c, t, g, unknown or other
  misc_feature (399)..(399): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccagggaggggctggagtgggtggccaacataaagcaagatggaagtgagaaatactangtttggactctgtgaagggccgattcaccatctccagagacaacgcccagaactcattgtatctgcaaatgaacagactgagagccgaggacacggctgttatacttagtgcgagagaggagggagagtagtagtaagtagnggtcggcggttcttactactactactactatagtgtcgtacggcgggaacgaaccggaccgacgtaccgtaccgtcctccacaccgtccaccgaaccggaccgacctacgtccgttcccctcccgtccgaccctccctccacgacgcgccctaccgtcgggccggacaccgccgg

SEQ ID NO: 235199 - DNA, 616 bp, Homo sapiens
  misc_feature: GYAE6OF02G0OU9.37.61.F06.1.454.CMB.1.raw
  modified_base (376)..(376): a, c, t, g, unknown or other
  misc_feature (376)..(376): n is a, c, g, or t
  modified_base (409)..(409): a, c, t, g, unknown or other
  misc_feature (409)..(409): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccagggaagggctggagtgggtggccaacataaaagcaagatggaagtgagaaatactatggtggactcgtgtagaagggccattcaaccatcctccagacgacaacgcccaagaactcattgtatctgacaaatgaaacagactagagacgcgaggacacgggctgtagtattacgngtgacgagagaggaggcgtatagtagtaagtgngtggtccttactactactactactacagtcggtacgtcgtagggacgaaacggaccgacgggtaccgacccgtcctaccgtcgaccgtaccctacccgaaccgaaccggtacccgaccgttaccgggttccccttcccccgtaccggccctacccctaccccgtaccgacgacgcccgtaccctccgggcgggaccacggtaccggg

SEQ ID NO: 235200 - DNA, 579 bp, Homo sapiens
  misc_feature: GYAE6OF02FN5EX.37.61.F06.1.454.CMB.1.raw
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccagggaaggggctggagtgggtggccaacataaaagcaaagatggaagtgagaaatactatgtggactctgtgaagggccgattcaccatctccagagacaacgcccagaactcattgtatctgacaaatgaacagactgagagccgaggacacggctgtgtatttactggtgcgagagaggaggcgaagttagtagtaaagtggcgtgggtccttactacttactaacctactactagttggacgttcgtggggacgaaagggaccgacggtccaccgtctcctcacgcctccaccgaacgggcccagtccgtccgttccccgtcggccctaccccgtccctaccaacgacgccacccgtcggtcggggccacgaccgg

SEQ ID NO: 235201 - DNA, 543 bp, Homo sapiens
  misc_feature: GYAE6OF02IUBRF.37.61.F06.1.454.CMB.1.raw
  modified_base (191)..(191): a, c, t, g, unknown or other
  misc_feature (191)..(191): n is a, c, g, or t
  modified_base (472)..(472): a, c, t, g, unknown or other
  misc_feature (472)..(472): n is a, c, g, or t
  modified_base (509)..(509): a, c, t, g, unknown or other
  misc_feature (509)..(509): n is a, c, g, or t
  modified_base (515)..(515): a, c, t, g, unknown or other
  misc_feature (515)..(515): n is a, c, g, or t
  modified_base (527)..(527): a, c, t, g, unknown or other
  misc_feature (527)..(527): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccnccaggttccagggaggggctggagtgggtggccaacataaagcaagatggaagtgagaaatactatgtggactctgtgaagggccgattcaccatctccagagacaacgccagaactcattgtatctgacaaatgaaacagactgagagccgaggacacggctaggtgttattactgtgacgagagaggaggcgtagttagtagtaatggcgtgggtcttctactactactactacatagacgtcgtgggacgacgggaccgacggtcgacccgtctctcncgccgccaccgacggccactcgtacctcccgtcgccncctccnccaacgacgacncctcgcgggcagacgg

SEQ ID NO: 235202 - DNA, 573 bp, Homo sapiens
  misc_feature: GYAE6OF02HSBLU.37.61.F06.1.454.CMB.1.raw
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccaggggaaggggctgggagtgggtggccaacataaagcaagatggaagtgaagaaatactatgtggactctgtgaagggccgattcacatctcagagacaacgcccagaactcattgtatctgacaaatgaacagactgagagaccgaggacacggctgtgtattacngtgacgngaggaggaggctagttagtagtaaagtggtacgtcggtccttctactactactactacatacggacgtcgtagggacgaaacggaccgacggtccaccgtctcctcgacgcctaccaccgaacggaccctacgtccgttccttccccgtcgtcccaccctccctacccgacgacgccaccgtcggtcggggacacgcgg

SEQ ID NO: 235203 - DNA, 582 bp, Homo sapiens
  misc_feature: GYAE6OF02F1DIW.37.61.F06.1.454.CMB.1.raw
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcaccttttaatacctattggatgagttgggtccgccaggttccagggaaggggctggagtgggtgccaacataaagcaagatggaatgagaaatactatgtggactctgtgaagggccgattcaccatctccagagacaacgaccaaaaactcactgtatctgcaaatggacggcctgagatccgaggacacggctgtgtattattgtgcgagagtatttagactacgaaagtttcgagtgactggtatgatgcttatgataccgtggggaccaagggaccagtgtcaccgtctcttacacgcctccaccgaacgggtccacgttaccggtcccttacccccgtcgggcccgtccccgttaggcccttacccgaggtaccgaccgaccctacccggagtaccgacgtacccgacggtccccggg

SEQ ID NO: 235204 - DNA, 648 bp, Homo sapiens
  misc_feature: GYAE6OF02H66KO.37.61.F06.1.454.CMB.1.raw
  modified_base (266)..(266): a, c, t, g, unknown or other
  misc_feature (266)..(266): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccagggaaggggctggagtgggtgccaacataaagcaagatggaagtgaagaaatactatgtggactntgtgaaggccgattcacatctcagagacaacgcccagaactcattgtatctagcaaatagaacagactagagagccgaggactacggctgtagtattcgtgtgcgaagagaggaggacgagttaagtagtaagtaggcgttgggtccttactacgttaaccttaactaacttaacagttacggtacgttacggtacgggtacgaaacgggaccgtaacggttcccgaacccgttacccgtaccctcgaccgtaccctacccgaacccgaacgggtaccccacgttacccggttcccgttacccccgtcggtccctacccgtccccttacccgaacgtaccgacccgtacccgttaccggtacggggtacccacgtacccggg

SEQ ID NO: 235205 - DNA, 555 bp, Homo sapiens
  misc_feature: GYAE6OF02F5E2U.37.61.F06.1.454.CMB.1.raw
  modified_base (364)..(364): a, c, t, g, unknown or other
  misc_feature (364)..(364): n is a, c, g, or t
  modified_base (388)..(388): a, c, t, g, unknown or other
  misc_feature (388)..(388): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagattttgggctcaactctcctgtgcagcctctggattcaccttttaatacctattggatgagttgggtccgccaggttccagggaagggggtggagtgggtggccaacataaagcaagatggaagtgagaaatactatgtggactctgtgaaggccgattcaccatctcagagacaacgcccagaactcattgatctgcaaatgaacagactgagacgccgaggacacggctgtgtattacngtgcgagagaggaggcgatttagngtaagtggcgtggtcttctactactactactacagtggacgtcgtgggacgaagggaccacggtcaccgtctcctcacgccctaccaccgaacggcccacgtccgtccttccccgtcggccaccctccctccaacgacgcctaccgtccgtcggggcacgacgccgg

SEQ ID NO: 235206 - DNA, 677 bp, Homo sapiens
  misc_feature: GYAE6OF02IAYS7.37.61.F06.1.454.CMB.1.raw
  modified_base (270)..(270): a, c, t, g, unknown or other
  misc_feature (270)..(270): n is a, c, g, or t
  modified_base (350)..(350): a, c, t, g, unknown or other
  misc_feature (350)..(350): n is a, c, g, or t
tcagtagtgtagatcacgaccggtgctcgatttagctacgctctaagggaaagggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccagggaaggggctgggagtggggtggccaacataaaagcaagatgggaagtgaagaaatactatgtggactntgtgaaggccgattcacatctcagagacaacgcccagaactcatttgatctgcaaatgaacagactgagagccgaggacncggtctgtgtattacgtggtgcgaagagagggaggcgtagttaagtaggtaaagtgggtcgtcgggtcctttacgtacctaacttaaccttacgtactagttacggtacgtacggtgggaacgaaacgggacccgtaacgggtcccaccggttccgtcccgtaccgaccgtcccctacccgaaacccggaacccgggtacccctaacggttcccggttaccccgtttccccccggtacgggtaccccctacccccgttccccgtacccgaaccggtaccgacccgtacccgttcccgggtaccggggtaccccacggtaacccgggg

SEQ ID NO: 235207 - DNA, 563 bp, Homo sapiens
  misc_feature: GYAE6OF02FON30.37.61.F06.1.454.CMB.1.raw
  modified_base (477)..(477): a, c, t, g, unknown or other
  misc_feature (477)..(477): n is a, c, g, or t
tcagtagtgtagatcacgaccggtgctcgatttagctacgctctaagggaaaggggaagactgacggtcccccaggagttcaggtgctgggcacggtgggcatgtgtgagttttgtcacaagatttgggctcaactctcctgtgcagcctctggattcacctttaatacctattggatgagttgggtccgccaggttccagggaaggggctggagtgggtggccaaacataaaagcaagatgggaagtgagaaatactatgtggactctgtgaagggccgattcaccatctccagagacaacgcccagaactcattgtatctgcaaatgaacagactgagagcgagacacggctgtgtattacgtgtgcgagagagggaggcgattagtagtaaatggcgtgggtccttctactactactactactatggacgttcgtggggacgaaagggaccgacggtcgaccgtctcctcgacncctccaccgaacggcccagtccggtccttccccgtcgcccaccctccctaccgacgacgtccaccgtcgtcggggtcaccgacggg

SEQ ID NO: 235208 - DNA, 588 bp, Homo sapiens
  misc_feature: GYAE6OF02IKWDR.37.61.F06.1.454.CMB.1.raw
  modified_base (326)..(326): a, c, t, g, unknown or other
  misc_feature (326)..(326): n is a, c, g, or t
  modified_base (371)..(371): a, c, t, g, unknown or other
  misc_feature (371)..(371): n is a, c, g, or t
  modified_base (384)..(384): a, c, t, g, unknown or other
  misc_feature (384)..(384): n is a, c, g, or t
  modified_base (386)..(386): a, c, t, g, unknown or other
  misc_feature (386)..(386): n is a, c, g, or t
  modified_base (414)..(414): a, c, t, g, unknown or other
  misc_feature (414)..(414): n is a, c, g, or t
  modified_base (430)..(430): a, c, t, g, unknown or other
  misc_feature (430)..(430): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccaggggaaggggctggagtgggtggccaacataaagcaagatggaagtgaagaaatactatgtggactctgtgaagggccgattccaccatctccagagacaaccgcccagaactcatttgtatctnacaaatgaacagactgagagaccgaggacacggctgtgtattacngtgcgagagaggngngtattagtagtaaagtggcgtggccttntaactactactactanagttgacgtcgcgggacgaaggccgaggtccacgtcctcctacacgtaccctccgaccgaaccgggccctacgtcccggtacccttcccccgcggtaccctacccctacccttaccgaaacgtccgacctacccgtccggtcgggcccacgacccggg

SEQ ID NO: 235209 - DNA, 543 bp, Homo sapiens
  misc_feature: GYAE6OF02FIDS9.37.61.F06.1.454.CMB.1.raw
  modified_base (509)..(509): a, c, t, g, unknown or other
  misc_feature (509)..(509): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccaggggaaggggctggagtgggtggccaacataaagcaagatggaagtgagaatactatgtggactctgtgaagggccgattcaccatctccagagacacgcccagaactcattgtatctgacaaatgaacagactgagagccgagacacggctgtgtatactgtgcgagagaggaggcagttagtagtaagtggtcgtcgggtcttctactactactactacatggacgtcgtggggacgaacgggaccgacggtcaccgtcctcctcacgcctccaccgacggcccacgtccgtcctccccgtcgccnccctcctccacgacgcacctcgtcgggcacgcgg

SEQ ID NO: 235210 - DNA, 593 bp, Homo sapiens
  misc_feature: GYAE6OF02I0JVM.37.61.F06.1.454.CMB.1.raw
  modified_base (362)..(362): a, c, t, g, unknown or other
  misc_feature (362)..(362): n is a, c, g, or t
tcagtagtgtagatcacgaccggtgctcgatttagctacgctctaagggaaaggggaagactgacggtcccccaggagttcaggtgctgggcacggtgggcatgtgtgagttttgtcacaagatttgggctcaactctcctgtgcagcctctggattcacctttaatacctattggatgagttgggtccgccaggttccagggaaggggctggagtgggtggccaacataaagcaagatggaagtgagaatactatgtggactctgtgaagggccgattcaccatctccagagacaacgcccagaactcattgtatctgcaaatgaacagactgagagcgaggacacggctgtgtatttacngtgcgagagaggaggcgtattagtagtaaagtggcgtcggcttactactactactacctactatggacgtcgtgggacgaacgggaccgacggtctaccgtcctcctcgacgcctaccaccgaacgggcccacgttccggtacccttccccgtacggtcccctaaccccgtcccgttacccgaaccgacggtccctaacccgttccggtacggggtaccaccggtaccggg

SEQ ID NO: 235211 - DNA, 601 bp, Homo sapiens
  misc_feature: GYAE6OF02GICLO.37.61.F06.1.454.CMB.1.raw
tcagtagtgtagatcacgaccggtgctcgatttagctacgctctaagggaaaggggaagactgacggtccccccaggagttcaggtgctgggcacggtgggcatgtgtgagttttgtcacaagattttgggctcaactctcctgtgcagcctctggattcacctttaatacctattggatgagttgggtccgccaggttccagggaaggggctggagtgggtggccaacataaagcaagatggaagtgagaaatactatgtggactctgtgaagggccgattcaccatctccacagacaacgccaaagaaatcaattctttttgacaaatagaacagtctgagagtcgagacacgccatgtattactagtacgagaagaacagacgttgggccgacgggaaccctggtaccaccgtctcctcagccctccgaccgaacgggcccacgttccggtcccttccccgtcggccgtccctcgcctccgaggacgccaccctccggaacggcaccacaacggcccggcccgtgggacctcggcccgtagggtaccgaacggtaccttaccttacccattacctaacccgacgttacgagtaccggg

SEQ ID NO: 235212 - DNA, 554 bp, Homo sapiens
  misc_feature: GYAE6OF02F4NR1.37.61.F06.1.454.CMB.1.raw
  modified_base (191)..(191): a, c, t, g, unknown or other
  misc_feature (191)..(191): n is a, c, g, or t
  modified_base (293)..(293): a, c, t, g, unknown or other
  misc_feature (293)..(293): n is a, c, g, or t
  modified_base (355)..(355): a, c, t, g, unknown or other
  misc_feature (355)..(355): n is a, c, g, or t
  modified_base (470)..(470): a, c, t, g, unknown or other
  misc_feature (470)..(470): n is a, c, g, or t
  modified_base (511)..(511): a, c, t, g, unknown or other
  misc_feature (511)..(511): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccnccaggttccagggagggctggagtgggtggaccaacataaagcaagatggaagtgaagaaatactatgtggactctgtgaggccgattcaccatctccaganacaaccgcccagaactcattgtatctgacaaatgaacagactgagagcgagacacggctgtntattatgtgcgagagaggagctagttagtagtaagtggacgtggtccttctactactactactactagtcgacgtcgtgggacaaacgggaccacggtaccgaccgtctccgtcncgccctccaccgacgaccacgtccgtccctcccgtcgcccnccctccctaccacgacgcctacccgtcgtcgggcaccgaccgg

SEQ ID NO: 235213 - DNA, 588 bp, Homo sapiens
  misc_feature: GYAE6OF02GQ2CI.37.61.F06.1.454.CMB.1.raw
  modified_base (364)..(364): a, c, t, g, unknown or other
  misc_feature (364)..(364): n is a, c, g, or t
  modified_base (380)..(380): a, c, t, g, unknown or other
  misc_feature (380)..(380): n is a, c, g, or t
  modified_base (412)..(412): a, c, t, g, unknown or other
  misc_feature (412)..(412): n is a, c, g, or t
  modified_base (484)..(484): a, c, t, g, unknown or other
  misc_feature (484)..(484): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccagggaaggggctgggagtgggtggccaacataaagcaaagatggaagtgaagaaatactatgtggactctgtagaaggccgattcaccatctccagagacaacgcccagaactcattgtatctgacaaatgaaacagactggaagagccgaggacacggctgtntattactgtgcgaagnggagggaggcgtaagttaggtagtaaagtggngtggtccttctactactactactacagttagcgtcgtgggacgaaacgggaccgacggtccaccgtcctccnccgacgccctaccaccgaacggcccacgttcccggtccttccccgtcggcccctaccctcccgtaccgaacgacgaccctaccgttcggcggggccagacccgg

SEQ ID NO: 235214 - DNA, 485 bp, Homo sapiens
  misc_feature: GYAE6OF02G90NN.37.61.F06.1.454.CMB.1.raw
  modified_base (470)..(485): a, c, t, g, unknown or other
  misc_feature (470)..(485): n is a, c, g, or t
tcagtagtgtagatcacgaccggtgctcgatttagctacgctctaagggaaaggggctggagtgggtggccaacataaagcaagatggaagtgagaaatactatgtggactctgtgaagggccgattcaccatctccagagacaacgcccagaactcattgtatctgcaaatgaacagactgagagccgaggacacggctgtgtattactgtgcgagagaggaggcgattagtgtaaatggctgggccttctactactactactacatggacgtcgtggggcaaagggaccacggtcaccgtctcctcagcctccaccaacggccatcggtccttccccctggccaccctccctccaagacgccacctcgtgggggcacgagccggccctggggctggcctggtcgaacggtactacttaccgactctacctactacctggacgcgggctcggacgaaggccgcatacgnnnnnnnnnnnnnnnn

SEQ ID NO: 235215 - DNA, 747 bp, Homo sapiens
  misc_feature: GYAE6OF02JNN5A.37.61.F06.1.454.CMB.1.raw
  modified_base (294)..(294): a, c, t, g, unknown or other
  misc_feature (294)..(294): n is a, c, g, or t
tcagtagtgtagatcacgaccggtgctcgatttagctacgctctaagggaaaggggaagactgacggtcccccaggagttcaggtgctgggcacggtgggcatgtgtgagttttgtcacaagatttgggctcaactctcctgtgcagcctctggattcacctttaatacctattggatgagttgggtccgcctaggttccagggaaggggctggagtgggtggccaacataaagcaaagatggataggaagaaatactatgtggactctgtagaaggccattcgaccaattccngtacagaacgacctaacggaccctaagaaccttacgaacttgtaacgtcgtaagtactaaaagtacaaacgagaacgttaggaacggtaacggaccggtaacggtaccgacgggtccttaaggttaccgttaagttaccgtacggtagacggtaaagttaacgttagtttaaaccgaaacgtttaacgtaaacggtttacggtacgttagtaacgttaggttaggtacgtattaggttactagtacgttaacggtccgtaacggggtaccgaaacggtactaggtaccggtaccgtacccgttacgtaccgttaccgaccgtacccgtaccgaaaccggtacccggtaccgttccgttaccccggtccgttaccccggtaccgtcccacccggttaccgacggtaccgacggtaacccgtccgaacccgtacggtaccggaaccgtaacccgg

SEQ ID NO: 235216 - DNA, 617 bp, Homo sapiens
  misc_feature: GYAE6OF02HR8F7.37.61.F06.1.454.CMB.1.raw
  modified_base (274)..(274): a, c, t, g, unknown or other
  misc_feature (274)..(274): n is a, c, g, or t
  modified_base (298)..(298): a, c, t, g, unknown or other
  misc_feature (298)..(298): n is a, c, g, or t
  modified_base (372)..(372): a, c, t, g, unknown or other
  misc_feature (372)..(372): n is a, c, g, or t
  modified_base (529)..(529): a, c, t, g, unknown or other
  misc_feature (529)..(529): n is a, c, g, or t
tcagtagtgtagatcacgaccggtgctcgatttagctacgctctaagggaaaggggaagactgacggtccccccaggagttcaggtgctgggcacggtgtgcatgtgtgagtttttgtcacaagatttgggctcaactctcctgtgcagcctctggattcacctttggcagctttgccatgagctgggtccgccaggctccgagggaaggggctggagtgggtctcgaggttattacgtggtagtggtaactaccgcatacacgcagactccgngacgggccgttcaccgtctcaganacaacttccaagaactacggtactagtcgtagaaaatcgaaacagcctgagacgccggaagaccaacggccctnttaattcgtgtagcgagagactcaggacggatagtagacgagcacgctactgtacgtacgtacgggaccgaacggtaacttccgtcgtaccaccgtctcctaccgacacccgtacccaaccgaccggccacgttccgttcccttccccgcgtacccncccttaccacctaacggccgacctacccgtaccggtaccggggactacggaccggacccgggtccccggtcgggtccgtcggtcccgg

SEQ ID NO: 235217 - DNA, 672 bp, Homo sapiens
  misc_feature: GYAE6OF02J2AN9.37.61.F06.1.454.CMB.1.raw
  modified_base (189)..(189): a, c, t, g, unknown or other
  misc_feature (189)..(189): n is a, c, g, or t
  modified_base (226)..(226): a, c, t, g, unknown or other
  misc_feature (226)..(226): n is a, c, g, or t
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
  modified_base (308)..(308): a, c, t, g, unknown or other
  misc_feature (308)..(308): n is a, c, g, or t
tcagtagtgtagatcacgaccggtgctcgatttagctacgctctaagggaaaggggaagactgacggtcccccaggagttcaggtgctgggcacggtgggcatgtgtgagttttgtcacaagatttgggctcaactctcctgtgcagcctctggattcacctttaatacctattggatgagttggtccnccaggttccagggagggctggagtgggtggccaacanaaagcaaagntggaagtnagaaatactatgtggactctgtgagggccgattcaccatcctccagagacaacgcccagtaacncatgtatctgacaatcgaacagactggagagaccgaggacacgggcttggtgtagtttacctggtcgcgtagaggaggtacggcgtaatttagtagtaagtggtacgttacgggtccttacgtaccttaccttaactacgttaacagtacgtacgtcgtacgggtacgaacgggaccgtacgggtaccgtacccgtaccgtacccgttaccgacgtaccgtacccgtacccggaaccgggccccgtaacgtcccggtacccgttttcccccggtaccgggtacccctaaccccgtccccgttacccgaaccggtacgacccgtaaccgtcccggttaacccgggggtcctacccggaacccggg

SEQ ID NO: 235218 - DNA, 591 bp, Homo sapiens
  misc_feature: GYAE6OF02IWCLG.37.61.F06.1.454.CMB.1.raw
  modified_base (298)..(298): a, c, t, g, unknown or other
  misc_feature (298)..(298): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccaggggaaggggctggagtgggtggccaacataaaagcaagatggaagtgaagaaatactatgtggaactctgtgaagggccgattcaccatctccagngacaacgcccagaactcattgtatctgcaaatgaaacagactgagagccgaaggacacggctgtntattacngtgcgagaggaggaggcgtaagttagtagtaaagtggcgtcgggtcttactaacgtacctactaactactagtaggacgtcgtgggacgaaacgggaccacggtcgaccgtctcctcacgcctacccaccgaacggacccacgtccggttccttccccgtcggacccaccccgtaccctaccgaacgacggacctaccgtcgtcggggacctacgacccgg

SEQ ID NO: 235219 - DNA, 574 bp, Homo sapiens
  misc_feature: GYAE6OF02GN0QA.37.61.F06.1.454.CMB.1.raw
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
  modified_base (546)..(546): a, c, t, g, unknown or other
  misc_feature (546)..(546): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccagggaagggctggagtgggtggccaacataaagcaagataggaagtgaagaaatactatgtggactctgtgaaggccattcacatcncaganacacgccagaactcattgtatctgacaaatgaacagactgagacgcgaggacacggctgtagtattacgtgtcgacgagagagggaggacgtaagttagtagtaaagtggcgtcggtccttctactactactactacagtcggtacgtcgtacgggacgaaacgggaccgacggtaccaccgtcctcctcacgcctaccaccgaacggcccacgtccgtcccttccccgtcgccctaccctcccaccaacgacncctacccgtcggtacgggccacgaccgg

SEQ ID NO: 235220 - DNA, 584 bp, Homo sapiens
  misc_feature: GYAE6OF02FQUU7.37.61.F06.1.454.CMB.1.raw
  modified_base (359)..(359): a, c, t, g, unknown or other
  misc_feature (359)..(359): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccagggaaggggctggagtgggtggccaacataaagcaagatggaagtgagaaatactatgtggactctggtgaagggccgattcaccatctccagagacaacgcccagaactcattgatctgcaaatgaaacagactgagacgccgaggacacgggctgngttaatactgtgcgagagaggaggcgtagttacgtagtaaagtggcgtgggtccttcgtactactactactacagtggactcgtgggacgtaaagggaccgacggtcctaccgtccgtacctcgacgccctccaaccgaaccgggcccacgtccgtccttccccgtcggaccctaccctccgttacccaagaccgccgtaccgtccggcggggacaccgaccggg

SEQ ID NO: 235221 - DNA, 724 bp, Homo sapiens
  misc_feature: GYAE6OF02HM1SQ.37.61.F06.1.454.CMB.1.raw
  modified_base (228)..(228): a, c, t, g, unknown or other
  misc_feature (228)..(228): n is a, c, g, or t
  modified_base (291)..(291): a, c, t, g, unknown or other
  misc_feature (291)..(291): n is a, c, g, or t
  modified_base (368)..(368): a, c, t, g, unknown or other
  misc_feature (368)..(368): n is a, c, g, or t
  modified_base (388)..(388): a, c, t, g, unknown or other
  misc_feature (388)..(388): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggtccagggaaggggctggagtgggtggccaaanataaaagcaagatggaagtgaagaaatactatgtggactctgtgaaagggccattcaccatcnccagagacaacgcccaagaactcaattgtatctgacaaaatgaaacagactagaagaggaccgaaggaccacgggtntacggtagtaactttaacgngtacgagaaggaggaagggacggacgtaagtttagtagtaaaagtggtacgtcgggtaccttaccgttaacttaaccgtaacttaaccgtaacaagttacggtaccgttacgtacggggacgtaaaacgggaaccgtaacggtacccgtaacccggtcctacccgtaccgtaccgacccgttaccccgaaaccgaaaccgggtaccccgaacgttacccggttacccgtttacccccccgtacggtaccccgttacccccgttacccgttacccgaaaccgtaaccggtacccgtaaccccgttacggtaccgggggtaccgtaaccggaaccggg

SEQ ID NO: 235222 - DNA, 594 bp, Homo sapiens
  misc_feature: GYAE6OF02F4FD6.37.61.F06.1.454.CMB.1.raw
  modified_base (191)..(191): a, c, t, g, unknown or other
  misc_feature (191)..(191): n is a, c, g, or t
  modified_base (339)..(339): a, c, t, g, unknown or other
  misc_feature (339)..(339): n is a, c, g, or t
  modified_base (354)..(354): a, c, t, g, unknown or other
  misc_feature (354)..(354): n is a, c, g, or t
  modified_base (361)..(361): a, c, t, g, unknown or other
  misc_feature (361)..(361): n is a, c, g, or t
  modified_base (370)..(370): a, c, t, g, unknown or other
  misc_feature (370)..(370): n is a, c, g, or t
  modified_base (384)..(384): a, c, t, g, unknown or other
  misc_feature (384)..(384): n is a, c, g, or t
  modified_base (411)..(411): a, c, t, g, unknown or other
  misc_feature (411)..(411): n is a, c, g, or t
  modified_base (426)..(426): a, c, t, g, unknown or other
  misc_feature (426)..(426): n is a, c, g, or t
  modified_base (483)..(483): a, c, t, g, unknown or other
  misc_feature (483)..(483): n is a, c, g, or t
tcagtagtgtagatcacgaccggtgctcgatttagctacgctctaagggaaaggggaagactgacggtcccccaggagttcaggtgctgggcacggtgggcatgtgtgagttttgtcacaagatttgggctcaactctcctgtgcagcctctggattcaccttttaatacctattggatgagttgggtccnccaggttccaggggaggggctggagtgggtggccaacataaaagcaagatgggaagtgaagaaatctatggtggactcgtgtgaaggccattcacatctccagagacaacgcccagaacctcattgtatctagacaaatgaacagacngagacgcggaggacncgctgtntatacgtgngcgagagaggaggntaagtgtagaagtggcgtcggtccttntactactactactanacgtggacgtcgtcgggacgaaacggaccacgacgtacgccgtcctccgtacgtacnccctacccaaccgacgggccctacgttcccgtacccgttccccgtcgtacccctaccccgttaccctacccgacgtacgtacccgtacccgtcggtccggggaccaaccgg

SEQ ID NO: 235223 - DNA, 630 bp, Homo sapiens
  misc_feature: GYAE6OF02FGZJ8.37.61.F06.1.454.CMB.1.raw
  modified_base (226)..(226): a, c, t, g, unknown or other
  misc_feature (226)..(226): n is a, c, g, or t
  modified_base (320)..(320): a, c, t, g, unknown or other
  misc_feature (320)..(320): n is a, c, g, or t
tcagtagtgtagatcacgaccggtgctcgatttagctacgctctaagggaaaggggaagactgacggtcccccaggagttcaggtgctgggcacggtgggcatgtgtgagttttgtcacaagatttgggctcaactctcctgtgcagcctctggattcacctttaatacctattggatgagttggtccgccaggttccagggaagggctgggagtgggtggccaanataaagcaagatggaagtgagaatctatgtggactcgtgtgaacgggcctattcgaccattcctccagagaccaacgcccagaactcattgtanctagctaaagtgaacagactgagagccggagacacggtctgtcgttattacgtggtgacggaagaggtaagggcggacgtaatttaggtagtaaagtggtcgtcgggtaccttctactacttactactactagtcgtacgttcgtagggaccgtaaacgggacctaccggtccgaccgttcctaccctcgaacgtccctacccacccgtaacgggccctacgttccggtcccttccccgttcggcccctacccctcccgtaaccgaacgtccgtaccgacccgtcggtacggggtccaccggtacccggg

SEQ ID NO: 235224 - DNA, 714 bp, Homo sapiens
  misc_feature: GYAE6OF02HSVSR.37.61.F06.1.454.CMB.1.raw
  modified_base (274)..(274): a, c, t, g, unknown or other
  misc_feature (274)..(274): n is a, c, g, or t
  modified_base (292)..(292): a, c, t, g, unknown or other
  misc_feature (292)..(292): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccaggggaaggggctgggagtgggtggccaaacataaaagcaaagataggaagtgaagaaatactatgtggactcngtgaagggcatcacatcncagagacaacgcccaagacctctattgtactctagacaaatgaacagactgagacggccgaggaccacggctgtagttattacgtggtgacgaagacggagggaggacgtaagtttacggtaggttaaagtcggtacggttcgggtccctttaccgttaacctaacgtaaccttaacttacgtacggtacggtaccgttacgggttacggggaaacgaaacggggtacccgtaacggttaccgtaacccgttccgtaccctccgaccgtcccctaccccgaaccggtaaccgggcccctaaccgttcccggttaccctttaccccccggtccggtacccctacccccgtccctaacccgtaaccggtacccgacccgtaacccccggttccgggtaacggggacccgacccgtaacccgggg

SEQ ID NO: 235225 - DNA, 563 bp, Homo sapiens
  misc_feature: GYAE6OF02G8A5W.37.61.F06.1.454.CMB.1.raw
  modified_base (350)..(350): a, c, t, g, unknown or other
  misc_feature (350)..(350): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (387)..(387): a, c, t, g, unknown or other
  misc_feature (387)..(387): n is a, c, g, or t
  modified_base (395)..(395): a, c, t, g, unknown or other
  misc_feature (395)..(395): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccaggggaaggggctggagtgggtggccaacataaagcaagatggaagtgagaaatactatgtggactctgtgaagggccgattcaccatctccagagacaacgcccagaactcattgtatctgcaaatgaacagactgagagccgaggacncggctgtgtattacngtgcgagngaggngcgattagngtaatggngtggcttctactactactactactatcggacgtcgtggggacaacgggaccgacggtccaccggtcctcctcacgtcctaccaccaacgggcccagtccggttcccttccccctcggcccacccctccctcccgaagacgcctaccgtccgtcggggccacgaccggg

SEQ ID NO: 235226 - DNA, 588 bp, Homo sapiens
  misc_feature: GYAE6OF02HQ5CO.37.61.F06.1.454.CMB.1.raw
  modified_base (385)..(385): a, c, t, g, unknown or other
  misc_feature (385)..(385): n is a, c, g, or t
  modified_base (557)..(557): a, c, t, g, unknown or other
  misc_feature (557)..(557): n is a, c, g, or t
tcagtagtgtagatcacgaccggtgctcgatttagctacgctctaagggaaaggggaagacgtgacggtccccccaggagttcaggtgctgggcacggtgggcatgtgtgagttttgtcacaagatttgggctcaactctcctgtgcagcctctggattcacctttaatacctattggatgagttgggtccgccaggttccagggaagggctggagtggggtggccaacataaagcaagagtggaagtgaagaaatactatgtggactctgtggaaggccgattcaccatcctcagagacaacgcccaagaactcattgatctgacaaatgaacagactggagagccgaggacacggctgtgtacttagtgtgcgaagaggaggnggacgtattagtagtaaagtggtcgtcggtccttacgtactactactaactacgagtcggtacgtcgtagggacgaaacggaccgacgtccgaccgtctaccgtcacgcctaccgacgaacggcccatcccggttccttccccgtcgccctaccctccctacccgaagaccnccgtacccgtcggtacggggccgacgccggg

SEQ ID NO: 235227 - DNA, 668 bp, Homo sapiens
  misc_feature: GYAE6OF02GRZWW.37.61.F06.1.454.CMB.1.raw
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcaactttggtagctattggatggactgggtccgccagtctccgagggagggctggagtgggtggccaacatacgagggaggtggtggtaacgaaaaactgtagtggactcgtggtggcggggccgattccaccatctccagagacaacgaccaaaactcactgtatctgacaagtcggacgcctagacgagtccggaggacgaccggtcgttgtagttactttagtggtcgacgaggagttaatttacgaacttaacgtaagtttcgaagttcgtacgtaggttagtgtagttgtacgttaagtcgtaacgtaccgggtacggggaaccgtaacgggtacctaaggttcggtaccctaccggttccttacgtccgaccgtccctaccgaacccggaccgggtccctacggttcccgttcccgttccccgtcggccctccgtaccgccgttaccgacggtccgtaccgaccccgtacggaaccgaccgaccaccggaccggcccgtccggg

SEQ ID NO: 235228 - DNA, 716 bp, Homo sapiens
  misc_feature: GYAE6OF02I5M14.37.61.F06.1.454.CMB.1.raw
  modified_base (190)..(190): a, c, t, g, unknown or other
  misc_feature (190)..(190): n is a, c, g, or t
  modified_base (239)..(239): a, c, t, g, unknown or other
  misc_feature (239)..(239): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcaccttaatacctattggatgagttgggtccnccaggttccagggaggggctggagtgggtggccaacgataaagcaaagntggaagtgaagaaatactatgtggactcgtgtaggaacgggccgatttccacctattcctaccaagacgaaccaaccggccccaagtaacctctatttgtaatcctagactaaaagtcgaaacaggactgagacgccgaaggaccgaggtctgtacttagtttactggtacgacggaaggtacggaagggtacggacgtagttttaacgggtagttaaaacggtgggtacggtacggttaccgttaccgttacgttaaccttacttaacctactaggttacggtacgttcggtaggggaccgtaaaccgggaccgtaccggtaccgtacccgttaccgtaccgtacgtaccgtcccttacccgacccggtaaccggacccgtccgttcccgttcccgttacccccgtccggtaccccaccccgttaccctacccgaacgtaccgccgtaccgtccgggtcgggacccacggtccggg

SEQ ID NO: 235229 - DNA, 457 bp, Homo sapiens
  misc_feature: GYAE6OF02FTTME.37.61.F06.1.454.CMB.1.raw
  modified_base (339)..(339): a, c, t, g, unknown or other
  misc_feature (339)..(339): n is a, c, g, or t
  modified_base (343)..(343): a, c, t, g, unknown or other
  misc_feature (343)..(343): n is a, c, g, or t
  modified_base (442)..(457): a, c, t, g, unknown or other
  misc_feature (442)..(457): n is a, c, g, or t
tcagtagtgtagatcacgaccggtgctcgatttagctacgctctaagggaaaggggctggagtgggtggccaacataaagcaagatggaagtgagaaaatactatgtggactctgtgaagggccgattcaccatctccagagacaacgcccagaaactcattgtatctgcaaatgaacagactgagagccgaggacacggctgtgtattactgtgcgagagaggaggcgattagtgtaaaatggctgggcttctactactactactacatggacgtctgggcaaagggaccacggtcaccgtctcctcagcctccaccaaggcccatcggtcttccccnggcnccctcctccaagagcacctctgggggcacagcggaccctgggctgcctggtcaaggactacttcatctacactactgagcgggctggcaagcgcatagnnnnnnnnnnnnnnnn

SEQ ID NO: 235230 - DNA, 661 bp, Homo sapiens
  misc_feature: GYAE6OF02G3VV1.37.61.F06.1.454.CMB.1.raw
  modified_base (240)..(240): a, c, t, g, unknown or other
  misc_feature (240)..(240): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattccactttaatacctattggatgtagttgggtccgccaggttccagggaagggctggagtgggtggccaacataaagcaaagntggaagtgaagaaatctatgtggactcgtgtagagggctattcaccatctaccagacgaccacgcccaagaacctctattggtactcgtagaccaaaatcgaaacaagcgtagacgtacgaccggaaggaaccgacggtctttaattttactaacgttgaccgcgaaggacgaaaggtcgttacggggtcgtttcgaacctaggcgggtaccgacggggtaaccctggtacctaccggtcctccgtccacgccctaccacccggaaccgccctacgtcccgttacccgtcccccgtgggcccctcccgtcgtcccgacgacggacccgcctacccgtacgacgacgccgacgaaccgggtcccggtaccggtggcccgtcgtcccgtacggaccgttaacggtacctaccttacctaaccg

SEQ ID NO: 235231 - DNA, 836 bp, Homo sapiens
  misc_feature: GYAE6OF02JNCG9.37.61.F06.1.454.CMB.1.raw
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctagttggattggagtttcgggtcccgcctaggttccaggggaaggggtctgggaggttggggtcggaccctaacgaagtaaaacggcaaaggtactggggaaaagttgaaagaaaaccttacgttagttgggtagggtaaccttcgttggttaggaaacgggggtacccggtaattttccaaccccggtaagttcccttacccgtaacgaacggtaaaccgaaaccggcccccaaaggtaaccgtaccctaagttttccggttaataccgtttcggaactaaaagttaccgggtaaaccaacggtaccgttaggaaacgttaacgggacccggaaagggggttaacccgaccggggtacccgtttcgggtttaaaggttacgtttttaaacccgtggggtttaccggacgaaagggggtcggtaaacggggtaggtccgggtaagtttaacggtaaggttaaagtacgggtcgttacggggtcctttaccggttacgttacctaacgttactacgtagtacggtacgtcgttcgggacgaacggaaccggtacgtactaccgtctacctccgtacgcctaccacgtaccggtcaccgtcgtccgtccccgtcgcctaccctccgtaccgacgcgacctaccgtcggtcgggtacaccgtaccggg

SEQ ID NO: 235232 - DNA, 701 bp, Homo sapiens
  misc_feature: GYAE6OF02GU2V6.37.61.F06.1.454.CMB.1.raw
  modified_base (146)..(146): a, c, t, g, unknown or other
  misc_feature (146)..(146): n is a, c, g, or t
  modified_base (191)..(191): a, c, t, g, unknown or other
  misc_feature (191)..(191): n is a, c, g, or t
  modified_base (228)..(228): a, c, t, g, unknown or other
  misc_feature (228)..(228): n is a, c, g, or t
tcagtagtgtagatcacgaccggtgctcgatttagctacgctctaagggaaaggggaagactgacggtccccccaggagttcaggtgctgggcacggcgggcatgtgtgagttttgtcacaagatttgggctcaactctcctgtgnagcctctggattcacctttaatacctattggatgagttgggtccncaggttccagggacgggctgggagtgggtggaccaanataaagcaaagagtaggaagtgaagaaatactatgtaggactcgtggtggaagggccgtattacacctatccgtaccagagaacaacgaccaaaaactcaactatactctagaacgtaagtcgggacgtcctaggaagtaccgtccggaaggacgaaccggtcgtacggttgtttaagttactttgggtaggaccggtaaggtaagttaacgttttaacgaaccgtttaaacgttaaacggtttcgtaagttagtacgttaggtagtgtatagttacgttagtagtaccgtacgggtacgggtaacccggaacgggtaccgtagttcgtacccgtaccggttcttccgtactaccgtacccctaccgaaccgtaccgaccctaccgtaccggttccccttcccggtcgcccgtccgtcgaccgttaccgacggacctaccgcccgtacgacgtacgacgtacgaccgtcccgg

SEQ ID NO: 235233 - DNA, 579 bp, Homo sapiens
  misc_feature: GYAE6OF02G7DEH.37.61.F06.1.454.CMB.1.raw
  modified_base (267)..(267): a, c, t, g, unknown or other
  misc_feature (267)..(267): n is a, c, g, or t
  modified_base (548)..(548): a, c, t, g, unknown or other
  misc_feature (548)..(548): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccagggaagggctggagtgggtggccaacataaagcaaagatggaagtgaagaaatactatgtggactntgtgaaggccgattcaccatcctccagacgacaacgcccagaactcattgtatctgacaaatgaacagactgagacgccgaggacacggctgtgtattacgtgcgtacgagaggaggaggcgtagttagtagtaagtggtcgtcggtccttactacctactactactacagttcgacgtcgtgggacgaacggaccgacggtcaccgttcctccgtcactcctccgaccgtacggcctacgtccgtccctcccgtcggccctaccctccgacccaagaccnccgtaccgtcggtacgggaccctgacccggg

SEQ ID NO: 235234 - DNA, 662 bp, Homo sapiens
  misc_feature: GYAE6OF02HJISE.37.61.F06.1.454.CMB.1.raw
  modified_base (402)..(402): a, c, t, g, unknown or other
  misc_feature (402)..(402): n is a, c, g, or t
  modified_base (423)..(423): a, c, t, g, unknown or other
  misc_feature (423)..(423): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttggtccgccaggttccagggagggctggagtgggtggccaacataaagcaaagagtggaagtgaagaaattactatggtggactcgtgtgaacgggcctattccaccatctccgagacgacaaccgccaagaactcatttgatctagacaaagtcgaaacgtagcgtagacggcgacggacgacggcgtctaggtcttatagtgcgagaaggaggaggngacgttagttagtaagtaggnggtcggtcgtcttacttaactactaacctactactaggtacgtcggtacggtacgggaacgaaccggtaccggtaccgacccgttaccgtcctccgacgtacccgacccgaaccgtacccggaaccgtccgttaccggttccccgttccccgttaccccggtcgacccccgttacccgtcccgaaaccgacgtcccgacccgtaccgtaccgggggtaccgtaccggaccgtcccgggg

SEQ ID NO: 235235 - DNA, 643 bp, Homo sapiens
  misc_feature: GYAE6OF02I8PCD.37.61.F06.1.454.CMB.1.raw
  modified_base (228)..(228): a, c, t, g, unknown or other
  misc_feature (228)..(228): n is a, c, g, or t
  modified_base (313)..(313): a, c, t, g, unknown or other
  misc_feature (313)..(313): n is a, c, g, or t
  modified_base (332)..(332): a, c, t, g, unknown or other
  misc_feature (332)..(332): n is a, c, g, or t
  modified_base (386)..(386): a, c, t, g, unknown or other
  misc_feature (386)..(386): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattccacctttaatacctattggatgagttgggtccgccaggttccagggaggggctggagtgggtcgccaanataagcaagatggaagtgaagaaatactatgtggactcgtgtgaagggccgtattcaccatccgtacagacgacacgcccagacncgattgtatcgtgataaangaacagactgacgagccgagacgacggtctggtcgttatctagtggacgaaggnggacgggaggtacgtagttaggtacgtaaagtgggtcgtcgggtccttcgtaacctacgtaaccgttaacctactaaggttacggaccggttcgtacgggaccgaaacgggccgacggtcctaccgtcctctaccgacctccctacccgacggtaaccggcccgtacgtcccggttcccttccccggtcgtacccgtaccccttcgtacccgaagtccgaccgtacccgtaccgggtccgggacctacggacccggg

SEQ ID NO: 235236 - DNA, 617 bp, Homo sapiens
  misc_feature: GYAE6OF02GOB9O.37.61.F06.1.454.CMB.1.raw
  modified_base (168)..(168): a, c, t, g, unknown or other
  misc_feature (168)..(168): n is a, c, g, or t
  modified_base (341)..(341): a, c, t, g, unknown or other
  misc_feature (341)..(341): n is a, c, g, or t
tcagtagtgtagatcacgaccggtgctcgatttagctacgctctaagggaaaggggaagactgacggtccccccaggagttcaggtgctgggcacggtggtcatgtgtgagttttgtcacaagatttgggctcaactctcctgtgcagcctctggattcacctttaanacctattggatgagttggtccgcaggttccaggggaagggctggagtgggtgaccaacataaaagcaagataggaagtgaagaaatactagtggtggactctgtagaagggccattcaccatctccagagacaacgcccaagaactcattcgatctagacaatgaacagactnagacgcgagacacggctgtagttatactgtgacgaagaggtaggacggacgtagttaagtaggtaaagttggcgtacgggtccttactaacgtacttaacgtactaactagtacgtacgtcgtgggtaacgaaacgggaccgtaacggtacctacccggtacttacccgtcgaccgtcccgtacccaaaccgacggaccctacgtccgttccctcccgtcgaccctacctacccgtacaacggtcaccgtcccgacggtacgggtacacggtccgg

SEQ ID NO: 235237 - DNA, 670 bp, Homo sapiens
  misc_feature: GYAE6OF02GQ9OQ.37.61.F06.1.454.CMB.1.raw
  modified_base (361)..(361): a, c, t, g, unknown or other
  misc_feature (361)..(361): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccgagggaggggctggagtgggtggccaacataaagcaaagatggaagtgaagaaatactatgtggactctggtaggaaggccgattccacatctccagacacaacgcccaagaactcattgtactctgacaaatgaacagataggagacgacgagacgacgntagtattacttagtgtgacggaagacggagggacgtacgaagtttaggtaagttaagtcgggtacgttacgggtcctttaacgtaaccttaacctaaccttaactaacgtgttacgggtacgttacgggtacgggaacgaacgggtaccgtaccggtaccgtaccgttccctaccgtacgaccgttacccgtaccgaaccggtaccgggtaccctaccggttcccgttccccgtaccccgtccgtaaccccgtccctccctaaccgacggtacccacccgtacggtcccggacgggccaacggtcccgg

SEQ ID NO: 235238 - DNA, 710 bp, Homo sapiens
  misc_feature: GYAE6OF02HAR72.37.61.F06.1.454.CMB.1.raw
  modified_base (192)..(192): a, c, t, g, unknown or other
  misc_feature (192)..(192): n is a, c, g, or t
  modified_base (224)..(224): a, c, t, g, unknown or other
  misc_feature (224)..(224): n is a, c, g, or t
  modified_base (249)..(249): a, c, t, g, unknown or other
  misc_feature (249)..(249): n is a, c, g, or t
  modified_base (360)..(360): a, c, t, g, unknown or other
  misc_feature (360)..(360): n is a, c, g, or t
  modified_base (420)..(420): a, c, t, g, unknown or other
  misc_feature (420)..(420): n is a, c, g, or t
  modified_base (433)..(433): a, c, t, g, unknown or other
  misc_feature (433)..(433): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttcgggtccnccaggttccagggaaggggctgggaggtgggnggccaaacgtataaaaggcaaaggngtagggaagtgaagtaaactacttaagtgtaggacctgtagtgaaacgggccgaattcaaccctatctaccagagactaaaccggccctaagaacttcaattcgtaattcngtacaaaattcgaaacacggactggaaggacgtaccggaaggaccacgggcctagggttntaacgttttacgngtgacgtaagacgagggaggtacgtagttaagtagttaaagtcggagttcgggtcttacgtactactaactacgtacagttacggtacgtacgtgggacgtaaacggaccgtaacgtaccgacgtccgtcctaccgacgaccctaccgacccgtaaaccgacccgtaacgtcccggttaccttcccccggtacggtacccgtaccccttacccgtacccgtaaacgtacccggtaccgtaccggttcccggacggggtaccgtacccgtaacccggg

SEQ ID NO: 235239 - DNA, 573 bp, Homo sapiens
  misc_feature: GYAE6OF02FKXFJ.37.61.F06.1.454.CMB.1.raw
  modified_base (309)..(309): a, c, t, g, unknown or other
  misc_feature (309)..(309): n is a, c, g, or t
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccagggaggggctggagtgggtggccaacataaagcaagataggaagtgaagaaatactatgtggactctgtgaaggccattccaccatctccagagacacgccagaactnattgtatctgacaaatgaacagactgagagccgaggacacggntgtntattctgngcgagnggagggaggtcgtagttagtagtaaagtggtcgtcgggtccttactactacttaactactactagtcggacgttcgtagggacgaacgggaccgacggtaccaccgtcctcctcgacgtccctaccgaccgacggcccacgttccgtcccttccccgtcgcctaccctcctaccacgacgccgccgtcggtcgggcggcgcgg

SEQ ID NO: 235240 - DNA, 646 bp, Homo sapiens
  misc_feature: GYAE6OF02F2SAV.37.61.F06.1.454.CMB.1.raw
  modified_base (154)..(154): a, c, t, g, unknown or other
  misc_feature (154)..(154): n is a, c, g, or t
  modified_base (232)..(232): a, c, t, g, unknown or other
  misc_feature (232)..(232): n is a, c, g, or t
  modified_base (254)..(254): a, c, t, g, unknown or other
  misc_feature (254)..(254): n is a, c, g, or t
  modified_base (272)..(272): a, c, t, g, unknown or other
  misc_feature (272)..(272): n is a, c, g, or t
  modified_base (319)..(319): a, c, t, g, unknown or other
  misc_feature (319)..(319): n is a, c, g, or t
  modified_base (331)..(331): a, c, t, g, unknown or other
  misc_feature (331)..(331): n is a, c, g, or t
tcagtagtgtagatcacgaccggtgctcgatttagctacgctctaagggaaaggggaagactgaccggtccccccaggagttcaggtgctgggcacggtgggcatgtgtgagttttgtcacaagatttgggctcaacctctcctgtgcagcctntggattcacctttaatacctattggatgaggttcggtccgccaggttccaggggagggctggaggtgggtcgaccaanataaagcaagatggaagtgaanaatactatgtgactctgnggaggcctatccacatcctacagagacaaccgcccagaacctcattntactacgtacanaaagagaacagtacgagagacgaccggaggaccaggcttagtattaactcgtgtagcggaagaggaaggggacgtacgtaagtttaagtagttaaagtcggtcgtcgggttccttcgtaactactactaactatacgtggtacgtaggtacgggtacgaaacggccgtacgtaccgaccgtccgtcctaccacccgtaccctaccgacccgaaccggtccctaccgttcccgttcccgtccccgtacgtcccctaccccgtaccgacccgacgaccgtcccgtacccgtccgggtaccggaccgaccgtaccggg

SEQ ID NO: 235241 - DNA, 591 bp, Homo sapiens
  misc_feature: GYAE6OF02IYUOR.37.61.F06.1.454.CMB.1.raw
  modified_base (361)..(361): a, c, t, g, unknown or other
  misc_feature (361)..(361): n is a, c, g, or t
  modified_base (506)..(506): a, c, t, g, unknown or other
  misc_feature (506)..(506): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccagggaaggggctgggagtgggtggccaacataaagcaagatggaagtgaagaaatactatgtggactctgtgaagggccgattcaccatctccagagacaacgcccagaactcattgtatctgactaaatcgaaacagactagagagaccggagacacggntggtagttatttactggtgcggtaaggaggagggaggacgtagttaagtaggtaaagtggtcggtggtccttctactaacttactaactactagtcggacgtcgacgggacgaacggaccgtacggtccgtaccgtcgtcctacnccgtacctccaccgacggccacgtccgtcccttccccgtcgccctacctccctacgacgacacccacctcgacgacgccaaccgg

SEQ ID NO: 235242 - DNA, 840 bp, Homo sapiens
  misc_feature: GYAE6OF02IJLOX.37.61.F06.1.454.CMB.1.raw
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
  modified_base (304)..(304): a, c, t, g, unknown or other
  misc_feature (304)..(304): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttggtccgccaggtttccgaggggaaggggctggaggtgggtggccaacaataaagcaagataggagtagaagaaatactatgtgactctgtgaaggccattcaccatcnccagnacgaacncccaagaactctattgtactcgtgacaaatacgaaacagtaccgtaggaacggacgaccgaacggaccgaacgggtcttacggtagttaacgtttacgttggtcggacggtaaggacgggaaggggaacggggtacgttaaggtttaaggtttaaggtttaaacggttagggtaccggttcggggttacccttttaccgttaaccttaaccgttaaccctaaccgttaacgtaacgttacgggtacgttaccgggtaacggggaaccgggtaaaaccgggtacccggtaaccggttacccgtaacccgttcccgttacccgtcccgtaacccgtacccccgtaacccgtaaccccggaaacccgggtaccccgtaaccggtttacccccggtttacccccgtttccccccccggttccgggtaccccccgttaaccccccgttaacccccgttacccgttaaaacccgggcccgttaaccccggttaccccggttaccggggtacccggggtacccggtacccggtaaccccgggg

SEQ ID NO: 235243 - DNA, 797 bp, Homo sapiens
  misc_feature: GYAE6OF02HNCPT.37.61.F06.1.454.CMB.1.raw
tcagtagtgtagatcacgaccggtgctcgatttagctacgctctaagggaaaggggaagactgacggtccccccaggagttcaggtgctgggcacggtgggcatgtgtgtagttttgtcacaagatttgggctcaactctcctgtgcagcctctggacttcacctttaatacctattggatgagttcgggtccgccgaggttccgagggaagggctggaggtgggtgaccaaactataaaagcaaagagtaggaagtagaagtaaaattacgttaagtggttacggacttcggttaggtagggaaacgggccgtattaccaacctatacctccgaaggaacgacctaaccgcccaagaacccttcgaagttttggtaactctacggactaaaagtcgaaacctaaggaccgtgaagtaccggaccgggaaggaaccgaccggtcgttaggttagttaacgttttcgtgggtaggacggaaagggtaaggaacggggtaacggtacggttaaagttacggtaacggttaaacggttcgggtaccggttccgggttacctttaccgttaacgttaaacctactttaacctaacgtacggtacggttaccggtacggtacgggaaaccgaaacgggtcccgaacggtcccgaccgttcctcctaccgaccgtaccctaccgaacccgtaacggacccttacgtcccgttaccccttccccggtccgaccccttaccccgtacccgttaccgaacggtacccgaccgtcccgttacgggcgggtacccgacggtacccggg

SEQ ID NO: 235244 - DNA, 623 bp, Homo sapiens
  misc_feature: GYAE6OF02I5YQ4.37.61.F06.1.454.CMB.1.raw
  modified_base (350)..(350): a, c, t, g, unknown or other
  misc_feature (350)..(350): n is a, c, g, or t
  modified_base (523)..(523): a, c, t, g, unknown or other
  misc_feature (523)..(523): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattccacctttaatacctattggatgagttggtccgccaggttccaggggaagggctggagtgggtggaccaacataaacgcaaagatggaagtgaagaaactactagtagtggactcgtgtgaagggcattcaccatctccagagacacgaccaagaactcattgtatctgacaagtacgaacagactagaagngaccggaacggacgacggccgttgtacgttatttacgtaggtacgtacggaagtaacggagggacggacgtagttacggtagtaacgtggtacgtcgggtcttacgtactacttactactactagtcgtacgtgagggtacgaacggaccgacgtacaccgtctcccgcgacnccgtacccgaccgtacgcccgtacgtccgttccttcccgacggtcccaccccgtaccacccgaacgcgtacccgtccacgggaccgggctacccgaccgg

SEQ ID NO: 235245 - DNA, 606 bp, Homo sapiens
  misc_feature: GYAE6OF02GP4R4.37.61.F06.1.454.CMB.1.raw
  modified_base (363)..(363): a, c, t, g, unknown or other
  misc_feature (363)..(363): n is a, c, g, or t
  modified_base (367)..(367): a, c, t, g, unknown or other
  misc_feature (367)..(367): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcacctttaatacctattggatgagttgggtccgccaggttccaggggaagggctgggagtgggtggccaacataaagcaagatggaagtgaagaaatactatgtggactcgtgtggaacgggcctattccaccatcctccgagagaccaacgcccagaactctattgtatctgacaaatgaacagactgagacgccgagacacgntgtntattctggtgacgagaggaggaggtcgtagttagtagtaaagtggtcgtcgggtccttactactacttacctactacagttcggacgttcgtacgggacgaaacgggaccgacggtccgaccgttcctcctacgtacgccctaccgacccgaacggccctacgtcccgttcccttccccgtcgaccctacccctcctaccgaacgcgccgtaccgtaccggcgggtaccgacgtaccgg

SEQ ID NO: 235246 - DNA, 718 bp, Homo sapiens
  misc_feature: GYAE6OF02G316D.37.61.F06.1.454.CMB.1.raw
  modified_base (153)..(153): a, c, t, g, unknown or other
  misc_feature (153)..(153): n is a, c, g, or t
  modified_base (171)..(171): a, c, t, g, unknown or other
  misc_feature (171)..(171): n is a, c, g, or t
  modified_base (357)..(357): a, c, t, g, unknown or other
  misc_feature (357)..(357): n is a, c, g, or t
  modified_base (457)..(457): a, c, t, g, unknown or other
  misc_feature (457)..(457): n is a, c, g, or t
  modified_base (480)..(480): a, c, t, g, unknown or other
  misc_feature (480)..(480): n is a, c, g, or t
tcagtagtgtagatcacgaccggtgctcgatttagctacgctctaagggaaaggggaagactgacggtcccccaggagttcaggtgctgggcacggtgggcatgtgtgtagttttgcacaagatttgggctcaactcgtcctagtgcagcctntggattcctacctttaanacctagtcggatgtaggttgggtccgccgtaggtccgaggggagggctagggtagtggggtacgacccaagaataaagcaaagtcgtagggtaaagtgaaagaaactacgttagtcggtagaccgtctaggtaggaacgggctaattccaacctagtcctacgaggtacaaccgtaaccgccgaanaacgttcctaagtttcggactcgtaagaactaaaggtcgaaacacggtacgaggagacgaccggtaaggaccgtacggtcttagtacgttaagtttaccnggtgaacgtaagtagggacgggngacgtttaaagttcgtagtaagtcggtacgttcggtaccttactaaccgtacttaacgtactacgttacgtaggtacgttacggtacgggacggaaacggtaccgtaccgtaccgtaccgtccgtaccgtacgaccgttaccacccgaacgacggaccctcggtcctacccgttacccgccgtcctaccccgtcgaccgtacgtacgtaccacccgttcggacggtactaccggccgg

SEQ ID NO: 235247 - DNA, 607 bp, Homo sapiens
  misc_feature: GYAE6OF02FT519.37.61.F06.1.454.CMB.1.raw
  modified_base (270)..(270): a, c, t, g, unknown or other
  misc_feature (270)..(270): n is a, c, g, or t
  modified_base (288)..(288): a, c, t, g, unknown or other
  misc_feature (288)..(288): n is a, c, g, or t
  modified_base (291)..(291): a, c, t, g, unknown or other
  misc_feature (291)..(291): n is a, c, g, or t
  modified_base (311)..(311): a, c, t, g, unknown or other
  misc_feature (311)..(311): n is a, c, g, or t
  modified_base (518)..(518): a, c, t, g, unknown or other
  misc_feature (518)..(518): n is a, c, g, or t
  modified_base (524)..(524): a, c, t, g, unknown or other
  misc_feature (524)..(524): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattcaccttttaatacctattggatgagttgggtccgccaggttccagggaggggctggagtgggtggccaacataaagcaagatgggaagtgaagaaatactagtgtggacctntgtgaagggccattcacntcnccagagacacgccaagactnattgtatctagctaaaatcgaaacagaccgtagaacggacgcccgggaaggaccaacggggtcttaggtagttaactttacgtggtcgacgaaggaggtagggaggactagttagtagtaaagtggtcgtcggtcttacgtactactactactacagttcgtacgtcgtaggggacgaacggaccgacggtccaccgtcctcctacncgtccnccaccgacggaccacgtccgtcctccccgtcgaccctccctaccctccgaagccgtacctaccgtcgtcgggaccacgaccgg

SEQ ID NO: 235248 - DNA, 751 bp, Homo sapiens
  misc_feature: GYAE6OF02JE1H6.37.61.F06.1.454.CMB.1.raw
  modified_base (247)..(247): a, c, t, g, unknown or other
  misc_feature (247)..(247): n is a, c, g, or t
  modified_base (307)..(307): a, c, t, g, unknown or other
  misc_feature (307)..(307): n is a, c, g, or t
  modified_base (346)..(346): a, c, t, g, unknown or other
  misc_feature (346)..(346): n is a, c, g, or t
  modified_base (349)..(349): a, c, t, g, unknown or other
  misc_feature (349)..(349): n is a, c, g, or t
  modified_base (368)..(368): a, c, t, g, unknown or other
  misc_feature (368)..(368): n is a, c, g, or t
  modified_base (395)..(395): a, c, t, g, unknown or other
  misc_feature (395)..(395): n is a, c, g, or t
tcagtagtgtagatcacgaccggtgctcgatttagctacgctctaagggaaggggagactgacggtcccccaggagttccaggtgctgggcacggtgggcatgtgtgagttttgtcacaagtatttgggctcaactctcctgtgcagcctcgtggtattcacctttaatacctattggatgtagttcgggtccgccgtaggttccaaggggaaggggtctgggagtgggtgccaatataaagcaagntggaagtgaagtaaactactagtgtaggacttcgtgtaggaaggggcctattccaacctntcctccagacgaacaaccgccctagaacttcatttgacngtnacgtaaatcgaaacacgancgaagtagaccggaggactaccgggtnttagtgttaactttcgaggtcgacggaagaaggtagggaggttagtagtttaacggttaagtaaacgtggtacgttacgggtacctttacttacctaacgttacttaccgtaacttacggttacggtaccggttcggtacgggggtaaccgaaacggggtacccgtaaccgggttccgaacccggtttcctacccgtccgtaacccgtcccgttacccgaacccggaaccggtccccgtaccgttccccggtttcccgttacccccggtaccggtaccccttacccccgtaccccgttaacccgtaacggacccttacccggacccgttcccgggtacgggacccaggtaccccgg

SEQ ID NO: 235249 - DNA, 852 bp, Homo sapiens
  misc_feature: GYAE6OF02HX26B.37.61.F06.1.454.CMB.1.raw
tcagtagtgtagatcacgaccggtgctcgatttagctacgctctaagggaaaggggaagactgaccggtccccccaggagttcaggtgctgggcacgggtgggcatgtgtgtagttttgcacaagtatttgggctacaactcctcctgtgcagcctctggattctacctttaataccttagttggatggtagttcgggtccgccgtaggttccgaggggagggctgggaggtgggtcgaccaacgataaagcaaggtataggaaagtggaaagtaaattactagtaggtacggacttcgttggtacgggaacggggtcccgtaattccaaccgtatccgtaccgaaggtaacgaccgaaccggcccaaagtaaccttcgtaagtttcgtacttcgtacgaactaaacgtacgaaacaggtaacctaggaacgtacggaccgaaggaccgcggtcgttaggtattacgtacgtaggtaacgacggtaagagggtacgggtacggtacgttaagttaagggtaacgtaaacggtcggttaccggttcggtttacctttaaccttaacgttaaccgttaacctaaccgtaacgtacggttacggtaccgggttacgggtaacggggtaaaccgggaaaccgggtacccggttaacggtaccccgtacccggttacccgtacccgtaaccggtacccggttaccccgtaaccccggtaaaccggaacccgggttcccgtaacccggtttcccggttacccccgtttcccggaaccgtacccccgtacccctacccgtaaccgaacgtacccgtacccggtaaccggtccggggtaccggtaccaccggtacccggg

SEQ ID NO: 235250 - DNA, 596 bp, Homo sapiens
  misc_feature: GYAE6OF02JI8NY.37.61.F06.1.454.CMB.1.raw
  modified_base (320)..(320): a, c, t, g, unknown or other
  misc_feature (320)..(320): n is a, c, g, or t
  modified_base (422)..(422): a, c, t, g, unknown or other
  misc_feature (422)..(422): n is a, c, g, or t
  modified_base (455)..(455): a, c, t, g, unknown or other
  misc_feature (455)..(455): n is a, c, g, or t
  modified_base (574)..(574): a, c, t, g, unknown or other
  misc_feature (574)..(574): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctctgtgcagcctctggattcacctttaatacctattggatgagttggtccgccaggttccagggaggggctggagtgggtggccaacataaagcaaagatggaagtgaagaaatactaatggtggactcgtagtagaagggaccgattccaccaatctaccagtagacaacgcccagaactnacttgactcagacaaagtgaaacagaactagagacgccggagacacggctaggtcgtaattcgagtgacgaagtacgaagggagtcgtatttagagtaaacnggtcgtacggcttacactacgtaactaccgtanacgtagtcgtacggaggacgaaacgggtacgacggtcgaaccgttctaccgtcgacgtccaccgacaaccgggtcctacgttaccggtcctacccggcgacccgctaccgtcaacgacnccgcctggtacggccagacggg

SEQ ID NO: 235251 - DNA, 825 bp, Homo sapiens
  misc_feature: GYAE6OF02GVS18.37.61.F06.1.454.CMB.1.raw
  modified_base (152)..(152): a, c, t, g, unknown or other
  misc_feature (152)..(152): n is a, c, g, or t
  modified_base (235)..(235): a, c, t, g, unknown or other
  misc_feature (235)..(235): n is a, c, g, or t
  modified_base (257)..(257): a, c, t, g, unknown or other
  misc_feature (257)..(257): n is a, c, g, or t
  modified_base (292)..(292): a, c, t, g, unknown or other
  misc_feature (292)..(292): n is a, c, g, or t
  modified_base (308)..(308): a, c, t, g, unknown or other
  misc_feature (308)..(308): n is a, c, g, or t
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctntggattcacctttaatacctattggatgagttgggtccgccaggttccagggagggctggagtgggtgcaacataaagcaagntggaagtgaagaaatcgtatgnggactctgtgaaggcattcacatctcagacacacnccagaactcatcgtanctgactaaatcgaaacacgacgtagacggtaggacccggaaggaccgacggtccgttaggtagtttaactttacgtaggtcggaccgtaaggaagggagggtaacggggtactttaaggtttaagggttaaggttaaaacgggttcggggtaccggttaccgggggttacccttttaccgttaaacctttaacccgttaaacctttaacccgttaaaccgtacggttaaccgggttaaccggttaccgggttacggggggtaacccggtaaaccgggggtacccgtaacccggggttacccttaacccgggttcccgttaccccgtaccgtacccggttacccccgttaaccccggaaacccggtaaacccgggccccttaaccgggttccccggtttcccccgttaccccccgggtacgttacccccctaccccccgttacccgtaaccccggtaaccgtacccgtacccgttacccggtccgggtacccggggtacccaacccgggtccccgggg

SEQ ID NO: 235252 - DNA, 712 bp, Homo sapiens
  misc_feature: GYAE6OF02FH3UC.37.61.F06.1.454.CMB.1.raw
  modified_base (188)..(188): a, c, t, g, unknown or other
  misc_feature (188)..(188): n is a, c, g, or t
  modified_base (299)..(299): a, c, t, g, unknown or other
  misc_feature (299)..(299): n is a, c, g, or t
tcagtagtgtagatcacgaccggtgctcgatttagctacgctctaagggaaaggggaagactgacggtcccccaggagttcaggtgctgggcacggtgggcatgtgtgagttttgtcacaagatttgggctcaactctcctgtgcagcctctggattcacttttaatacctattggatgagttggccnctaggttccagggacgggctggagtgggtgccaacgataaagcaaagatggaagtgaagtaaatctagtggtcggacttcgtggtagaacgggccgtattccaccattccnccgagacgacaaccgcccaagtaactcagttgtatcgtagactaaatcgaaacagacctagacgacgaccggaggacacggctaggtacgttagttactgtcggacgtaagggagaggggtaggtactaagtttacgtaagttaagtacggtacgtcgggttacctttaccgtaaccgtttacgttaaccgttaaccgttaccgtaagttacgggtaccggttacggtacggggtaacgaaaccggggtaaccgaaccggtacccgtaccgttaccgtacccgtacgtaccgttacccaccgaaacccgaaccgggccctaccggtccgttcccgttccccgtccggtacccgtaccctaccctaccgtaacgtaccgcccgtaccgtccgggtaccgggtacacggtaccgg

SEQ ID NO: 235253 - DNA, 861 bp, Homo sapiens
  misc_feature: GYAE6OF02G1A4U.37.61.F06.1.454.CMB.1.raw
tcagtagtgtagatcacgaccggtgctcgatttagctacgctctaagggaaaggggaagactgacggtccccccaggagttcaggtgctgggcacggtgggcatgtgtgagttttgtcacaagatttgggctcaactctcctgtgcagcctctggattccacctttaatacctattggatgaggttgggtccaccgaggttccgaggggaaggggcgtgggaggttggggtcggaccaaacgaataaacgacaaaggagtacgggaagtaggaaagaaagtacttagtcggtaggtacttcgtggtaggaacgggtccgtaattccaacctactccgtaccgaagtacgaaccgaaccgaccccgaacgtaactctaagttcgtacttacgtacgaactaaagtaacgaacgacgaacgttaggaaggacggaccgggaaggtaaccgacgggtacgttggttacttaacgtttacgtggtacggtacggaaggaggggtaacgggaggtactaaagtttacggtaagtaaacggtcgggtaccggttcgggtaccctttaccgttaaccgttaccgttaacttaccgttaacgtacggttacggtaccggtacgggttaacggggaacgtaaaccgggtaccggtaaccggttacccgtaaccggttccctaacccgtaccgtaccgtaccccgttaaacccgacccggtaaaccggtccccgtaaccggttcccccgtttaccccgtttccccccggtacccggttacccccgtaacccccttaccccgaacccgtaacccggtacccgtacccgtaccccggttaccgggtaaccggggtccctaccgggtccccggg

SEQ ID NO: 235254 - DNA, 1147 bp, Homo sapiens
  misc_feature: GYAE6OF02IICTN.37.61.F06.1.454.CMB.1.raw
tcagtagtgtagatcacgaccggtgctcgatttagctacgctctaagggaaaggggaagactgacggtccccccaggagttcaggtgctgggcacggtgggcatgtgtgtagttttgtcacaagatttgggctcaactctcctgtgcagcctctggtacttcctaaccttttaataccttattggatgtaggttgggcccgccgtaggttccgaggggaagggggcgtgggtaggtggggtcggaccaaacgaattaaaaggacaaaggtaagttagggaagttaggaaagtaaaacttactaagttggtaggtaccttcggttaggtagggtaaacgggggcccgtaacgttttacccgaaccctaacgttccctacccgaaagggaaccgaaacccgaaaacccccggcccccgaaaaggtaaaccccttaccgttaagttttacggtttaactccgtcggtaaaacctaaaagttaccggtaaaaccgtaaacggtaccgttaaggggaaacgggacgggaacccccggggtaaacggggaacccggtaaccgggggtccttttaggggttaggttttaaccgttttaaccggtttggggttacgggtaccgggaaaggggtaaagggggaaaggggtcgggttaaacgggtaaggtttttaagggtttaaagggtttaaaggttacggggtccggttaccgggggtttaccccttttaccgtttaaaccgtttaaacccgttaaaccgttttaacccgttaaacgtaacggttaacggggtttaacccgggtttacccgggttaagggggggtaaaccccgggtaaaaccggggtaacccccgggttaaacccggggttaccccgttaaccccgggtttacccccggttaccccgttaacccggtaaccccggttacccccgtaacccccgggtaaaccccgggtaaccccggggtaccccccgttacccggtttcccccgggtttttaaccccccgtttccccccccggttaacccggttacccccccgttaacccccccggttacccccgtaaccccgtaacccggtaacccggtacccccggttaccccgggtttacccggggttacccggggggacccctaaccgggtaccccccgggg

SEQ ID NO: 235255 - DNA, 725 bp, Homo sapiens
  misc_feature: GYAE6OF02I40F3.37.61.F06.1.454.CMB.1.raw
  modified_base (326)..(326): a, c, t, g, unknown or other
  misc_feature (326)..(326): n is a, c, g, or t
  modified_base (352)..(352): a, c, t, g, unknown or other
  misc_feature (352)..(352): n is a, c, g, or t
tcagtagtgtagatcacgaccggtgctcgatttagctacgctctaagggaaaggggaagactgacggtccccccaggagttcaggtgctgggcacgggtgggcatgtggtgtagttttgtcacaagattttgggctcaactctcctgtgcagcctctggattcacttaatactattggatgagttggccgcctaggttccaggggagggctagggagtgggtggccaacagtaaagcaagataggaagtgaagaaatactattggtacggtactcgtggtagaaacgggccgattcacctatctaccagagacacgccagactctnttgtaatctaggactaaatccgaaanacgtacgtagagaacgtccggaggtaaccgacgggttctaggttagttaacgtttaccgtagtcggaacggtagacggagggacgtagtagttaggtagtaagcggtcgtggtccttacgttacttacgtaccttaacgtacgtaagtacggtacggtacggttcggggacgaaaccggaccgtaccgggtacccgtacccgttccgttaccgtacgtaccgtacccgtacccgaacccggacccggtacccgtccgtaccggtttcccgttacccccggtccggtaccccggtacccttaccccgtaacccgtaaccggtacccgtacccgtaccgtacccggttaccgggaccggtacccgtaacccgggg

SEQ ID NO: 235256 - DNA, 415 bp, Homo sapiens
  misc_feature: GYAE6OF01BA3E1.13.2.A02.1.454.CMB.1.raw
  modified_base (408)..(415): a, c, t, g, unknown or other
  misc_feature (408)..(415): n is a, c, g, or t
tcagtcacgtactacacgaccggtgctcgatttagactcatctacagggaggatggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttactactgccaacagtcttacggaacctcgtacacttttggcctaggggaccaggctggagatcaaaacgaactgtggctgcacatctgtctcatctcccgcatctgatagtacgtgactgagcgggctggcaaggcgcatagnnnnnnnn

SEQ ID NO: 235257 - DNA, 416 bp, Homo sapiens
  misc_feature: GYAE6OF01A9NWK.13.2.A02.1.454.CMB.1.raw
  modified_base (408)..(416): a, c, t, g, unknown or other
  misc_feature (408)..(416): n is a, c, g, or t
tcagtcacgtactacacgaccggtgctcgatttagactcatctacagggaggatggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttactactgccaacagtcttacggaacctcgtacacttttggccaggggaccaggctggagatcaaacgaactgtgctgcacatctgtcttcatcttcccgccatctgtatagtacgtgactgagcgggctggcaggcgcatagnnnnnnnnn

SEQ ID NO: 235258 - DNA, 572 bp, Homo sapiens
  misc_feature: GYAE6OF01DFMCR.13.2.A02.1.454.CMB.1.raw
  modified_base (239)..(239): a, c, t, g, unknown or other
  misc_feature (239)..(239): n is a, c, g, or t
  modified_base (541)..(572): a, c, t, g, unknown or other
  misc_feature (541)..(572): n is a, c, g, or t
tcagtcacgtactacacgaccggtgctcgatttagactcatctacagggaggatggagacagagtcaccgtcacttgccgggcaagtcagaccattgacaaatatgtaaattggtatcaacagaagccaggtgaacgcccctaagctcctgatctatactgcatccactttgtcgagggcggggtcccatcgtaaggttccgtggcaggtggatcgtgggacagtattcactctcaccntcacagtctcgaccaacctgaagtactgtacgactaacgttactacgtcgaccaacgtagttaccgttaaccggtaaccttccgttaaccttaacggttttccggggccgaacgggggtacccagggtctagggaagtactaacgaaaacgtacgttgggcgtcgtcgacccacctattccgttgttccttacctacgtttcccctcccgaatacttcgttagtaacgttacggttacgtacgtaacggtgggaaccggggtcgggtacgtacgggacgaacgggtccgataacgtgcagtnnnnnnnnnnnnnnnnnnnnnnnnnnnnnnnn

SEQ ID NO: 235259 - DNA, 609 bp, Homo sapiens
  misc_feature: GYAE6OF01A2K1Z.13.2.A02.1.454.CMB.1.raw
  modified_base (268)..(268): a, c, t, g, unknown or other
  misc_feature (268)..(268): n is a, c, g, or t
  modified_base (576)..(576): a, c, t, g, unknown or other
  misc_feature (576)..(576): n is a, c, g, or t
  modified_base (580)..(609): a, c, t, g, unknown or other
  misc_feature (580)..(609): n is a, c, g, or t
tcagtcacgtactacacgaccggtgctcgatttagactcatctacagggaggatggagacagagtcaccgtcacttgccgggcaagtcagaccattgacaaatatgtaaattggtatcaacagaagccaggtgaagcccctaagctcctgatctatactgcatccctactttgtcgagggccggggtcccatccgtaaggttccgtggcaggtggatcgtgggacagtatttcactctcaccatcacagtctcgacaactgaagctgngacctaaactttacctactcgacctaaacgtacgttaccgttaacccggaaccttccgttaaccttaccggttttaccgggacccggtaacggggaacccaaaggtcgttagggaacacgtaccgaaacgaccgtaaacgttgggtacgtccgtacgaccctaacctacgttccgttcgtttacctcctaaccgttcccccgtttaccccgaccttacgttacccgtaggtaacgttaacggttaccggtacgtaccggttagggacggtcgggtccgtagggacgtacggccgtagacgtagcgctnacgnnnnnnnnnnnnnnnnnnnnnnnnnnnnnn

SEQ ID NO: 235260 - DNA, 627 bp, Homo sapiens
  misc_feature: GYAE6OF01A5KQ0.13.2.A02.1.454.CMB.1.raw
  modified_base (285)..(285): a, c, t, g, unknown or other
  misc_feature (285)..(285): n is a, c, g, or t
  modified_base (548)..(548): a, c, t, g, unknown or other
  misc_feature (548)..(548): n is a, c, g, or t
  modified_base (554)..(554): a, c, t, g, unknown or other
  misc_feature (554)..(554): n is a, c, g, or t
  modified_base (562)..(563): a, c, t, g, unknown or other
  misc_feature (562)..(563): n is a, c, g, or t
  modified_base (572)..(572): a, c, t, g, unknown or other
  misc_feature (572)..(572): n is a, c, g, or t
  modified_base (576)..(576): a, c, t, g, unknown or other
  misc_feature (576)..(576): n is a, c, g, or t
  modified_base (594)..(594): a, c, t, g, unknown or other
  misc_feature (594)..(594): n is a, c, g, or t
  modified_base (611)..(611): a, c, t, g, unknown or other
  misc_feature (611)..(611): n is a, c, g, or t
  modified_base (617)..(617): a, c, t, g, unknown or other
  misc_feature (617)..(617): n is a, c, g, or t
  modified_base (619)..(619): a, c, t, g, unknown or other
  misc_feature (619)..(619): n is a, c, g, or t
tcagtcacgtactacacgaccggtgctcgattttagactcatctacgagggaaaggggctggtgtgggtctcacggattgacaatgactgggagagacacaatccacgcggattctgtgaggggccgattcaccacatcgagagacaacgccaagaacacggtatatctgcaaatgaacagtctgagaggcgaagacgacggcggtttactcgtgtgcaagaggtgctggtcgctagttcggttttgattcgtcgtcggggccaggggacaagtcggtaaccgtntcttcacgcctaccaccgaacgggccctagtccggtccttcccccgtgggcccgccctcggtccgtcccgtagggaccgaccgtaccgtacccggaagacggaccgaccggacggcccgggtcccgttaggggccttacggcccggttcgggtaaccgaaacggtacccttaccgtttacccgtaacggttcggtcgaacgttcggacgggtccgggtcgtcggggacctaacggggccgtacgaaggttaacgcgtaagtcncgccgngcgtacgnngcgcgcgcncgcncgcgcgcgcgcgcgacgngcgagcgcgacgcgacncgcacncncgtcgtcg

SEQ ID NO: 235261 - DNA, 426 bp, Homo sapiens
  misc_feature: GYAE6OF02F97ID.13.2.A02.1.454.CMB.1.raw
  modified_base (413)..(413): a, c, t, g, unknown or other
  misc_feature (413)..(413): n is a, c, g, or t
  modified_base (415)..(415): a, c, t, g, unknown or other
  misc_feature (415)..(415): n is a, c, g, or t
  modified_base (417)..(426): a, c, t, g, unknown or other
  misc_feature (417)..(426): n is a, c, g, or t
tcagtcacgtactacacgaccggtgctcgatttagactcatctacagggaggatggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcagtctgaagattttgcagtttattactgtcagcagtataataactggcctccgtacatgtacacttttggccaggggaccaacctggagatcaagacgaactgtggctgcaccatctgtcttcatcttcccgcatctgattagtacgtgactgagcgggctggcaggcnangnnnnnnnnnn

SEQ ID NO: 235262 - DNA, 424 bp, Homo sapiens
  misc_feature: GYAE6OF02GESPO.13.2.A02.1.454.CMB.1.raw
  modified_base (406)..(406): a, c, t, g, unknown or other
  misc_feature (406)..(406): n is a, c, g, or t
  modified_base (412)..(424): a, c, t, g, unknown or other
  misc_feature (412)..(424): n is a, c, g, or t
tcagtcacgtactacacgaccggtgctcgatttagactcatctacagggaggatggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctggcacagacttcattctcaccatcagcagcctgcagcctgaagattttgcaacttattactgtctacaagatcacaattatcctgggacgttcggccaagggaccaaggtagaaatacaaacgaactgtggctgcaccatctgtcttcactccttcccgcatctgatgtacgtgactgaggcgggctggcaaggcncatagnnnnnnnnnnnnn

SEQ ID NO: 235263 - DNA, 604 bp, Homo sapiens
  misc_feature: GYAE6OF02JGNEC.13.2.A02.1.454.CMB.1.raw
  modified_base (195)..(195): a, c, t, g, unknown or other
  misc_feature (195)..(195): n is a, c, g, or t
  modified_base (265)..(265): a, c, t, g, unknown or other
  misc_feature (265)..(265): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (576)..(579): a, c, t, g, unknown or other
  misc_feature (576)..(579): n is a, c, g, or t
  modified_base (581)..(603): a, c, t, g, unknown or other
  misc_feature (581)..(603): n is a, c, g, or t
tcagtcacgtactacacgaccggtgctcgatttagactcatctacagggaggatggagacagagtcaccgtcacttgccgggcaagtcagaccattgacaaatatgtaaattggtatcaacagaagccaggtgaagcccctaagctcctgatctatctgcatccactttgcaggcgggtcccatcaaggttccgngcagtgatcgtgggacagatttcactctcgaaccatcaacctgtcctgaccaaacctgaacgtactggtnacctaaactttactactacgaccctaaacgtagttaccctttaacgggaaaccctttcggttaccttaacctttttcgggaacccggaacgggggacctaacggcgttaggggaaactaaccttaaccgaaaaccggtacgttcggtacggtacctcggtaccacctagttccgttacgtaccttactaccgtttcccgttaccccgaccttaaggttctaacggtacttacggttaaccgttcgaacggttacgggacggtcccggggtacgtcggaacggtacggccgacgtacgtagctgcngngncnnnngnnnnnnnnnnnnnnnnnnnnnnnc

SEQ ID NO: 235264 - DNA, 425 bp, Homo sapiens
  misc_feature: GYAE6OF02FXRVG.13.2.A02.1.454.CMB.1.raw
  modified_base (323)..(323): a, c, t, g, unknown or other
  misc_feature (323)..(323): n is a, c, g, or t
  modified_base (380)..(380): a, c, t, g, unknown or other
  misc_feature (380)..(380): n is a, c, g, or t
  modified_base (410)..(425): a, c, t, g, unknown or other
  misc_feature (410)..(425): n is a, c, g, or t
tcagtcacgtactacacgaccggtgctcgatttagactcatctacagggaggatggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttactactgccaacagtcttacggaacctcgtacacttttggcaggggaccaggctgganatcaaacgaatgtgctgcaccatctgtcttcatccttcccgccatctgatagtacgngactgagcgggctggacaggcgcagtacgnnnnnnnnnnnnnnnn

SEQ ID NO: 235265 - DNA, 565 bp, Homo sapiens
  misc_feature: GYAE6OF02I98LP.13.2.A02.1.454.CMB.1.raw
  modified_base (237)..(237): a, c, t, g, unknown or other
  misc_feature (237)..(237): n is a, c, g, or t
  modified_base (265)..(265): a, c, t, g, unknown or other
  misc_feature (265)..(265): n is a, c, g, or t
  modified_base (296)..(296): a, c, t, g, unknown or other
  misc_feature (296)..(296): n is a, c, g, or t
  modified_base (544)..(565): a, c, t, g, unknown or other
  misc_feature (544)..(565): n is a, c, g, or t
tcagtcacgtactacacgaccggtgctcgatttagactcatctacagggaggatggagacagagtcaccgtcacttgccgggcaagtcagaccattgacaaatatgtaaattggtatcaacagaagccaggtgaagcccctaagctcctgatctatactgcatcctactttgtcgagggccggggtcccatcgaagggttccgtggcaggtggatcgtggcacgagtacttcattcncaccatcagcagcctgacagctagaatntttgactaactttattactgtactaacgaanatacaataattctaccggtgggtaccgttacggaccggaaaagggtacccgaaaagggtagtaaaacgtaaccaaaaaacgggtaacgtcgggtacggtccgtagaccgtaacctaagttccggttatttccgttactaaccgttcccgttccccgtactaacgtttacgttacgaaacgtttacgttaacggtacgtaacgtggtaacgggtcgggtaccgaggtacgaccgggactacgattacgnnnnnnnnnnnnnnnnnnnnnn

SEQ ID NO: 235266 - DNA, 395 bp, Homo sapiens
  misc_feature: GYAE6OF01AF5MS.21.67.G01.1.454.CMB.1.raw
  modified_base (389)..(395): a, c, t, g, unknown or other
  misc_feature (389)..(395): n is a, c, g, or t
tcagtcgtcgctcgcacgaccggtgctcgatttagagtatacatattgggtttggggagtatggtcaggaatttcagggcagaattaccttgaccacagactcatccacgggcacagcctacttggaactgaggaacctgagaatggacgacacggccacatattattgtgcgcgagtgggggcatttgtagactactactattattacttcttggacgtctggggcaaagggccacggtcaccgtctccccagcctccaccaagggcccatcggtcttccccctggcgccctgctccaggagcacctccgagagcacagcggccctgggctgcctggtcaaggactacttcccgagcgacgactgagcgggctggcaaggcgcatagnnnnnnn

SEQ ID NO: 235267 - DNA, 548 bp, Homo sapiens
  misc_feature: GYAE6OF01AJP8M.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgaggaacctgagaatggacgacacggccacatattattgtgcgcgagtgggggcatttgtagactactactattattacttcttggacgtctggggcaaagggccacggtcaccgtctccccagcctccaccaagggcccatcggtcttcccctggccgccctgcctccaggcgcacctccgagacgcacagccggccctgggctgcctggtccaaggctacttccctcgtctcgtactcgacgcgggctggcaggcg

SEQ ID NO: 235268 - DNA, 272 bp, Homo sapiens
  misc_feature: GYAE6OF01A8DGS.21.67.G01.1.454.CMB.1.raw
  modified_base (265)..(272): a, c, t, g, unknown or other
  misc_feature (265)..(272): n is a, c, g, or t
tcagtcgtcgctcgcacgaccggtgctcgatttagagtatacatattgggtttgggggcatttgtagactactactattattacttcttggacgtctggggcaaagggaccacggtcaccgtctccccagcctccaccaagggcccatcggtcttccccctggcgccctgctccaggagcacctccgagagcacagcggccctgggctgcctggtcaaggactacttcccgagcgacgactgagcgggctggcaaggcgcatagnnnnnnnn

SEQ ID NO: 235269 - DNA, 270 bp, Homo sapiens
  misc_feature: GYAE6OF01EK1G6.21.67.G01.1.454.CMB.1.raw
  modified_base (265)..(270): a, c, t, g, unknown or other
  misc_feature (265)..(270): n is a, c, g, or t
tcagtcgtcgctcgcacgaccggtgctcgatttagagtatacatattgggtttgggggcatttgtagactactactattattacttcttggacgtctggggcaaagggaccacggtcaccgtctccccagcctccaccaagggcccatcggtcttccccctggcgccctgctccaggagcacctccgagagcacagcggccctgggctgcctggtcaaggactacttcccgagcgacgactgagcgggctggcaaggcgcatagnnnnnn

SEQ ID NO: 235270 - DNA, 550 bp, Homo sapiens
  misc_feature: GYAE6OF01A60GG.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgaggaacctgagaatggacgacacggccacatattattgtgcgcgagtgggggcatttgtagactactactattattacttcttggacgtctggggcaaagggaccacggtcaccgtctccccagcctccaccaagggcccatcggtctcccctggccgccctgctccaggcgcacctccgagacgcacacgccggcccgtgggcctgccctggtcaaggactacgttcccgagcgacgactgagcgggctggcaaggcg

SEQ ID NO: 235271 - DNA, 568 bp, Homo sapiens
  misc_feature: GYAE6OF01EHFAB.21.67.G01.1.454.CMB.1.raw
  modified_base (550)..(550): a, c, t, g, unknown or other
  misc_feature (550)..(550): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgaggaacctgagaatggacgacacggccacatattattgtgcgcgagtgggggcagtttgtagactactactattattacttcttggacgtctggggcaaaagggaccacggtcaccgtctccccagcctccaccaagggcccagtccggtccttccccctggccgcccctgcctccaggacgcaccctccgacgacgccacgacgccggccctgggcctggccctgggtccaaggcctacgttcccgaggccgacgacnggagcgggctggcaggcg

SEQ ID NO: 235272 - DNA, 560 bp, Homo sapiens
  misc_feature: GYAE6OF01D3Y83.21.67.G01.1.454.CMB.1.raw
  modified_base (442)..(442): a, c, t, g, unknown or other
  misc_feature (442)..(442): n is a, c, g, or t
  modified_base (549)..(549): a, c, t, g, unknown or other
  misc_feature (549)..(549): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgagaacctgagaatggacgacacggccacatattattgtgcgcgagtgggggcagtttgagactactactattattacttcttggacgtctggggcaaagggccacggtcaccgtctcccagccctccaccaggcccatcggtccttccccnggccgccctgcctccaggacgcaccgtccgagacgcacgacgccggccctgggcctggcctggtccaagggccttaccgttccctcggtctctacgtgacggcgggntcggcaaggcg

SEQ ID NO: 235273 - DNA, 574 bp, Homo sapiens
  misc_feature: GYAE6OF01COXAP.21.67.G01.1.454.CMB.1.raw
  modified_base (540)..(540): a, c, t, g, unknown or other
  misc_feature (540)..(540): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctgggcctcggtgaaggtctcctgcagggcctctggttacagtttttccgactataccacgggcacagcctacttggaactgaggaacctgagaatggacgacacggccacatattatgtgcgcgagtgggggcagtttgtagactacgtactattattacttcttggacgtcgtggggcaaagggaccacggtcaccgtctccccagccctccaccaaggcccatccggtcttcccctggccgcccgtgcctcccgaggacgcacccgtccgagacgccacgacgccggccccgttgggctcgcctggtccaagggtacctaccgttcccncgttcctctacgtgacgcgggctcggcgaaggcg

SEQ ID NO: 235274 - DNA, 571 bp, Homo sapiens
  misc_feature: GYAE6OF01C5X38.21.67.G01.1.454.CMB.1.raw
  modified_base (447)..(447): a, c, t, g, unknown or other
  misc_feature (447)..(447): n is a, c, g, or t
  modified_base (563)..(563): a, c, t, g, unknown or other
  misc_feature (563)..(563): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatggggatgggccgaccttcgcaacggaaagatggagtatggtcaggatttcagggcagaattaccttgaccacagactcatccacggacacagcctacttggaactgaggaacctgaagaatggacgacacggccanatatattgtgcgcgaggtgggggctagtttgtagactaacttactaattatttacttcgttgggacgttcgtggggacaaaggggaccctacgggttaccacccggtcctccccgngtaccccg

SEQ ID NO: 235275 - DNA, 574 bp, Homo sapiens
  misc_feature: GYAE6OF01D0BN1.21.67.G01.1.454.CMB.1.raw
  modified_base (411)..(411): a, c, t, g, unknown or other
  misc_feature (411)..(411): n is a, c, g, or t
  modified_base (566)..(566): a, c, t, g, unknown or other
  misc_feature (566)..(566): n is a, c, g, or t
tcagtcgtcgctcgcacgaccggtgctcgatttagagtatacatattgggtttgggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagttttccgactatagtatcagttgggtgcgacaggcccttggacaagggcttgagtggatgggatggggccgtaccttcgacgaacggaagagtggagtagtggtacaggtaatttcgagggcagaaattaccttgaccacagactcatccacggacacngcctactggaactgagactgagaatggacgacacggcacatattatgtgcgcgaggtgggggctagtttgtagacttactacttattattacttcgttggtacgttcggtcggggacgaaacgggacccgtacggtactacccggtcctccccgngtaccccg

SEQ ID NO: 235276 - DNA, 580 bp, Homo sapiens
  misc_feature: GYAE6OF01DJ85M.21.67.G01.1.454.CMB.1.raw
  modified_base (466)..(466): a, c, t, g, unknown or other
  misc_feature (466)..(466): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtgcccactcccagactcaactggtgcagtctggacctggaggtgaagaagccgtggggcctcggtgaaggtctcctgcagggcctctggttactagtttttccgactatagtatcagttgggtgcgacaggcccttggacaagggcttgagtggatgggatgggccgaccttcgacaacggaagatggagtagtggtacaggatttcgagggacagtaattaccgttgaaccacagactcactccgacgggcacagacctactggaactggagacctgagaatggacgacacggacacatattatgngcgcgaggtggggctagtttgtagtactactacttattattacttcgttacggacgttcggtggggaccgtaaagggacctacgggtacacccggttcctccccgcgtaccccg

SEQ ID NO: 235277 - DNA, 574 bp, Homo sapiens
  misc_feature: GYAE6OF01D89PM.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccgaccttcgcaacggaagatggagtatggtcaggtaatttcgagggcaggtaattaccgttagaccacagactcatccgacgggcacagcctacgttcggaactgaacggaacctgaagaagtcggacgacgacggccacatattatgtgcgcgaggtgggggtctagtttgtagtactactacttattattacgttcgttggtacgtgtgggacgaagggaccgtacggtacaccgtcctcccgcgtaccccg

SEQ ID NO: 235278 - DNA, 583 bp, Homo sapiens
  misc_feature: GYAE6OF01AHLYD.21.67.G01.1.454.CMB.1.raw
  modified_base (400)..(400): a, c, t, g, unknown or other
  misc_feature (400)..(400): n is a, c, g, or t
  modified_base (476)..(476): a, c, t, g, unknown or other
  misc_feature (476)..(476): n is a, c, g, or t
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcgggtgaaggtctcctgcgagggcctcgtggttactagtttttccgacttatagtatcagttgggtgcgacaggcccttggacaagggcttggagtggagtggggagtgggccgacctttcggcgaacggaaagagtggagtagtggtcaaggaatttcgaggcaagtaattacttgaccanagactcatccacgggcacagcctatagactgacgaactgagaagtaggacgacgacggccactatattatgtgcgngaggtggggctagtttgtagacttacgtactattacttacgttcgttggtacgttcggtggggactaacgggtaccaccgggttcacccgtcctcccgcgtaccccg

SEQ ID NO: 235279 - DNA, 565 bp, Homo sapiens
  misc_feature: GYAE6OF01BI5VB.21.67.G01.1.454.CMB.1.raw
  modified_base (487)..(487): a, c, t, g, unknown or other
  misc_feature (487)..(487): n is a, c, g, or t
  modified_base (552)..(552): a, c, t, g, unknown or other
  misc_feature (552)..(552): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgaggaacctgagaatggacgacacggccacatattattgtgcgcgagtgggggcagtttgagactactactattattacttcttggacgttcgtggggcaaagggccacggtcaccgtctcccagccctccaccaagggcccatccggtctcccctggccgccctgcctccacggacgccaccgtcgacgagccacncgcgccctgggcctgccgtggtccaacggcttccgttccctcgtctcctacgtcggacgccgggntcggcgtaggccg

SEQ ID NO: 235280 - DNA, 680 bp, Homo sapiens
  misc_feature: GYAE6OF01COJ3H.21.67.G01.1.454.CMB.1.raw
  modified_base (394)..(394): a, c, t, g, unknown or other
  misc_feature (394)..(394): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggcgaccttcgcaacggaagatgggagtatggtcaggaatttcgagggcaagtaacttacgttagacctacagtacnctactccgaacgacacgagtcctacgttaggaacgtggaacggtaacctaggaagaaagtcggaacgaccgaaccggacccaacgtaacttaatttacgttaggtcggacggtacggtagggtagggggtacttagtttagtaacggtacttaaccgttaacttaactttaacgttttaacgtttccgtttacgggtacggtttacggttacgggggtaacgtaaacggggtaacccgtaacggttacccgaacccggtttcccccgtaccccgtacgtacccccg

SEQ ID NO: 235281 - DNA, 608 bp, Homo sapiens
  misc_feature: GYAE6OF01AYWMP.21.67.G01.1.454.CMB.1.raw
  modified_base (476)..(476): a, c, t, g, unknown or other
  misc_feature (476)..(476): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcctactcccagactcaactggtgcagtctggacctgaggtgaagaagcctggggcctcggtgaaggtctcctgcagggcctctggttacagtttttccgactataccacgggcacagcctacttggaactgaggaacctgagatggacgacacggccacatattatgtgcgcgagtggggcatttgtagactactactattattacttcttggacgtcgtggggcaaagggaccacggtcaccgtctcccagccctccaccgaacggcccagtccggtccttcccccgtggcccgtccccgtgtcctccgacggcnccaccgtccgagacgcacgacggccgcccgtgggcctcggtccgtcggtaccaacgggtaccttacccgttcccgtccggttccttaccgttacgtcggacggtcggggccttcgggaccgtaacgggccgg

SEQ ID NO: 235282 - DNA, 400 bp, Homo sapiens
  misc_feature: GYAE6OF01BER1Q.21.67.G01.1.454.CMB.1.raw
  modified_base (290)..(290): a, c, t, g, unknown or other
  misc_feature (290)..(290): n is a, c, g, or t
  modified_base (391)..(400): a, c, t, g, unknown or other
  misc_feature (391)..(400): n is a, c, g, or t
tcagtcgtcgctcgcacgaccggtgctcgatttagagtatacatattgggtttggggagtatggtcaggaatttcagggcagaattaccttgaccacagactcatccacgggcacagcctacttggaactgaggaacctgagaatggacgacacggccacatattattgtgcgcgagtgggggcatttgtagactactactattattacttcttggacgtctggggcaaagggaccacggtcaccgtctccccagcctccaccaagggcccatcggtcttcccctggccnccctgcctccaggagcacctccgagagcacagccggccctgggcctgcctggtcaaggctacttcccgagcgacgactgagcggctggcaaggcgcatagnnnnnnnnnn

SEQ ID NO: 235283 - DNA, 824 bp, Homo sapiens
  misc_feature: GYAE6OF01D37S9.21.67.G01.1.454.CMB.1.raw
tcagtcgtcgctcgcacgaccggtgctcgatttagagtatacatattgggtttgggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcgagggcctctggttactagtttttccgactatagtatcgtaggttgggtgcgacgacggtcccgttaggacgaagggtctttggaggtgggagtggggagttcggggaccgtaccgttcggacgaaacgggaagagtgggagttagtggtacaggtaattcggaggcaagtaacttactgacacagactacataccgacggacacgacgtcctacgtacggaactaggaacggtaacccgtaggaacggtaagtaccgggaaccggaaaccgacccgggaaccctaacgtaacgtttaacgttttaacggtttacgggtacgggtaccgggtaaccggggtaacgggggtttacggggggtaaccctttaagggtttttacgggaaccgttaaccgtttaaccggttaacttttaacgttttaaccgttttaacccgttttaccgggtttaacggggttaccggtttacccggggttaacggggggttaacccgtaaaaaccggggggttaccccgtaaacccggggtttacccgtaaacccccggttttccccggtaaccccccgtaaccgggttaacccccccgg

SEQ ID NO: 235284 - DNA, 541 bp, Homo sapiens
  misc_feature: GYAE6OF01E18EP.21.67.G01.1.454.CMB.1.raw
  modified_base (460)..(460): a, c, t, g, unknown or other
  misc_feature (460)..(460): n is a, c, g, or t
  modified_base (513)..(513): a, c, t, g, unknown or other
  misc_feature (513)..(513): n is a, c, g, or t
  modified_base (532)..(532): a, c, t, g, unknown or other
  misc_feature (532)..(532): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgaggaacctgagaatggacgacacggccacatattattgtgcgcgagtgggggcatttgagactactactattattacttcttggacgtctggggcaaagggaccaggtcaccgtctccccagcctccaccaagggcccatcggtcttcccctgccgccctgctccaggngcacctccgagagcacagccggccctgggctgcctggcaaggactacttcccncgtctctactgacgcgggntggcaggcg

SEQ ID NO: 235285 - DNA, 549 bp, Homo sapiens
  misc_feature: GYAE6OF01EZLNP.21.67.G01.1.454.CMB.1.raw
tcagtcgtcgctcgcacgaccggtgctcgatttagagtatacatattgggtttgggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagttttccgactatagtatcagttgggtgcgacaggccctttggacaagggcttgagtggatgggatgggccgaccttcgcaacggaagatggagtatggtcaggaattcgaggcagaattactgacacagactcatccacggcacagctactggactgagactgagatggacgacacggccacatattattgtgcgcggaggtggggctagtttgtagactacgtatattattacttcgttcggtagtacgtggggacgaaagggaccgtacggtcaccgtctccccgagtaccccg

SEQ ID NO: 235286 - DNA, 747 bp, Homo sapiens
  misc_feature: GYAE6OF01CR92Q.21.67.G01.1.454.CMB.1.raw
  modified_base (354)..(354): a, c, t, g, unknown or other
  misc_feature (354)..(354): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcgacgggcctcgtggttactagtttttccgacttatagtatcgtaggttgggtgcgacaggtcccttggacagggtcttggagtggagtgggatcgggccgacttcgacgtaacggaaagntaggagtagtggtacgaggtaattcgaggacaagtaacttactgacctacagactcacgtccgacgggcacacgtacctacgttaggaacgtggaacgtaccgtagaagaacgtaggaaccgaacgaccgggacctaacaagttaatttacgttacggtacggtccgggacggtacggggttacgggggtaccttaaggttttcggtaaacggtacccgtttaaacgttaaccgttttaactttaaacgttttaaccgtttaccgggtttaacggggtaccggtttaccggttaccggggggtaaccgtaaaaaccgggggtacccggtaaccccgggttaccccgttaaccccggttaccccttaccccccggaaccggttaacccccccgg

SEQ ID NO: 235287 - DNA, 568 bp, Homo sapiens
  misc_feature: GYAE6OF01EAY80.21.67.G01.1.454.CMB.1.raw
  modified_base (475)..(475): a, c, t, g, unknown or other
  misc_feature (475)..(475): n is a, c, g, or t
  modified_base (556)..(556): a, c, t, g, unknown or other
  misc_feature (556)..(556): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactataccgacgggcacagcctacttggaactgagaacctgagaatggacgacacggccacatattattgtgcgcgaggtgggggctagtttgtagactactactattattacttcttggacgtcgtggggacaaagggccacggtcaccgtctcccgagcctccaccaagggcccagtccgtaccttccccgtggccgccctgcctccaggacncacctcgagcgcacgacggccgcccgtggctcgccgtggtcgaacggtcctaccttcccgcgtcctctacgtcgacgcggntcggcgaggccg

SEQ ID NO: 235288 - DNA, 555 bp, Homo sapiens
  misc_feature: GYAE6OF01CIEOQ.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctactggaactgaggaacctgagaatggacgacacggccacatattattgtgcgcgagtgggggcagtttgtagactactactattattacttcttggacgtcgtggggcaaagggaccacggtcaccgtctccccagcctccaccaacgggcccatccggtccttcccccgtggccgcccctgcctcccgaggacgccaccctccgagacgcacagccggccctgggctgcctggcaaggctacctcctcgtctctactgacgcggctggcaggcg

SEQ ID NO: 235289 - DNA, 619 bp, Homo sapiens
  misc_feature: GYAE6OF01E0DY2.21.67.G01.1.454.CMB.1.raw
  modified_base (497)..(497): a, c, t, g, unknown or other
  misc_feature (497)..(497): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggtcttggagtggagtggggagtcgggccgaccgttcggacgaaacggaaagatggagttagtggtcgaggtaatttcgagggacagtaattacctagaccacagtactcagtccgacgggcacgacgtcctacgttacggaactagaaggaacccgtagaagaagtaggacgacgacgaccacgtatattatgtgcgngaggtggggtctagtttgtagtacttactattactttattaccgttcgtttacggtacgttcggtcggggtacgtaaacgggaccgtacggtaccgacccgttcccgtccccgacgtccccg

SEQ ID NO: 235290 - DNA, 743 bp, Homo sapiens
  misc_feature: GYAE6OF01CL1NH.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagtttttccgactatagtatcagttgggtgcgacaggcccttggacaagggcttgagtggatgggatgggccgaccgttcgacgaacgggaaagagtagggagtagtggtacgaggtaattttcgaagggcaagtaattaccgttgacctacagactcacgtaccgacgggcacgacgtacctacgttaggaacgtcggaacggtaacccgtaggaagtaacgtagggaacgaaccgaaccggacccaaccgtaagttaagtttaagtttaggtacggaccggtacgggtacgggttacggggggacttaaggttttaggtaacggtaaccgtttaaccgttaacgtttaacgtttaacgttttaaccgttttacggtttacgggtaaccggtttaccggttacgggggtaaccggtaaaacggggtacccgtaaccggggttaccccttaacccgggttcccttacccccgtaaccggttaccccccgg

SEQ ID NO: 235291 - DNA, 577 bp, Homo sapiens
  misc_feature: GYAE6OF01C425A.21.67.G01.1.454.CMB.1.raw
  modified_base (414)..(414): a, c, t, g, unknown or other
  misc_feature (414)..(414): n is a, c, g, or t
  modified_base (570)..(570): a, c, t, g, unknown or other
  misc_feature (570)..(570): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggagtgggccgtaccttcgacgaacggaaagagtggagtagtggtcaggtaatttcgagggcagtaattaccgttgaccacgagactcactccacgggcacngcctactggaactgagacctgagaagtggacgacgacggccacatattatgtgcgcggaggtggggatagttgtagacttactacttattattactttacgtggtacgttcggtggggacgtaaacgggaccgtacggtacacccgtcctccccgngtacccc

SEQ ID NO: 235292 - DNA, 583 bp, Homo sapiens
  misc_feature: GYAE6OF01DCVSK.21.67.G01.1.454.CMB.1.raw
  modified_base (483)..(483): a, c, t, g, unknown or other
  misc_feature (483)..(483): n is a, c, g, or t
  modified_base (494)..(494): a, c, t, g, unknown or other
  misc_feature (494)..(494): n is a, c, g, or t
  modified_base (575)..(575): a, c, t, g, unknown or other
  misc_feature (575)..(575): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatcctttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttgagtggatgggatgggccgtaccgttcgacgaacgggaaagagtagggagtagtggtcaaggtaatttgagggcaagtaaattaccttgaaccacagactcagtccgacgggcacgagcctacttacggaactggacgaacctgagaagtggacgacacggccacatatattagtgacgnggaggtggggntagttgtaagtactactaattattattacttcgttgtacgttggtggggacgaagggacctacggtacaccgtctccccgngtaccccg

SEQ ID NO: 235293 - DNA, 401 bp, Homo sapiens
  misc_feature: GYAE6OF01DHAJZ.21.67.G01.1.454.CMB.1.raw
  modified_base (304)..(304): a, c, t, g, unknown or other
  misc_feature (304)..(304): n is a, c, g, or t
  modified_base (388)..(401): a, c, t, g, unknown or other
  misc_feature (388)..(401): n is a, c, g, or t
tcagtcgtcgctcgcacgaccggtgctcgatttagagtatacatattgggtttggggagtatggtcaggaatttcagggcagaattaccttgaccacagactcatccacgggcacagcctacttggaactgaggaacctgagaatggacgacacggccacatattattgtgcgcgagtgggggcatttgtagactactactattattacttcttggacgtctggggcaaagggccaacggtcaccgtctccccagcctccaccaagggcccatcggtcttccccctggcgccctgctccaggancacctccgagagcacagcgccctgggctgcctggtcaaggactactcccgagcgaacgactgagcggctggcaaggcgcatagnnnnnnnnnnnnnn

SEQ ID NO: 235294 - DNA, 667 bp, Homo sapiens
  misc_feature: GYAE6OF01C35IW.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctcgtggttactagtttttccgactatagtatcagttgggtgcgacaggcccttggacaagggcttgagtggatggggatgggccgtaccttcggacgtaacggaaagagtaggacgtatgggtacaaggtatttcgagggacaggtaattaccgttgaaccacaagactcgacgttcccgaacgggcaacgacgaccttacgttaggaactggaacggtaaccgtaggaagtaagtacggaacgaccgaacggccaacgattagttaattgtacgcggacggtaggtgggggtactagtttacgtaacgtacgttaccgttaacgtttaattacgtttaacgttcgttcgggtacgttcggttaggggtaccgtaaacggggtacccgtacggttaccacccggttccctccccgacgtacccccgg

SEQ ID NO: 235295 - DNA, 570 bp, Homo sapiens
  misc_feature: GYAE6OF01DKYS0.21.67.G01.1.454.CMB.1.raw
  modified_base (461)..(461): a, c, t, g, unknown or other
  misc_feature (461)..(461): n is a, c, g, or t
  modified_base (473)..(473): a, c, t, g, unknown or other
  misc_feature (473)..(473): n is a, c, g, or t
  modified_base (489)..(489): a, c, t, g, unknown or other
  misc_feature (489)..(489): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttgagtggatgggatgggccgaccttcgcgaacggaaagagtggagtagtggtcaggtaatttcgagggcagtaattaccgttgaccacagactcatccgacgggcacacgtctactggaactgacggaacctgaagaagtcggacgacgacggaccanacttattattgngcgcggaggtggggtntagtttgagtactactactattattactcgttgacgtgtcgggacgaaggacctacggtcacccgttcgccctagaccccg

SEQ ID NO: 235296 - DNA, 623 bp, Homo sapiens
  misc_feature: GYAE6OF01CDS1R.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcgagggcctcgtggttactagtttttccgactagtagtatcaggttgggtgcgacaggcccttggacaaggcttgagtggatgggatgggccgtaccttcggcaaacgggaaagagtggagtagtggtacagggtaatttcgagggctagtaaattaccttaggaaccacgagactcactaccgacggacacgacgtcctaacgttggaactggaacggtaaccgtgaagaaatggaacgacgacgggaccaacgaacttagttattgtagcgacggaggtggggactagtttgtagactaacgtacttattactttacttcgtttggaacgttcgtggggacaaagggtacccgtaacggtactacccggtccctcccgacgtaccccg

SEQ ID NO: 235297 - DNA, 941 bp, Homo sapiens
  misc_feature: GYAE6OF01C7E3V.21.67.G01.1.454.CMB.1.raw
tcagtcgtcgctcgcacgaccggtgctcgatttagagtatacatagtgggttgggacccaaaaaccacaccctccttgggagacttcccctagatcacacgcccctcaccataggactggacctggagcattcctttcctgggtggcagcagcaacaggtgcccactcccagactcaacctggtcgcagtctggacctgaggtgaagagccgtggggcctcggtagaacggtcctccgtcgcgagggtcctcgttggttacgtacgttttccgacttagtagttatctaaggttgggtcgcgaacgacggtaccccgtttaggaacctaacggggtactttggaacggtggggaacgttacgggggtaacgtcgggggtacccggtaaccgttttaccgggaaccgtaaaaccgggggtaaaagtacggtttaggggaacggtttaaacggtacgggtaaccggtaaggggtaaagttttaccggaaggggtaaccgtaaacggttaaaacgtttacccggttaacggtaaacccgtaaccggtaaaccggtaacctacctaaacggtaccccggaacgggttacccaaacgtacgtaacccggtttaacggttacgggtaaacccgttacgggaaaccgggtaaaccccgtttaggaaaacgggttaaacgttaccggggtaaacccggtaaaccggtaacccggggtaaccctaaacccggtaaagtttaaacgtttaacgtttacgggttacggtaacccgggtaacgggtaacggggttacggggggtaccttaaggttttcgggttaaccgttacgtaaacccgtttaagttaacggttaaacggtttacgttcggttaacgggtacgtacggttacggggtaccgtaaagggtaccgtacggtaccggtacccgttccgaccccgtcgtaccccg

SEQ ID NO: 235298 - DNA, 702 bp, Homo sapiens
  misc_feature: GYAE6OF01B7MGF.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcaggttgggtgcgacaggcccttggacaagggcttggagtggatgggagtgggccgaccttcgcgaacggaagagtggtagtagtggtacgaggtaatttcgaggcaagtaattaccgttgacccacagactcactccgacgggtcacacgtcctacgttacggacgtgaacggtaaccgtggaacgtaacgtacgggaacgtaccggaaccggtacccaacgtactttaactttaagttcggtaggtccggacggtacggggtgggggtacgttagttttagtaacggtaccttacgttaaccttagtttaacgtttaccgtttacggtttacgggttaccggtttacgggttacggggtacggtaaacgggtacccgggtaacgggttacccgtaccccggttcccgttccccccgtacggtaccccccg

SEQ ID NO: 235299 - DNA, 671 bp, Homo sapiens
  misc_feature: GYAE6OF01AJ2EH.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggtcttggaggtggagtggggagtcgggccgtaccgttcggacgaaacggaaagagtgggagtagtggtcgaaggtaatttcgaggcaagtaacttaccgttagaaccacagactcagtccgacgggcacgacgtcctacgtaggaactaggacgaacctagacgaagtaggaccgacgacgaccacattattacgtgtacggcggacggtagggtggggtacttagtttaggtaacgtaccttaacgttaacgttattttaaccgtttactttacggttcggttacggttcggtacggggtaaccgtaaaacgggtacccgtaaccgggttacccgaaccccggttcccgtcccccgaacggtaccccccg

SEQ ID NO: 235300 - DNA, 746 bp, Homo sapiens
  misc_feature: GYAE6OF01AWQ0U.21.67.G01.1.454.CMB.1.raw
  modified_base (339)..(339): a, c, t, g, unknown or other
  misc_feature (339)..(339): n is a, c, g, or t
tcagtcgtcgctcgcacgaccggtgctcgatttagagtatacatatttggggttttgggggacccaaaaacccaacacccctccttgggaggagttcccctaggatcacagcccctcaccatggactagggaccttcggaggccatcctttttcctagggtggtccaggcaaggcaaccgaggtgcccgtactcccacgactcaacttaggttggcagtctggaccgtcgagggtgaaaggaacgccgtagggggccgtcgggttggaagggtactcctacggcgaggggccgttcgtggttacaggtttttccgacgtactagtagttcaggttgggnggcgtacacggcccttggaccaaggggcttggacggtcggagtggggatcgggccgtaccgtttcggacgaacgggaaacgagtgggaggtagtcggtcgagggaattttcgagggcaggtaacgttaccttagaccctagacggactacgaagttccgaacgggacgtacgacgtacctaacgttcggaacgtacggtaggttaaccgtacggttaacggaacgttacgggaaccgaacgtacgggacccacgtacgtacttacttcggtacgccgtaccgacgggtagggggcctagtttcggtacgtaccgtacgtacgtacttacgttacttacgttcggtacgtcgtcggggcgaaacgggccgtaacgggtccgacccggtccgtccccgtaggtaccccg

SEQ ID NO: 235301 - DNA, 618 bp, Homo sapiens
  misc_feature: GYAE6OF01DQR77.21.67.G01.1.454.CMB.1.raw
  modified_base (373)..(373): a, c, t, g, unknown or other
  misc_feature (373)..(373): n is a, c, g, or t
  modified_base (461)..(461): a, c, t, g, unknown or other
  misc_feature (461)..(461): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgaggaacctgagaatggacgacacggccacatattattgtgcgcgagtggggctagtttgagactactacgtattattacttnttggacgttctggggacaaagggacacggtcaccgtctccccagcctaccaccaacgggcccaagtccggtaccttccccgtggcccnccgtcgccgtccgaggtacgcacctccggacgagccacgacgccggcccgtagggccagtcccgtgggtaccaaacgggtccttaaccgtttccccgtcggttccttacccgttacgtcgggaacggtccgggtacgttcgggaccgtaaagggccg

SEQ ID NO: 235302 - DNA, 605 bp, Homo sapiens
  misc_feature: GYAE6OF01DVKZL.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactgtttttccgactatagtatcagttgggtgcgacaggcccttggacaagggcttgagtggatgggatgggccgtaccttcggacgaacggaaagagtggagtagtggtacgagggtaatttcgaggcagtaacttaccttagaccacagtacctcagtccgacgggacaacgagaccttacgttaggaactggaaggtaacctgaagaagtcggacgacgacgccacatattatgtgcgcggaggtggggatagtttagagtactacttacttattacttacttcgttaggtacgttcggtggggaccgaaacgggacccgtacggtacctacccgtcctccccgacgtaccccg

SEQ ID NO: 235303 - DNA, 556 bp, Homo sapiens
  misc_feature: GYAE6OF01CE7IK.21.67.G01.1.454.CMB.1.raw
  modified_base (340)..(340): a, c, t, g, unknown or other
  misc_feature (340)..(340): n is a, c, g, or t
  modified_base (356)..(356): a, c, t, g, unknown or other
  misc_feature (356)..(356): n is a, c, g, or t
tcagtcgtcgctcgcacgaccggtgctcgatttagagtatacatattgggtttggggacccaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcgggtgaaggtctcctgcagggcctctggttacagtttttccgactatagtatcagttgggtgcgacaggcccttggacaaggggcttgaggtggagtgggatgggccgacttcgcaacggaanagtaggagtatggtanaggaatttcaggcagtaataccttgaccagagactcagtccacgggcacgagcctacgtggaactgaggaacctggagaatggacgacgacggcacatatatgtgcgcgaggtggggatagtttgtagactactattattattattcgttgacgtcgtagggcgaaagggacctacggtacaccggtcctcccgagtccc

SEQ ID NO: 235304 - DNA, 644 bp, Homo sapiens
  misc_feature: GYAE6OF01CIMWP.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtgcccactcccagactcaactggtgcagtctggacctgaggtgaagagccgtggggcctcggtgaaggtctccgtgcgagggccttcgtggttactagtttttccgactactaccgacgggcacacgtcctacgttggaactggaacggaacctgagaagtggacgacacggacacgatattatgtgcgcggaggtggggctagttgtacgactacttactattattacgttcgttggtacgtcgtaggggacgaaacgggacctacggtccaccgtcctaccccgacgccctaccgaaccgaacgggcccaacgtccggttcccttacccccgtggcccgtccccgtgccctcgacggcgtaccaccgtcgacgacgccaccgtacggccggtccgtcggccgtacggtcccgtgggtaccacggtacccttaccgttcccgtcgttcctcgtaccgtgacggcggtcgtcggcgtaacggtcg

SEQ ID NO: 235305 - DNA, 689 bp, Homo sapiens
  misc_feature: GYAE6OF01BLC1W.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcgggtgaaggtctcctgcagggcctcgtggttactagtttttccgacttatagtatctagttgggtgcgacaggtcccttggacaagggcttgagtggatgggatgggccgaccttcgacgaacggaagagtggagtagtggtcaggtaattcgaggcagaattaccgtagaccacagactcactccgacgggcacgacgtctacgttaggaactggaacggtaaccgtagaagtaagtacgggaccgaacgaaccgggcccaacgtaagttaacgtttaacgtttggtacggtaccggtacggtagggtacggggggtacttaagtttagggtaacggtaacgttaacgttaacgttacgtttaactttaccgtttacgtttacgggtacgttaccggtggggggtacctaaaacggggtacccgtaaccgggtaccgtaaccccggtccttcccccgacggtacccccg

SEQ ID NO: 235306 - DNA, 671 bp, Homo sapiens
  misc_feature: GYAE6OF01A4L0X.21.67.G01.1.454.CMB.1.raw
  modified_base (508)..(508): a, c, t, g, unknown or other
  misc_feature (508)..(508): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtgggcctcggtgaaggtctcctgcgagggtcctcgtggttactagttttccgactactaccgacgggcacacgcctacgttggaactgaacggaacctgaagaagtcggaacgacgacggaccaactagttattagttggtcgcggacggtagggtggggtactagtttgtaacgtacttaactacttattaactttacgttcgttaggacgttcggtaggggacaaacgggacctacggtccaccgtcctacccgacgtccctccgaaccgacggccctacgttccgtccttccccgnggcccgtcccgtcgcccgtacggacgacgccctacccgtcgaacgacgaccgacgacggccggtcccgtgggcctcggcccgtagggtaccaacgggtacctaccggttcccgaggtcccggaccgtacgtacggacggtccggacgtgggaccgaacggtcg

SEQ ID NO: 235307 - DNA, 651 bp, Homo sapiens
  misc_feature: GYAE6OF01A8MMR.21.67.G01.1.454.CMB.1.raw
  modified_base (517)..(517): a, c, t, g, unknown or other
  misc_feature (517)..(517): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctcgtggttactagtttttccgactatagtatctagttgggtgtcgacgaggcccttggactaagggcttggagtggacgtggggagtcggggccgaccgttcgacgaacggaaagagtggagtagtggtacgaggtaatttcgaggactaaggtaacttaccgttaggaaccacgacgtactcgaactcccgacgggacacgacgtacctacgttggaactggaacggtaacctggaagtaagtaggacgacgacggaccactaatagttataggngcggacggacggtggggtactagtttgagactactacttattacgttacttgttacggtaggttcggtacggggtaacgaaaggggtacccgtaccgggttaccgacccgttcccgtcccgtacggtacccccg

SEQ ID NO: 235308 - DNA, 580 bp, Homo sapiens
  misc_feature: GYAE6OF01EA1EL.21.67.G01.1.454.CMB.1.raw
  modified_base (415)..(415): a, c, t, g, unknown or other
  misc_feature (415)..(415): n is a, c, g, or t
  modified_base (470)..(470): a, c, t, g, unknown or other
  misc_feature (470)..(470): n is a, c, g, or t
  modified_base (573)..(573): a, c, t, g, unknown or other
  misc_feature (573)..(573): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactgtttttccgactatagtatcagttgggtgcgacaggcccttggacaagggcttgagtggatggggatggggccgaccgtttcggacaacgggaagagtggagtagtggtcaggtaatttcgagggcaagtaattaccttgaaccacagactcatccacggacacngctactaggactgagactgagaagtggacgacacggccacgtatattatgtgcgngtaggtggggctagtttgagtacttactacttattattactttcgttacggtagttcggtaggggaccgaaagggaccgtacggtaccgacccgtctccccgngtccccg

SEQ ID NO: 235309 - DNA, 654 bp, Homo sapiens
  misc_feature: GYAE6OF01C925V.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctcgtggttactacgttttccgactatagtatcgaggttgggtgcgacacggcccgttggacaagggtcttggaggtggtagtggggagtggggcccgtaccgttcggacgaaacgggaaagagtagggagtagtggtacgaggtaatttcgaggtcaagtaattaccgtgacacacgactcagtccgacggcacgacgcctacgttcggaactggaacggaccctaggaacgtaagcggacgacgaccggaccaactattaagttagttcggtcgcggacggtagggtcggggtacttagtttaggtacgtacttaacgtacttaattattacgttcgttcggtacgttcggtacggggacgtaaacgggtacctacgggtaccctaccggtaccctccccgacgtacccccg

SEQ ID NO: 235310 - DNA, 613 bp, Homo sapiens
  misc_feature: GYAE6OF01AZIU0.21.67.G01.1.454.CMB.1.raw
  modified_base (607)..(607): a, c, t, g, unknown or other
  misc_feature (607)..(607): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctcgtggttactagtttttccgacttatagtatcgaggttgggtgcgacaggcccttggacaagggcttggagtggagtgggagtcgggccgtaccgttcgacgaacgggaaagagtagggagtagtggtacgaaggtattcgaggctaagtaacttaccgttagaccacgagactcacgtccgacgggcacgacgccgtacgtaggaactggaacgaaccgtagaagtaagtcggaaccgacgacggccaactattagttagtgtgcgacggtaggtggggcttagttgacgtactactagttattacttacgtgttcggtacgttggacgggacgaagggaccgtacggtcacccgttcctcccgntacccg

SEQ ID NO: 235311 - DNA, 719 bp, Homo sapiens
  misc_feature: GYAE6OF01CKSFT.21.67.G01.1.454.CMB.1.raw
tcagtcgtcgctcgcacgaccggtgctcgatttagagtatacatattgggtttgggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactataccacgggcacacgctactggaactgaggaacctgagatggacgacacggccacatattattgtgcgcgagtgggggctagttgtagactactactaattattacttcttggacgttcgtggggacaaagggacctacggtcacccggtctcccacgccctcccaccgaacgggccccagtccggtccttccccccgtgggccgtcccctcggtcctcccgacggacgaccgacccgtaccggacgtaacgccaaccgtacggacccgggtcccccggttagggggcccttacgggccccgttcggggtacccgtaaaaccgggggttacccgtttaaaccccgtttccccccgtttcccgggttacccctttacccggttaaccgtttaccggggaaccgggttcccggggggtaccgtttcccgggggaaccggtaacggggtaccccgg

SEQ ID NO: 235312 - DNA, 719 bp, Homo sapiens
  misc_feature: GYAE6OF01AWUCP.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcgggtgaaggtctccgtgcgagggcctcgtggttactaggtttttccgactatagtatcgagttgggtgcgacgaggtcccttgggacaagggcttgagtggagttggggagtcgggccgaccgttcgacgaacggaagagtaggagtagtggtacgaggtaactttcgaggactaggtaacttaccgttgacacgaggactacacgtccgacgggtcacgacgtcctacgtacgaactaggaacgtaaccgtggaagtacgtaaggaccgtacgaaccggccctaacgtaacttaagtttagttcgggtcgtccggtacgggagggttacgggggaccttaaggtttacggtaacgtacttaaccggttaacttaacgttttacgtttaacgtttcggtttcgggtaaccggtttcgggtacggggtaacgtaaaaccggggtcccggtaaccgggttacccgacccggttaccccgtcccccgggcgtaaccccccggg

SEQ ID NO: 235313 - DNA, 733 bp, Homo sapiens
  misc_feature: GYAE6OF01AT84I.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctccgtgcagggcctctggttactacgttttccgactatagtatcgagttgggtgcgacgacggcccttggacaagggcttgaggtggagtgggagtgggccgaccgttcgcgaaacggaagagtggagtagtggtacgaggtaatttcgaggcaagtaacttacgtcgaccacagtactcacgttccgacggacacgacgccttacgttaggaacctagggacggtaacccgtaggaacgtaaggttacggaaccgtaaccggaccggtacccgaaacgtacgttaagtttagtttacggtaggtccggtaccggtaggggttacgggggtaccttaaggttttacggtaacgttaactaaccgtttaacgttaactttaacgttttaacgtttccgtttacgggtaccggtttaccgggtacgggggtaaccgtaaaacggggacccgttaccggggttacccgtaacccggttccccgtacccccggtaccggttaccccccg

SEQ ID NO: 235314 - DNA, 721 bp, Homo sapiens
  misc_feature: GYAE6OF01C7FC0.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcctggggcctcggtgaaggtctcctgcagggcctctggttactagtttttccgactatagtatcgagttgggtgcgacaggcccttggacagggcttgaggtggagtgggatgggccgacgttcgacgaacggaaagataggagtagtggtacgaggtaagtttcgagggcaaggtaattaccgttagaaccacagtacctcaactccgaacggtaacacacgacctaacgttacggtaacgtggaacggaacccgtaggaagtaaacgtacggaaccgaacgaccggacccaactaacgttaacgttaagtttggttacggcgtacgggtacgggttaggggggtacctaaggttttacggtaacgtaaccgttaacgttaacgtttaaatttacgtttaacgtttaccgtttcgggtaaccgggtttcggttacgggggtaaccgtaaaacggggtacccgtaacccgggttaccgttaccccggtacccgttccccgtaccggtaacccccg

SEQ ID NO: 235315 - DNA, 582 bp, Homo sapiens
  misc_feature: GYAE6OF01CXU2Y.21.67.G01.1.454.CMB.1.raw
  modified_base (498)..(498): a, c, t, g, unknown or other
  misc_feature (498)..(498): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctcgtggttactagtttttccgactatagtatcagttgggtgcgacaggcccttggacaagggcttgagtggatgggatgggccgaccttcgacgaacggaagagtggagtatgggtcaagggtaatttcgaggcaagtaattaccgttgacctacaggtactcaatccgacgggcacagcctacgtggaactgaggacctgaagaagtggacgacgacggaccacatattatgtgcgacgaggtggggctagttgtanacgtactactattacttacttgttcggtacgttcggtgggacgtaaagggaccgtacggtacaccgtccctcccgagtaccccg

SEQ ID NO: 235316 - DNA, 565 bp, Homo sapiens
  misc_feature: GYAE6OF01B8HVH.21.67.G01.1.454.CMB.1.raw
  modified_base (462)..(462): a, c, t, g, unknown or other
  misc_feature (462)..(462): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactatagtatcgagttgggtgcgacaggcccttggacaagggcttggagtggatgggagtgggcccgtaccgttcgacaacgggaaagagtggagtatggtcaggtatttcgaggcagtaattaccgttgaccacagactcatccgacgggcacacgcctactaggaactgaacgactagagaatggacgacgacggacanatattatgtgcgacgaggtggggctagttgagtactatactattattattcgttgtagtcggtgggacgaacggaccgtacggtcaccgtctcccgcgtcccg

SEQ ID NO: 235317 - DNA, 1053 bp, Homo sapiens
  misc_feature: GYAE6OF01C5G0D.21.67.G01.1.454.CMB.1.raw
  modified_base (139)..(139): a, c, t, g, unknown or other
  misc_feature (139)..(139): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatcctttccnggtggcagcagcaacaggtgcccactcccagactcaactggtgcagtctggacctgaggtgaagagccgtggggcctcgggtgaacggtctccgtgcgacgggtcctcgtacggttactagtttttccgacttagtagtatacgtaggttgggtacgcggaacgacgggtccccgtttagggaaccgtaaggggtcctttaggggaaggttggggtaagttagggggggaacgttccgggggacccgttaacccgtttacggaccgaaaaccggggtaaagtaggtagggtaaggttagtagggtaccgtaagggtaatttaccggaggggtaacaagggtttaaactttacccgttacggtaaaccccgaacgtaacggttaaccctacgtaaaccgtaccccggtaaacggggaccgtaaaccgtaccgttaaccccgttaacgggtttaaccgggtaaaccgttaccgggggtaaacccggttaaaccccggttaaggggtaaaccgggtaaacggtttaaccggggaaacccgggttaaaacccgggtaaccccgggaaacccggtaaccttttaaaacggttttaacgtttttaaacccggggtttggttaacccggggtaccgggttaaccgggggtacgggttaacccggggggggttaacctttaagggtttttaacccgggttaacggttaaccccgttttaaaaccggtttaacccgttttaaaacgtttttaaccggtttttaaaccccggtttaccggtttttaacccggggggtaacccgttttaacccgggggtttaaaccgggggggtaaaccgttaaaacggggtaacccccggttaacccggttaacccgggttaccccccggtttacccgtcccccgtaaccgggtaacccccccg

SEQ ID NO: 235318 - DNA, 720 bp, Homo sapiens
  misc_feature: GYAE6OF01D2N65.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatcctttcctggtggcagcagcaacaggtgcccactcccagactcaactggtgcagtctggacctgaggtgaagaagcctgggcctcggtgaaggtctcctgcagggcctctggttactagttttccgactatagtatcagttggtgcgacaggcccttggacaagggcttgagtggatgggatgggccgaccgttcggcaacggaaagatggagtatggtacaggtaattcgaggcagtaattaccttgaccacagactcatccgacgggcaacgacgccgtaacgttacggaacgttcggaacggtaacccgtaggaagaacgtagggaaccgtacgaaccgggacccaactaagttaacgtttaagtttggtacggtacggaccgggtagggtacggggggtcttaagttttcggtaacggtaaccgttaaccgttaaccgtttaacgtttaaacgttttaaccgtttaccggtttacgggttaaccgggtttaccggttacggggggtaacccgtaaaaacggggtaccccgtaacgggttaaccccgtaccccggttaccctaccccccgtacggttaaccccccg

SEQ ID NO: 235319 - DNA, 619 bp, Homo sapiens
  misc_feature: GYAE6OF01BKI36.21.67.G01.1.454.CMB.1.raw
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcaggttggtgcgacaggcccttggacaagggctgagtggatgggatgggccgaccttcggacaacggaaagacgtgggagtagtggtacaaggtatttcgagggcaaggtaacttaccgttgaaccacagactcactccgacggcacacgcctacgtcggaactggaacgtaactgaagaagtggacgacgacggaccanatattntgtgcgtacgagggtggggtctagtttgtacgtactacgttacttaatttacttacgttacgttcggtaccggttcggtggggtaaccgtaaacgggacccgtacgggtaccctacccgttccctccccgtacggtacccccg

SEQ ID NO: 235320 - DNA, 604 bp, Homo sapiens
  misc_feature: GYAE6OF01CW9U2.21.67.G01.1.454.CMB.1.raw
  modified_base (491)..(491): a, c, t, g, unknown or other
  misc_feature (491)..(491): n is a, c, g, or t
  modified_base (595)..(595): a, c, t, g, unknown or other
  misc_feature (595)..(595): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcgggtgaaggtctcctgcagggcctcgtggttactagtttttccgacttatagtatcgtagttgggtgcgacaggcccttggacaagggcttggagtggatggggatgggccgaccgttcgcaacggaaagatggagtagtggtactaagggaactttcgagggtcaagtaacttaccgttgaccacagactcactccgacggcacgtgacctacgtggaactggaacgaaccgtagagaagtcggacgacgacggaccacgattattagttgngtcgcggtaggtggggctagtttgactacgtactactattacttactcgttcggtacgttcgtggggaccaagggtaccgtacggtacacccgttcctccccgngtacccccg

SEQ ID NO: 235321 - DNA, 753 bp, Homo sapiens
  misc_feature: GYAE6OF01CTRAQ.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatcctttcctggtggcagcagcaacaggtgcccactcccagactcaactggtgcagtctggacctgaggtgaagaagcctggggcctcggtgaaggtctcctgcagggcctcgtggttactagtttttccgactagtagtactcaggttgggtgacgacaggcccttaggacaagggcttggagtggatggggatcgggcccgtaccgttcgacgaacgggaaagagtggagtagtggtacgaaggtaatttcgaggcaagtaacttacccgttagacctaacgacgtacctcgtactacccgacgggacacgacgtcccgttaacgttcggaaccgttacggacggtaaaccccgtgaacggtaacgtacgggaaccgaaccggacccggaaccacgtaacgttaactttacgttgggtacgaccgggtacgggtacgggttcgggggtaccgttagttttacggtaacgtaccgttaaccttaacgttaactttaacgttttaccgttaccggtttcgggtaacggtttaccgggtacgggggaaccggttaaacccgggtacccggtaaacccgggtacctaccccgggttaccccgtacccccgtcggttaaccccccgg

SEQ ID NO: 235322 - DNA, 757 bp, Homo sapiens
  misc_feature: GYAE6OF01C0AC8.21.67.G01.1.454.CMB.1.raw
  modified_base (684)..(684): a, c, t, g, unknown or other
  misc_feature (684)..(684): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtagaagaagccgtggggcctcgggtagaaggtcctccgtggccgacgggtcctcgtaggttactacgtttttccgacttacgtaccgacgggcaacgacgaccttacgttggaactggaacggaacctagaagaagtaggacgacgacggtccaactagttattagttggtgccgagtaggtggggactagttagagtactacgtacttaattatttacgttcgttaggacgttcgtaggggtaccaaacgggtaccacggtcctaacccgtcctaccccgacgtccctaaccaaccggaacgggtccctaacgttcccggttcccttcccccgtacgggtcccgtccccgttacggcccgtacccggacgggtaccgcccttacccgccggaacgaccgacccgaccgtaacgggcccggtcccgtcgggtccctacggtccccgtagggtaccgaaaccgggttcccttacccggtttccccnccggtttccgttacccgttaccggtacgggtaacccgggtcgggtaccgttaccgggaaccggtagggtcccg

SEQ ID NO: 235323 - DNA, 443 bp, Homo sapiens
  misc_feature: GYAE6OF01AKCPD.21.67.G01.1.454.CMB.1.raw
  modified_base (426)..(443): a, c, t, g, unknown or other
  misc_feature (426)..(443): n is a, c, g, or t
tcagtcgtcgctcgcacgaccggtgctcgatttagagtatacatattgggtttggggagtatggtcaggaatttcagggcagaattaccttgaccacagactcatccacgggcacagcctacttggaactgaggaacctgagaatggacgacacggccacatattattgtgcgcgagtgggggcatttgtagactactactattattacttcttggacgtctggggcaaagggaccacggtcaccgtctcccccagccctccaccgaacgggcccatccggtccttcccccctggccgcccctgcctcccaggacgccaccctcccggagagccacgacgccggccctggggctcggcccgtgggtcaacgggtcctaccttcccgagccgacgactgaggcgggctgggcaacggcgacagtagnnnnnnnnnnnnnnnnnn

SEQ ID NO: 235324 - DNA, 916 bp, Homo sapiens
  misc_feature: GYAE6OF01BCXBU.21.67.G01.1.454.CMB.1.raw
tcagtcgtcgctcgcacgaccggtgctcgatttagagtatacatattgggtttggggacccgaaaaaccacacccctccttgggagattcccctagatcacagcccctcaccatgggactgggacctggagcatcctttcctggtggcagcagcaacaggtgcccactcccagactcaactggtgcagtctcggacctgaggtgaagaacgccgtggggcctcggtgaaggtctctgcgagggcctctggttactaggttttaccgaacttagtagtatcgtaggttgggtgcgacgaggcccttggacgaaggtcttggacgtggagtgggatcgggtccgaccgttcgacgaacgggaaacggacgtaggaaggttagtcgggtaccgaagggtaacgttttccgaaggggtaccgtaaaggtaactttaacccgttaggaaacccgaacggtaacggtacccttaccgaaacgttacccggaaaccgggaaacctaaccgtaacggtacccgttacggtttaacgggaaacgttaccgggaaacggtaaaccccgtaggaacggtaaacgttacgggaaccgtaacggaacccgggtaccgtaaaccgtaagtttaaacgtttaacgttacgggttacggacccggtaacggggtaaggggtttccggggggttaccggttaagggtttttacgggtaaacgggttaaccgttaaaccgtttaaccggtttaaacgtttttaaaccgtttaaaccgggttttttaccggtttacggggttaaccccgggtttacccgggttaaacgggggggtaacccggttaaaaccgggggttaacccccggtaaaccgggggttaccccgttaaccccgggttacccccgtttaccccccggtaccgttaaccccccggg

SEQ ID NO: 235325 - DNA, 801 bp, Homo sapiens
  misc_feature: GYAE6OF01DA23F.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtgggcctcggtgaaggtctccgtgcgacgggtcctcgtggttactagtttttccgactagtagtatcgtaggttgggtgcggacacggtcccgttggaactaagggtcttaggaggtggtagtaggggagttcggggacccgtaccgttacggacgaaacgggtaaagagtagggtaagtagtggtacgtaggtaatttcgaagggtacaaggtaacttaccgtagaaccacagtactcgacgtccggacggacacgtacgtaccgtacgttacggaacgtagaacggtaacctggaaacggtaagtcgggaaaccgaaccgtaccggacccgtaactaagtttaacgtttaacgttacggtacggtacccggacggggttacggggttacgggggtaccttaagggtttacggttaacgttaaccgttaacctttaacgtttaacgtttaccgttttaaacgttcggttttaacgggtaaccgggttacggttaaccgggggtaaaccggtaaaaccggggttaacccccgttaacgggttacccccgttaaccccggttcccccttacccccggtaacgtaaccccccgg

SEQ ID NO: 235326 - DNA, 823 bp, Homo sapiens
  misc_feature: GYAE6OF01AK254.21.67.G01.1.454.CMB.1.raw
tcagtcgtcgctcgcacgaccggtgctcgatttagagtatacatattgggtttggggacccgaaaaaccaacacccctccttgggagattcccctagatcacagcccctcaccatggactggacctggagcatccttttcctggtggcagcagcaacaggtgcccactcccagactcaactggtgcagtctggacctggaggtgaagaagccgtggggcctcggtgaagggtcctcctgcgagggcctctggttactcgtttttccgacttataccgacgggcacacgcctacttggaactggaacggaacctgacgtaaagtcggaacgaccgacgggccaacacgttaattacgttggtgtcggcgtaaggtgggggactagttttggtaaggtacctacttaacgtttattaactttaacgttgttacgggtaccgttcgttaggggggacctaaaacggggtacccgtacgggttaccgtaaccccggttacctacccccgacggtcccccgttaccccgaaccgtaaacccgggggtcccctaacgttacccggggttaccccttttccccccggtaacgggtccccggtcccccggttacggcccctttacccgggaacggtacccgggtaaccaccccggttaacccgaacgggaccgtcccggaacccgtaaccgggcccgggtaaccccggtcgggaccgttccgggcccgttgggtaccccgaaagggttacccgttacccgtttccccgttacgtcccgttacccgttacgtaccggtaccgccgggggtctaccgggtgaaccgggtaccg

SEQ ID NO: 235327 - DNA, 647 bp, Homo sapiens
  misc_feature: GYAE6OF01AB9QG.21.67.G01.1.454.CMB.1.raw
  modified_base (281)..(281): a, c, t, g, unknown or other
  misc_feature (281)..(281): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgacttatagtatcagttgggngtcgacaggcccttggacaagggcttggagtggagtgggagtcgggccgacttcgcaacggaagagtggagtagtggtcgaggtaatttcgagggcagtaacttaccgttagaccacagactcactccgacggcacagcctacgtggaactgacggaactgagaagtaggacgtacgacggaccaactattacttaagttgtcgtacgacgggtagggtacgggggtacttagtttacggtaacgtacttaacgttaacgttagttttaacgtttaactttcgttacgggtaacggttcggtcggggtaaccgtaaagggacccgtaaccgggtacctacccggtcccgtccccgtacgtcccccg

SEQ ID NO: 235328 - DNA, 753 bp, Homo sapiens
  misc_feature: GYAE6OF01DHYDY.21.67.G01.1.454.CMB.1.raw
  modified_base (281)..(281): a, c, t, g, unknown or other
  misc_feature (281)..(281): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtgcccactcccagactcaactggtgcagtctggacctgaggtgaagaagccgtgggcctcggtgaaggtctcctgcgaggcctctggttactagtttttccgactatagtatcgagttgggngtcgacaggcccttggacaaggcttgagtggatcgggaatcgggccgtaccgttcgacgaacggaaagtatagggagttagtggtacgaggtaatttcgaggtacagtaaacgttaccgttaggaaccaacaggtacctcgtactacccgaacgggccaacgtacgtacccttacgttacggaaacgtggtaaacggaacccgttagaaagtaaacgtagggaaccggaacgaacccgggacccaacgtaacttaagtttaacgttagtaggtaccgacggtaagggttggggggtaccttaagttttacgggtaggttaacccttaacttaacgtttaacgtttacgtttaacctttcggtttaaccgggtaggtttcccgggttaacgggggaaccgtaaaaccgggggaacccgttaccgggtaaccccgttaccccgggtacctaccccccgtacggttaaccccccg

SEQ ID NO: 235329 - DNA, 273 bp, Homo sapiens
  misc_feature: GYAE6OF01ETITS.21.67.G01.1.454.CMB.1.raw
  modified_base (259)..(259): a, c, t, g, unknown or other
  misc_feature (259)..(259): n is a, c, g, or t
  modified_base (265)..(273): a, c, t, g, unknown or other
  misc_feature (265)..(273): n is a, c, g, or t
tcagtcgtcgctcgcacgaccggtgctcgatttagagtatacatattgggtttgggggcatttgtagactactactattattacttcttggacgtctggggcaaagggaccacggtcaccgtctcccagcctccaccaagggcccatcggtcttccccctggcgccctgctccaggagcacctccgagagcacagcggccctgggctgcctggtcaaggactacttcccgagcgacgactgagcggggctggcaaggcncatagnnnnnnnnn

SEQ ID NO: 235330 - DNA, 635 bp, Homo sapiens
  misc_feature: GYAE6OF01EU20Z.21.67.G01.1.454.CMB.1.raw
  modified_base (487)..(487): a, c, t, g, unknown or other
  misc_feature (487)..(487): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtgggcctcggtgaaggtctcctagcagggcctcgtgttactacgttttccgactatagtatcgtaggttgggtgcgacgacggtcccttggacgaaggtcttggagtgggagtgggagtcgggccgtaccgtcggacgaacggaagtagtaggtagtagtgtacgaggtagttcgaggacagtatactagacacacgactcactcgacgcgacacgtactacgttagactagacgactagaagtatcggacgacgaccggacactatattgtaggtnaccggtggaggttacggggattaagtttcgaagtaccttacttacgttactttaacgttactttccggtaggtacggttcggtacggggaacgtaaaacgggccgttaacccgggtcaaccccggttcctaccccggtagtacccccg

SEQ ID NO: 235331 - DNA, 700 bp, Homo sapiens
  misc_feature: GYAE6OF01DFLBT.21.67.G01.1.454.CMB.1.raw
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctgtggttactagtttttccgactatagtatcgaggttgggtgcgacgacggtcccttagggaccgtaaggggtctttaggaggtgggagttgggggaagtcggggacccggtaccgtttacggaccgaaacgggtaaagacgtagggtagttagtggtacgaggtaatttacggagggacaaggtaacttaccgttagaccctacacgactcgacgtacccgacgggacaacgacgtaccttacgttacggtaacgtaggaacggaacctggaagtaacgtcgggaaccgacgaccggaccataacttagttagttgtcggcggtaggacgggtggggtactaggtttagtacgtacttacttacttaattacgtttacttcgttggtacggtacggttaggggaccgtaaacgggccgtaccggtaccgtacccgttccctccccgtcgtacccccg

SEQ ID NO: 235332 - DNA, 831 bp, Homo sapiens
  misc_feature: GYAE6OF01A4F5Z.21.67.G01.1.454.CMB.1.raw
  modified_base (225)..(225): a, c, t, g, unknown or other
  misc_feature (225)..(225): n is a, c, g, or t
  modified_base (330)..(330): a, c, t, g, unknown or other
  misc_feature (330)..(330): n is a, c, g, or t
tcagtcgtcgctcgcacgaccggtgctcgatttagagtatacatattgggtttggggacccaaaaaccacacccctccttgggagattcccctagatcacagccctcaccatggactggacctggagcatcctttcctggtggcagcagcaactaggtgcccactcccagactcaactggtgcagtctggacctgaggtgagaagcctgggcctcggtgaggtcncgtgcagggcctctggttactaggtttttccgacttactaccgacgggcaccagtccttacttcggaactgtaggaacctaggacgaatggacgaccacggccanactaattatcgtagcgacgaggtggggtactagttgtagactacgtaacttattaactttacgttcttcgggtaacgttccgtagggggaccgtaaaacggggtaccgaaccggttcaacccggttacttacccccaacgtccccgtacccgtaaccgaaccggggtacccctaagttacccgggtacccgtttacccccgtagggaccccgtccccgttacggtaccccgttaccggaacgggtaaccgttcccgaaacccgtttcccggaaggtaacccgacccgtaaaccggacggtaccccgggtacccggttaccggggacccgtttaccgggtaccccggttacgggggttaccccgtaaaacggggggttacccttaaccccggtttttacccccggttacccgggtttaccccggttaccgttaacccggtttacggaacccggggttacccggggtaccgttacggggaccccgggtaacgggtaccccggg

SEQ ID NO: 235333 - DNA, 799 bp, Homo sapiens
  misc_feature: GYAE6OF01DR2KO.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtcgcccactcccagactcaactggtgcagtctggacctgaggtagaagaagccgtgggcctcggtgaaggtctcctgcgacgggcctcgtggttacgtagtttttccgactatagtatcgtaggttggtcgcgacgacggtcccgttaggaacgtaagggtcttaggaggtagggtagtaggggtaagtcggggtacccggtaccgttacggaaccgaaacgggaaaggtagtagggtaggttaacgttggtacgaaggtaactttacggagggtacgaagttaaacttaccgttagaacccgacacgtactacgtacgtaccgaaccggaacaaccgacgtaccgttaacgttacggaaacgttagggaaaccggtaaccgtagggtaaagaaacggttcggaaacccggaaccggacccggaaccgaaccgttaatttaagtttaacgtttcgggtagacccgggtagggtaacggggttgggggtacttaaggttttacggttaaccggttacttaacgtttaaacgttatttacgttttaccgtttacgttacgggtaccggttacggttacggggaacgtaaacgggacccgtaacggttaacccgaccgtttaccccgtcccgacgtaacccccg

SEQ ID NO: 235334 - DNA, 607 bp, Homo sapiens
  misc_feature: GYAE6OF01B5A6N.21.67.G01.1.454.CMB.1.raw
  modified_base (593)..(593): a, c, t, g, unknown or other
  misc_feature (593)..(593): n is a, c, g, or t
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtgggcctcggtgaaggtctcctgcgagggcctcgtggttactagtttttccgactactaccgacgggcacacgcctacgttcggaactgacggaacctgagaagtggacgacacggcacatattatgtcgcgcgaggtggggctagttgtagactactattattattacttcttggacgtcgtggggacaaacgggaccacggtaccaccgtcctccccgagccctaccgaccgaacgggccctacgtccggttcctccccgtggccgtcccgtcgcctccgacggacgcctaccgtcgacgacgaccgacgacggcccgccgtcggctcgccgtggacgaacggtcctaccgttcctcgtcctctacgtcggacggccggngcggacgacggtcg

SEQ ID NO: 235335 - DNA, 760 bp, Homo sapiens
  misc_feature: GYAE6OF01ASEVE.21.67.G01.1.454.CMB.1.raw
  modified_base (430)..(430): a, c, t, g, unknown or other
  misc_feature (430)..(430): n is a, c, g, or t
tcagtcgtcgctcgcacgaccggtgctcgatttagagtatacatattgggtttgggggacccaaaaaccacacccctccttgggagattcccctagatcacagcccctcaccatggactggacctggagcattccttttcctggtcggcagcagcaacaggtcgcccactcccagacctcaactggtgcagtctggacctgaggtgaagacgccgtgggcctcgggtgaacggtcctccgtagcgacgggtcctcgttaggttacctacggtttttccgaacttagtagtatcgtaaggttgggtgcgacgaggcccttggacgaagggcttggagtggagtgggacgtcgggccgtaccttcggacgaacggaagatacggatagtggtacaggtattcgaggtctaagtaacttacgttagaacctanacggtactacgtacgtaccgacggacctaacgaccgtccgttaacgttacggtaaacgtacggaacggtaacccgtaggaacgtaaggttacggaaccgaaccggaaccggacctaacctaagtttagtttaacgttaggtacgggaccgtacgggtaacggggtggggtacttaaggtttacggtacgtaaaccgttaacgttaaccgttaactttaacgtttaccgtttacggttacgggtacgtacgggttaacgggggaaccgtaaaacggggacccgtaaccggttcccgtaaccgttccccgtaaccccgccggttaacccccg

SEQ ID NO: 235336 - DNA, 574 bp, Homo sapiens
  misc_feature: GYAE6OF01BGB1A.21.67.G01.1.454.CMB.1.raw
  modified_base (452)..(452): a, c, t, g, unknown or other
  misc_feature (452)..(452): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcgggtgaaggtctcctgcagggcctcgtggttacagtttttccgactatagtatcagttgggtgcgacaggcccttggacaagggcttgagtggagtgggatgggccgaccttcgcgaacggaaagagtggagtagtggtcaggaatttcgaggcagattaccgttgaccacacgactcatccacgacacagcctactagactagacggaacctgagaatggacgacgacgccanactattattgtgcgacggaggtggggtcgtagtttagtacgtacttactacttattagttacttacgttgtagttcggtgggacgtaaggaccgtacggtcaccgtcctccccgcgtacccg

SEQ ID NO: 235337 - DNA, 773 bp, Homo sapiens
  misc_feature: GYAE6OF01BJMQF.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctggaggtgaagaagccgtggggcctcgggtgaaggtcctccgtgcgagggcctcgtggttactgtttttccgacttagtagtatcgtagtttgggtgcgacacggtcccgttggacgaagggcttggaggtggacgtgggggagtcggggccgtaccgtttcggacgaaacgggaaagtacgtgggaagtagtggtacgaaggtaatttcgagggctaagtaacttaccgttagacccaacgacgacctacacgtacccggacggaccaacgacgtacccgttaacgttaggaaccgtagaacgggtaaaccttagaaggtaaacgtcgggaaccgtaaccgaccggaccaacgaacgtttaagtttacgttaggttaggccggtacgggtaaggggtcggggggtaacttagtttacgggtaacgtaccgtttaaccttaacgttaacttttaacgtttaaccgtttcggtttaacgggttaccggttacgggtaccggggtaacggtaaaccggggtaacccggtaacgggttaccccgtacccggttacccctcccccggtacgtaacccccccgg

SEQ ID NO: 235338 - DNA, 560 bp, Homo sapiens
  misc_feature: GYAE6OF01ETGAV.21.67.G01.1.454.CMB.1.raw
  modified_base (400)..(400): a, c, t, g, unknown or other
  misc_feature (400)..(400): n is a, c, g, or t
  modified_base (548)..(548): a, c, t, g, unknown or other
  misc_feature (548)..(548): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccgaccttcgcaacggaaagagtggagtatggtcaggaatttcgaggcagaattacctgaccacagactcatccgacgggnacagcctacttggaactggaggaacctgagaagtggacgacacggccacataattatgtgcgcggaggtgggggcgtatttggtagactactactattattacttcgttacggtcgtcgtgggacaagggtaccacggtcaccgtccnccccgagtcccc

SEQ ID NO: 235339 - DNA, 732 bp, Homo sapiens
  misc_feature: GYAE6OF01E1VQD.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacgaagggcttggagtggagtgggagtcgggccgtaccttcgacgaacggaagagtggagtagtggtcaggtattcgaggcaagtaattactgaccacgagactacactaccgacgggaccacgacgtaccctacgttacggaacgtaggaacggtaaaccgttaggaacggaacgttacgggaaccgtaccgaaccgggaccctaacgtaattaacgtttaacgttgtacggaccggtacggtaagggtacgggggtaccttaaggttttacggttaacggtaaccttaaccgttaacgttaacttttaaactttaccgttttacggtttacgggttaacccggttcgggttaccgggggtaacgtaaaaccggggtacccgtaaccgggttaccgttaaccccggtaccccgttacccccgtacccggtacccccgg

SEQ ID NO: 235340 - DNA, 648 bp, Homo sapiens
  misc_feature: GYAE6OF01DXOUZ.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactacgttttccgactatagtatcagttgggtgcgacacggtcccttggacaagggcttgagtggagtgggatggggccgaccttcggacgaacggaagagtggagtagtggtacaggtaactttgagggctaggtaaacttaccgttgaaccaacgagacctcatcccgaacggtacaaccgacgtacctaacgttaggaactggaacggtaacctgaagtaaagtcgggaacgacgaccggaccaacgtattattagttgtggcgtaggagggtcggggcgtagtttagtagtacttactaacgttatttagttactttcgtttcggtacgttcggtaggggaaccgaaagggtacccgtacgggttacccacccggttcctccccgtacgtacccccg

SEQ ID NO: 235341 - DNA, 737 bp, Homo sapiens
  misc_feature: GYAE6OF01EOYVD.21.67.G01.1.454.CMB.1.raw
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtgggcctcggtgaaggtctctgcgacggcctcgtggttactacgttttccgactataccgacgggcacacgccgtacgttggaactgaacggaacctgaagagtggacgacgacggaccactattattagttggtcgcggcggtagggtggggtctagtttaggaagtacctacgttaacttagtttaacttacgtttcgttacggtacgttcgggtacggggtaacgtaaacggggacccgtacggtaccgtacccggtccctaccccgacgtcccctacccgaaccgacgggcccctacgttcccggttcccttcccccggtacggccccgtcccgtacgtcccgtcccggacggaccgcccgtacccgtccggaacgaccgaccgaccgacgggcccgtacccggtcgggcccgtccggtccgttacgggtaccgtaaccgggtaccctttacccggttcccgtacccgttccgtaccgttacggtcgggaccgggtccggtacggtcggaaccgacgggtccg

SEQ ID NO: 235342 - DNA, 723 bp, Homo sapiens
  misc_feature: GYAE6OF01D4K2H.21.67.G01.1.454.CMB.1.raw
tcagtcgtcgctcgcacgaccggtgctcgatttagagtatacatagttgggtttggggacccaaaaaccacacccctccttgggagattcccctagatcacagcccctcaccgatggactggacctggagcatccttttcctggtggcagcagcaacgaggtgcccactcccagactcaactggtgcagtctggacctgagtgaagagcctgggcctggtgaaggtctccgtgacagggcctcgtggttactagttttccgatagtagtatctaggttggtgacgtacacggtcccgttggacgaagggtcttggagtggtagtgggtagtgggacctaccgttacgacgaaacgggaaagtagtagggagttagtggtacgtaaggtaatttcggaggcaagtaacttaccgttagaaccgacgacgtactacactccgacggtcacgtacgccgttacgtaggaacgtggaacggtaacgtagaagtaagtacggaacgtacgaacggacccacgtaattagttaacttagggtcgaccgggacggacgggttcgggggtacgttagtttacggttaacgttacgttaaccgttaacgtttaagttttaacgtttaaccgtttaccggtttagggtaaccggttcggttacgggggaacgtaaaccggggtacccgtaccgggtacccgtaacccgttcccctacccgtaccgtacccccg

SEQ ID NO: 235343 - DNA, 870 bp, Homo sapiens
  misc_feature: GYAE6OF01C5BK1.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcattcctttcctggtggcagcagcaacaggtgcccactcccagactcaactggtgcagtctggacctgaggtgaagagccgtggggcctcggtgaaggtctccgtgcaggggcccctggttacgtacgttttcgttaccgtaatagtatcgtagttagggttggtcgaccgaggtcccgttaccggtaggaacggtacgttcgtaggtaggtagtagggtaggtacggtccgggtacccttacggtaccgaaacggaaacggtaagtcggtaaggtagtaggtacgtaaggtaagtttacgtacgggacgtaacgtaaacgtttaaccgttcggtaaccgaaccgtaacgaaccgtacctacgtacccggtaaccgggacgtaaccgtaaccggtaccgtttaacccgttaagggtaacccggtaagtaacggggtaaacccgtacgtaagggaaaacggttaccgggaaccgaacccggtaaccgggacccctaaacgtaaagtttaacgttttacgttacgggtcgggtaccgggaacggtagggggttaacgggggtacctttagtttacggttaaccgtaaccgtttacgtaaccgttttaaacgttttaacgttacccgtttttacgttccggggtaaacggttaccggtttacggggggaacgtaaaacccgggtaacccggcccgtttacccggaaccctttcccgtaaccccccgccgttcgtaaaccccccgg

SEQ ID NO: 235344 - DNA, 642 bp, Homo sapiens
  misc_feature: GYAE6OF01AGG8F.21.67.G01.1.454.CMB.1.raw
  modified_base (237)..(237): a, c, t, g, unknown or other
  misc_feature (237)..(237): n is a, c, g, or t
  modified_base (282)..(282): a, c, t, g, unknown or other
  misc_feature (282)..(282): n is a, c, g, or t
  modified_base (352)..(352): a, c, t, g, unknown or other
  misc_feature (352)..(352): n is a, c, g, or t
  modified_base (484)..(484): a, c, t, g, unknown or other
  misc_feature (484)..(484): n is a, c, g, or t
  modified_base (633)..(633): a, c, t, g, unknown or other
  misc_feature (633)..(633): n is a, c, g, or t
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcngggcctcgtggttactagtttttccgatatagtatcgagttgggngcgacaggcccttggacgagggcttgaggtggagtgggagtcgggccgaccgttcggcgaaacggaaagngtaggagtagtggtcaaggtattcgagggctaagtaacgttaccttgaacctacgaagtactacgactccggacggcacacgcctagtggactggaacgaccgtgagaagtcggacgacgacggaccaactnttaagttagttcggtacgacggcggtagggtggggtacttgtttaacgtacgtactacgttacgtaatttcgttaaccttggttcgggtaacgttcggtggggaacgtaaacgggtaccgtacggtacccgtaccgtacccgtccccgngtacccccg

SEQ ID NO: 235345 - DNA, 689 bp, Homo sapiens
  misc_feature: GYAE6OF01BDAJ3.21.67.G01.1.454.CMB.1.raw
  modified_base (430)..(430): a, c, t, g, unknown or other
  misc_feature (430)..(430): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtcgcccactcccagactcaactggtgcagtctggacctggaggtgaagagccgtggggcctcgggtgaacggtctccgtgcgacgggcctcgttggttactacgtttttccgacttagtagtatcgtaggttgggtgacgacgacggtcccgttaggacgtaagggtcttaggaggttggagttggggagtcgggtcccgtaccgttcggacgaacggaagtagtaggtagtagtggtacgaggtattcgaggcagtaacttacgtagacanagactacacgtaccgacggacacgacgtacgtacgtacgaacgtagaacgtaccgtagaagagtacggacgacgaccgaccaagtattagttactaggtcgtacggtacggtacgggtacggggtacttagttacgtaacgtacgttaacgttaacgttatttacgttaccgttacggttacggtacggttacggtcgggaacgtaaccgggtaccgtacgggttacccacccgttcccgtaccccgccggtaaccccg

SEQ ID NO: 235346 - DNA, 813 bp, Homo sapiens
  misc_feature: GYAE6OF01EJBH0.21.67.G01.1.454.CMB.1.raw
  modified_base (365)..(365): a, c, t, g, unknown or other
  misc_feature (365)..(365): n is a, c, g, or t
tcagtcgtcgctcgcacgaccggtgctcgatttagagtatacatattgggtttggggacccaaaaaaccacacccctccttgggagattcccctagatcacagcccctcaccatggactggacctggagcattccttttcctgggtggcagcagcaacaggtcgcccactcccagactcaacgtggtgcagtctggacctggaggtgaagagccgtgggcctggtgaacggtctcgtgcgaggtcctgtggttactgttttccgattagtagtatcgtaggttggtcgacgacgcggtccgttaggaacgaggtcttaggaggtggtagtgggagtcgggccgtaccgtcgacgaaacggtaagngtaggagtagtggtacgtaaggtagttcggaaggtactaaaggtaacttaccgtacgaaccgtaacgtacgtaacctacgtaacgtacccgaaacggtaccaaccggtaccgtaccttaacgggttaacggaaccgttacggaaacgggtaaccctagggtaaacgtaacggtaccggaaaccggaaccgtacccgggaacctaagttaactttaaagtttcgtaggtacggacggttaaccggggtagggtaccggggtactttacgggttaacggtaacgtaaccgtttacgttaaacgtttactttaacgggtttaaccctttgggttaaccggttaccgggttacgggtaccgggggtaaaaccgtaaaccggggtaccccgttaaaccgggtcccccgtaaaccccgggttccccgttaccccggacgttaaccccccccggg

SEQ ID NO: 235347 - DNA, 782 bp, Homo sapiens
  misc_feature: GYAE6OF01C4H6C.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctgggcctcggtgaaggtctctgcagggcctcgtggttactagtttttccgactatagtatcagttggtgcgacgaggcccttggacaagggtcttggagtggagtcgggagtacgggcccgtaccgttccgacgaacggaaagacgtaggtagtagtaggtacgtaagggtatttacggagggtacgaagtaaactttaaccgttacgaacccgacgtaacgaacgttactaacgtaccggaaccggtaccgaaccgtacgtaccctttaacggtacggtaaaccgtaggaacggtaaccccgttaggaaaggtaaacgttacgggaaccgaaccggtaacggacccgaaacttaacgttaatttacgttagttacgggccgtacgggtaagggtacggggggtacttaaggttacggttaacgtaaccgttaaccttaacgtttaactttaaacgttttacgttaccgtttacggggtaaccgttacgggttacggggtaaaccggtaaacgggtaaccccgtacgggttacccgttacccggtacccgttaccccgtaccggtaccccccg

SEQ ID NO: 235348 - DNA, 672 bp, Homo sapiens
  misc_feature: GYAE6OF01EX2WR.21.67.G01.1.454.CMB.1.raw
  modified_base (590)..(590): a, c, t, g, unknown or other
  misc_feature (590)..(590): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtcgcccactcccagactcaactggtgcagtctggacctggaggtgaagaacgccgtggggcctcgggtgaaggtcctctgcgaggccttcgtggttactagttttccgacttatagtatcgtaggttgggtcacggacgacggtcccgttaggacgaagggtcgttggaggtggagtggggacgtcgggcccgtaccgttcgaacgaaacggagtagtaggacgttagtggtaagaggtattcgaggacaagtacgttacgtcgaaccacgatacgtcacgtaccggacgacacgcgtactacgttaggactgaacgtaccgtaggaacgagtacggaacgaccgtaccgactaatacgttagttacgtgacggcggtaggtaggggtgggtacttaggttacgtacgacttacgtacgttatttaccgttnttacggttacgggacgtttacggacggggaacctaaacgggacccttcggtaccgtacccttaccgtccccgcgtaaccccg

SEQ ID NO: 235349 - DNA, 624 bp, Homo sapiens
  misc_feature: GYAE6OF01AXV6P.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgaggaacctgagaatggacgacacggccacatattatgtgcgcgagtgggggcatttgtagactactactattattacttcttggacgtcgtggggcaaaagggaccacggtcaccggtctcccagccctccaccaagggcccatccggtccttcccccgtggccgccctcgcctccgacggcgccacccgtccgacgacgccgaacgtagccggcccctggggcctcggccctcgggtccgaaacggtaccttaacccgttcccccgttacggtcccttaccgtaccttcgggaacgtcccgggggacctcggggaccgtaaacggggtcccg

SEQ ID NO: 235350 - DNA, 744 bp, Homo sapiens
  misc_feature: GYAE6OF01CQ2FR.21.67.G01.1.454.CMB.1.raw
  modified_base (362)..(362): a, c, t, g, unknown or other
  misc_feature (362)..(362): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctgggggcctcggtgaaggtctccgtgcgagggcctctggttacagtttttccgattatagtatctagttgggtgcgaactggcccgttggacaagggcttgagtggatgggatgggcgacgttcgacgaacggaagagtggagtagtcggtanaggatttcgaagggcaaggtaattaccgttgaaccacgagtacttacgattacccggacgggcacgtagccctacgttaggaacttacggaacggtaacccgtaggaaggaaacgtacggggaactacccggaacgggacccaaaccgtaacgttaacgtttaagttacggttacggacggtaccgggtagggtttacccgggggggtcttaagttttggtaacgtacggttaaacttaaaccggtttaagtttaaacttttaacccgtttacggtttccggttaaccgttacgggttacgggggtaaccggtaaaaaccggggtccgttaacccgggtacccgtaaccggtttcccgtaccccgttacggtaaccccccgg

SEQ ID NO: 235351 - DNA, 887 bp, Homo sapiens
  misc_feature: GYAE6OF01DK3F7.21.67.G01.1.454.CMB.1.raw
  modified_base (187)..(187): a, c, t, g, unknown or other
  misc_feature (187)..(187): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcattccttttccgtggtggcagcagcaacaggtcgcccactcccagactcaacgtggtnctagtctcggacctggaggtagaagacgccgtggggccgttcggtagacggtctccgtgcgacggtccttcgtaggttacttacgttttccgactacgtaccgacggtcacgtacgtaccgttacgtaggaacgtaggaacggtaaccgtaggaagtaagtcggaacggaccgtaccggacctaactagttaacgtttagttcggtacggtacggtacgggtagggttcgggtacttagttaggtaacgtacttaacgttaactttaagttactttaccgttcgttacggtacggttccggtacggggtaaacgaaaccgggtaccgtacccggtacccgtacccgtacccgttaccccaacggtaccccctacccggaaaccgaacccggggttcccccttaacggtttcccccggttccccgtacccccgggttcgggaccccccgtttcctcggtaccccgtacccggtaacgggaccgaccccgtttacccggacgggtaacgggtaccccgacgaccccgggtacgggttcccccggggtcccgttccggggtacgttaccgggaacccccgggtttagtaccccgggtaaacccgtttaaccctttccccccggttacccgttcggttaccccttaccggtaacggggacggttccgtacccgggggtgtacccggggacggtaacccggtccg

SEQ ID NO: 235352 - DNA, 568 bp, Homo sapiens
  misc_feature: GYAE6OF01AMQSQ.21.67.G01.1.454.CMB.1.raw
  modified_base (440)..(440): a, c, t, g, unknown or other
  misc_feature (440)..(440): n is a, c, g, or t
  modified_base (453)..(453): a, c, t, g, unknown or other
  misc_feature (453)..(453): n is a, c, g, or t
  modified_base (561)..(561): a, c, t, g, unknown or other
  misc_feature (561)..(561): n is a, c, g, or t
tcagtcgtcgctcgcacgaccggtgctcgatttagagtatacatattgggtttgggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactatagtatcagttgggtgcgacaggcccttggacaagggcttgagtggatgggatgggccgaccgttcgcaacggaaagagtggagtagtggtcagggtaatttcgaggcaagtaattaccttgaccacagactcatccacggaccacacgcctactggaactgacgacctgaganggacacacgccanatattatgtgcgacgaggtggggtctagtttgagtactactactatttattacttcgttggtacgttcgtgggtacaaacgggacctacggtccaccgtcctccccgngtccccg

SEQ ID NO: 235353 - DNA, 844 bp, Homo sapiens
  misc_feature: GYAE6OF01CN738.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatcctttcctggtggcagcagcaacaggtgcccactcccagactcaactggtgcagtctggacctgaggtgaagacgccgtgggcctcggtgaacggtctccgtgcgaggtcctcgtgtactacgttttccgactatagtactcgtaggttgggtacgccggtacgacggtcccgttaggaacgtaagggtcgttaggtaggtacggagtggggtacgtcggggacccgtaccgttcgaacgtaaacgggaaagtagtagggtaagttacgtaggtacgtaagggtaacgtttcggacgggtactaacggttaacttaccgtacgaaccgacgacgtaccgtacgtacgtacccggacggtacaccgtacgtaccgttacgttaacggaaccgtagaacggtaacctggtaaggaacgtcggaaccgtaccgaaccggtactaacgtagtttacgttagttcggtacggtaccggtcgggtaacgggtcggggttacttaagggtttacggtaaccgtacgtttaaaccgtttactttaaacgttttaccggttttaaccggttttacgggtttaccggttaacccgggtttacggggttaaccgggggtaaaacccgggttaaaacccggggttaccccggttaaacccgggttaccccgttaacccccgggtccccccgtttaacccccggtaacccgggtttaaccccccgg

SEQ ID NO: 235354 - DNA, 832 bp, Homo sapiens
  misc_feature: GYAE6OF01CZM2C.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtgcccactcccagactcaactggtgcagtctggacctgaggtgaagagcctggggcctcggtgaaggtctcctgcgagggcctcgtggttactagtttttccgactatagtatctaggttgggtgcgacgacggcccttggacaagggcttgaggtggatggggatgggccgtaccgttcgacgaacgggaaagagtaggagtagtggtcaaggtatttcgagggcaggtaattaccgttagacccaacgacgtaacctcgaacgttacccgaacggggccaacgacggaccctttaacgttacgggaaacgttaggaacgggaaaccctaggaacggaaagttacggggaaccgaacccggtaacccgggaccctaaaccgtaagttttaacgttttaacgtttcgggttacggtaccgggaccgggtaaggggttaccggggggggttactttaaacggtttttagggttaaccggttaaccgtttaaaccgtttaaaccgttttaacgtttttaaacgttttacccgttttaccgttttacggggtaaccggttttacccgggttaccgggggggttaacccgtaaaaacgggggttacccccgtaaccggggttaccccgttaacccgggttaccccccgttaccccccggaccggttaacccccccgg

SEQ ID NO: 235355 - DNA, 889 bp, Homo sapiens
  misc_feature: GYAE6OF01AP306.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcgacgggcctcgtggttacgtacgtttttccgacttagtagtatcgtaggtttgggtcgtcggaaccgacggtccccgtttagggaaccgtaacggggtcgttaggaggttgggaagttcgggggagttcggggacccggtaccgtttcggaccgaaaaccgggtaaaggacgttagggtaagttacggttgggtaccgtaagggttaacgttttacggaagggtacgtaaacggtaacgtttacccgttacggtaaaccccgaacgtaacgtaaccgtaccgtaacgttaccccgaacggggtacctaaccgtaaccggtacccgttaacggtttacggaaaccgttacgggaaaccgggttaaacccgtaacgggtaaacggtaaacgttaccggggaaacccgtaaccggtaacccgggaacctaaacgtaacgttaacgttttacgttaggtacggtaccggtacggtacgggtacggggggtacttacggtttaacggtaacggttacgttaaccggttaaacgtttacgtttaaacgtttaccgttttaccggttacgggttaccggtttacgggtacgggtaaccgtaaaccgggtaccgttaccgggtaccctaacccggttacccgtaccccgcgttaacccccg

SEQ ID NO: 235356 - DNA, 874 bp, Homo sapiens
  misc_feature: GYAE6OF01DIM5T.21.67.G01.1.454.CMB.1.raw
tcagtcgtcgctcgcacgaccggtgctcgatttagagtatacatattgggtttggggacccaaaaaaccacacccctccttgggagattcccctagatcacagcccctcaccatggactggacctggagcattccttttcctggtggcagcagcaacaggtgcccactcccagactcaactggtgcagtctggacctgaggtgaagagccgtgggcctcggtgaaggtcctcctgcgagggccttcgttacggttactagtttttcccgacttactaccgaccgggcaccgacgtccttacgttacggaaacgtcggaacggtaacctgagtaagtcggaacggaccaccggaccacattattattgtcggcggcggagggtcggggcttagttacgtagtacttacttacttaattactttacgttcgtttaggtacgttcggtaggggtacgtaaacgggacccgtaacgggttcccaacccgttcccgtacccccgacgtacccctacccccgtaaaccgggaacccgggtaccccttaaccggtttcccggtttcccccgtttaccccccggtccgggtaccccgtcccccgttacggtaccccgtaccccggaacggggtaacccgtacccctaacccccgggtcccggaaacggaccgtaccccggaaccgtcccggggtaacccccgggtccccgtacgggggtcccgttacccgggtacccggttaccggggtcccgtaaaaacccgggtcccgttttacccccgtttcccccggtttacccgttcccgtttacccggttaccggttaccgggtaccggggtacccggggttacgttccgggggaccggtaacggggtaacccggg

SEQ ID NO: 235357 - DNA, 739 bp, Homo sapiens
  misc_feature: GYAE6OF01DAXN7.21.67.G01.1.454.CMB.1.raw
  modified_base (270)..(270): a, c, t, g, unknown or other
  misc_feature (270)..(270): n is a, c, g, or t
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgacggcctgtgttactagtttttccgatatagtntcgtagttgggtgcgacgtacggcccgttaggaacgacgggtcgttaggaaggtgggtagtggggagtcggggtcccgtaccgttacggaacgaaacgggaaaggtacgtagggtagttagtggtacgaagggtaactttacggaggtactaagtaaacgttaccgttacgaaccaacgtacgtaactcctaacgtacccggaccgggtaccacgaccgtaccgttaacggttacggtaaccgtaggaaacgtaacccgtagaagtaacgtaggaacgtaccgaccggacccaagtattaacgttagttaggtcggacggtacggacgggtggggtactagtttagtaacgtacttacgttaacctttattactttacgttacggttacggttacggttacggttacgggaacgtaacgggtacccgtaccggttaccgacccgttacccgtcccgaccggtaaccccg

SEQ ID NO: 235358 - DNA, 784 bp, Homo sapiens
  misc_feature: GYAE6OF01CLTIB.21.67.G01.1.454.CMB.1.raw
  modified_base (281)..(281): a, c, t, g, unknown or other
  misc_feature (281)..(281): n is a, c, g, or t
tcagtcgtcgctcgcacgaccggtgctcgatttagagtatacatattgggtttggggacccaaaaaaccacacccctccttgggagattcccctagatcacagcccctcaccatggactggacctggagcatcctttcctggtggcagcagcaacaggtgcccactcccagactcaactggtgcagtctggacctgaggtgaagagccgtggggcctcggtgaacggtctccgtgcagggcctctggttactagttttccgactatagtatcgaggttggngcgacacggtcccgttaggaccgtaagggtcttggagtgggagtggggtagtcggggacccgtaccgttcggacgtaaacgggaaagagtagggagtaagtggtaccgtaaggtacgtttccggaggtacaaggttaacttaccgttacggaaccaacgaacggtacctacgtaacgtaccggacgggtacaacgtacgtaccgttaacgttaggtaaccgtacggtaacgggtaacccttaggaacgtaaacggtacgggaaccgaaccggtaaccggaccgtaactaacgtttaacgtttacgtttgggtacggccggtacggggtaaagggttcggggggtactttaacggtttacggtaacggttaaccttaaccggttaactttaagttacgttttaccgttcgtttacgggtaccggttacgggttcgggaaccggtaacgggtaacccgtaccgggttaccctaccccggttaccgtccccgtacggtaacccccg

SEQ ID NO: 235359 - DNA, 817 bp, Homo sapiens
  misc_feature: GYAE6OF01BH23M.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagacgcctgggcctcggtgaaggtctcctgcagggcctcgtaggttactgttttccgacttatagtatcgaggttgggtgtcgacgtaggccgttggacaagggtcttaggagtgagtgggagtgggccgtaccgttgcgaaacggaagtagtggagtagtggtagtaggtaatttcgaggctaagtaacttaccgtagaaccacgtacgtacctcgaactacccgacggtacacgtacgtaccgttaacgttacggaacgtaggtaacggtaaaccgttaggaagtaacgacgggtaaccgaacgaaccggtaccaacgtaacgttaagttacgttaaggtcggtaccgggtaacggtacggggttacggggggttaccttacggttttaacggtaacgttaaacccgttaactttaacccggtttaaacgttttaaaccgttttaacccgttttaacgggtttaaccggggtttaaccgggtttacggtaccgggggggttaaaaccgggtaaaaacccgggggttaaccccgggttaaacccgggttaacccggttaaacccccggttacccccggtttaacccccggtaacccggtttaaacccccccggg

SEQ ID NO: 235360 - DNA, 594 bp, Homo sapiens
  misc_feature: GYAE6OF01CAN9S.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttgagtggatgggatgggccgaccttcgcgaacggaaagatggagtatggtcaggaatttcaggcagaattacctgaccacagactcatccacggacacagcctacttaggaactgaaggaaccctagaagaagtggacgacgacggccacatattattgtgcgcgaggtgggggctagtttggtagtactacgttaacttattaatttacgtttcgttggtacgttcggttggggaccgtaaaagggtacccgtacgggtaccgtacccggtcctcccccgagtacccccg

SEQ ID NO: 235361 - DNA, 845 bp, Homo sapiens
  misc_feature: GYAE6OF01BMAEN.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatcctttcctggtggcagcagcaacaggtgcccactcccagactcaactggtgcagtctggacctgaggtgaagagcctggggcctcggtgaaggtctcctgcagggcctcgtggttactagtttttccgactatagtatcagttggtgcgacacggcccttggacaagggcttggagtggatggggatcggggccgtaccgtttcggaccgaaccgggtaaaagagtagggtacgtaagtcgggtactaagggtaactttcgaaggggtccaaaggtaaactttacccgttaggaaccctaacgtacggtaacttaccgtaaagttccccggaaacggggccctaaccgtaacgtacccgttaaccgttagggtaaaccgttacggaacggtaaacccgtaggaaggtaaacgttacgggaaccggaccgtaacccggggacctaaaccgtaacgtttaaacgttttacgtttaggttacgggtaccgggtacccgggtaaggggtttccgggggggtaaccgttaagtttttacgggtaaaccgggtaacctttaaaccggttaacgtttaaacgttttaaacgtttaacccgtttccgggttttaacgggttaccggttacggtttacgggggaccggtaaaaaccggggtacccgtaaacgggttccccgaaaccccgggtttcccgttaccccccgtaacggtaccccccg

SEQ ID NO: 235362 - DNA, 776 bp, Homo sapiens
  misc_feature: GYAE6OF01DU58G.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcattccttttccgtggtggcagcagcaacaggtcgcccactcccagacctacaacgtggtagcagtccgtggacctggaggtagaaagacgtccggtggggccttcgggagtaacggtcctctaggacgcgggtccttgttacggttacctagttttacccgattagtagtactgtaggttggtcgacgactacggtacccgttggacgaaggtcgttaggaggttaggagtgggtacgtcgggtacccgtaccgttggacgtaaacggtaaggcgttagggaagttaagtcggttaagagggttaacgtttaggacggtaactaaagttaaccggttactaacggaccgtaagtacgacgttacacggaccggaacggcgaaaccgtcgtacccgttaacggtacggtaacgttacggaaccggtaaacgtagaaggtacggtacggaaccgtacggaacccggacaacgttaattacgttagtacggtcggacgttcggaagggtcgggttactaggttacgtaatccgttaattacgttataaccgtttacgttacgttacggttacggtacgggtacgggacgtaaaaccgggtccggtaaccgttacccgttaacccgtcccctacccggtcgtaaccccccg

SEQ ID NO: 235363 - DNA, 922 bp, Homo sapiens
  misc_feature: GYAE6OF01CUIWE.21.67.G01.1.454.CMB.1.raw
  modified_base (732)..(732): a, c, t, g, unknown or other
  misc_feature (732)..(732): n is a, c, g, or t
tcagtcgtcgctcgcacgaccggtgctcgatttagagtatacatattgggtttggggacccaaaaaaccacacccctccttgggagattcccctagatcacagcccctcaccatggactggacctggagcattccttttcctggtggcagcagcaacaggtgcccactcccagacctcaaactggtgcagtctggcctaggaggtgaagaacgccgtgggggcctcgggtgtaacgggtcctccgtcgcgacgggtcctcgttggttacgtacggtttttccgacgtactaccgtacgggacacgacgtaccttacgttggaaactggaacggaacctaggaagtaagtcgggaaccgaaccgaccgggtacccaacgtaagttagtttacgttaggtcggacggacgggtagggtacggggggtacctttaagtttagggtaacggttaaccgtttaaccttaacgtttaaacgttttaaaccgttttaaccgttttccggtttacggggttacccgtttaccgggtaacgggggtaacccggtaaaaaccgggggttaacccgtaacccgggttacccgtaacccccggttcccgtacccccctaaccgggtaccccctaacccgaaaccccgggtaacccggggtccccctaaacggttccccgggtttacccctttccccccgggtcggtaccccgtcccgttacgtcccgtaccgtaacgggaaccncccgttaacccgtaccggaacgaacgaccccgtaaggaccggtccccgttccggttaccggggccttccggtacccgttcgggtaaaccgtacggttaccccgtttaccccgttcccgttaaccggttcccttaaccgttacggcggacccggggttcgggacccgtttgggaacccgtggggtacccgg

SEQ ID NO: 235364 - DNA, 738 bp, Homo sapiens
  misc_feature: GYAE6OF01A3XUQ.21.67.G01.1.454.CMB.1.raw
  modified_base (392)..(392): a, c, t, g, unknown or other
  misc_feature (392)..(392): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtgcccactcccagactcaactggtgcagtctggacctgaggtgaagaacgccgtggggcctcggtgaaggtctcctgcgagggcctcgtggttactacgtttttccgacttatagtatcagttgggtgcgacaggcccttggacaggcttggagtggatgggatgggccgacttcgacaacggaaagagtggagtagtggtcaggtatttcgagggcaagtaatactgaccanagactcatccgagggctacgacgtcctacgtaggaactaggaacggaaccctggaacggtaagttacgggaaccgaaccgaaccgggaccctaacgtaagttaacgtttagttacgggttacggtaccgggacgggtaacggggttaggggggtaccttaaggttttacggtaagtaaccgttaacgttaaccgttaaagttttaaccgtttaaccgtttacggtttccggggtaaccgtttacccgggttacggggggaaccgtaaaaccgggggtaccccttaaccgggggttacccttaaccccgggtttaccccgtacccccgtacggttaacccccccggg

SEQ ID NO: 235365 - DNA, 886 bp, Homo sapiens
  misc_feature: GYAE6OF01CWS1G.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctggaggtgaagaacgccgtggggcctacgggtgaaggtcctcctggcgacgggtcctcgttggttactacggtttttccgacttagtagtatcgtaggttgggtagcgacgtcggtcccgttaggaacgtacgggtacttggaggtggtagtgggtacgtcggggccgtaccgttcgaacgaacggaagagtaggagtagtggtacgtaggtagttcgaggactaaggttacttaaccgttacgaacccgtagacgtacctactacgtaccgacggaacctaccgtacgtaacccttacgttacggtaaccgttacgggaaacggtaaccctagggtaaacgtaaacggccgggtaaccgaaccggaacccggtacccgaaaccttaacggtttaaacgtttagtttaccgggtagggtaccccggtaggggtaacgggggtttacgggggttaacgtttacggtttttaaggtaaccgggtttaactttaaaaccggttttaaaccgtttttaaacgttttaaacccggttttttaccgtttacccggggttttaaccggggttaacgggtttttaacccgggggttaaccgggggtaaaccgggtaaaacccgggttaacccgggtaccccgggtttacccggtaacccccggtttacccgtcccccccggttaacggtaacccccccgg

SEQ ID NO: 235366 - DNA, 903 bp, Homo sapiens
  misc_feature: GYAE6OF01COTK2.21.67.G01.1.454.CMB.1.raw
tcagtcgtcgctcgcacgaccggtgctcgatttagagtatacatattgggtttggggacccaaaaaaccacacccctccttgggagattcccctagatcacagcccctcaccatggactggacctggagcatccttttcctggtgcagcagcaacaggtcgcccactcccagacctcaactggtgcagtctggacctggaggtagaagacgccgtgggcctcgggtagaacggtcctccgtggcgacggggtcccttcgttacggttaccttacggtttttaccgacttacgtacccgacgggacacgacgtccttacgtaggaactggaacggaacctgaagaacgtcggaccgaccgaccggaccaactattaattgttagtcggtcggcggtagggtcggggtacttagtttacggtaagtaccgtttaaacttactttaacgttttactttaaccgtttcgttacgggtaccggttacgggtacgggggtaaaccggtaaaaccggggtaccccgtaaccgggtttacccgaacccccggttcccgttacccccgaaccggtccccctaaccccgtaacccggaaccccgggtaccccgtaaccggttcccggttacccccgtttcccccgtccggggtccccgtccccgtcgtaccccgtacccggaacggtacccgtaccccgtaaccccgtaccggaaccggaccgtacccgtaaccgcccgggtaccccgggtcccccggtacggggaccgttcccgggacccggttacggggtaaccccgtaacgggtaccccgtttaacccgggtccccggaccggtaccccggaaccgtaccggttcgggaacccggggttcccggggaccggttacccgggaccgggtaaccgggtacccg

SEQ ID NO: 235367 - DNA, 1192 bp, Homo sapiens
  misc_feature: GYAE6OF01D29TP.21.67.G01.1.454.CMB.1.raw
  modified_base (184)..(184): a, c, t, g, unknown or other
  misc_feature (184)..(184): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtcgccactcccagactcaactgtgnagtctggacctggaggtagaagagtccgtcgggaccgttcgggtaggacggtctccgtggccgacgggcccttcgttacggtttaaccgttacggtttttaccccggaacgttaagttaacggttacttacgtagggttttgggggtacgaccggtaaccgtaccggtacccggtttagggaacgtaacggggtccgtttaggaggtagggtaacggtgggggtacggttacccgggggtacccgttacccggttaccgggaaccggtaaaaccggggtaaaaggtacggttaagggtaacgggtttaaacggttacgggttaacggtaaaacggggtttaacgtttaaccgggggaacggggttaacgtaaaacgggtttaaaccttttaaacccggtttaccgtaaaccccgtaaaccggtaaacgtacccggtttaacccgaaccgggtttaacccccggaaaccggggggtaccctaacccggtaaccgggtttacccccgttttaaaccgggttaacgggtaaaacccgggttacgggaaacccggggttaaaccccggttaagggtaaaccggttaaacgggttaaccccggggaaaccgggtaaacccggtaaaccccgggtaaccccgttaaagttaacgtttaacgttttaacggtttacgggtaccggttacggggtaccggggttaagggggttccggggggttaaccttttaaaggttttaccggggtaaaccgttttaacccggtttaaaacgtttttaaaccccgttttaaacgttttttaaccgtttttaaaccgggttttttaccccggggttttaaacggggttaacccgggttttaaacccgggggggttaaccggggggttaaaacccgggtaaaaacccccgggggtttaaccccgggttaaccccggggttaaaccccccgggttttaaaccccggtttacccccccggttaaccccccgggtaacccgtttaaacccccccccggg

SEQ ID NO: 235368 - DNA, 659 bp, Homo sapiens
  misc_feature: GYAE6OF01E27GB.21.67.G01.1.454.CMB.1.raw
  modified_base (279)..(279): a, c, t, g, unknown or other
  misc_feature (279)..(279): n is a, c, g, or t
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactataccgacgggcacngcctacttggaactgaggaacctgagatggacgacacggccacatattattgcgcgcgaggtggggctatttgagactactactattattacttcgttaggacgttcgtggggtacaaacgggcctacggtcaccggtcctccccagccctcccaccgacgggcccagtccggttcccttcccccgtcggccgtcccgtcgccgttcccgaggcgccacccgtccggaacgacgcccgaacgacggcccggtccccggtcggggcctccggtccgtcggttaccgaaacgggtacccgttacccgttacccgggacggcccgggaacccggaccgttagggaccgggtccggggaccggtccggcggaaacgggtcccgg

SEQ ID NO: 235369 - DNA, 871 bp, Homo sapiens
  misc_feature: GYAE6OF01CKS1M.21.67.G01.1.454.CMB.1.raw
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctggaggtagaagaagccgtggggcctcgggtgaaggtctcctgcgaggcctgtggttactagtttttccgactatagttatcgtaggttgggtcgccgtacgacgggtcccgttaggacgtaagggtcgttaggtaggttagggaggtgggggacgtcgggggacccgtaaccgtacggttccggaacgtaaaaccgggaaaagtaggtagggtaagtaacggttgggtaaccgtaagggtaaacgttttcggaacggggtacgtaaaggtaaaccttttaacccggtttacggaaccccgtaacgtaacggtaaccttacctaaccggttccccgaacggggtaccctaaccgaaccgttacccgttaacgttaccgggaacgttacggtaacggtaacccgttaggaaacgtaacggtacgggaaccgaaccggacccggtaccgtaaccgtaagtttacttaacgttacgtcggtacggtaccgggtacggggttcgggggtactttacggtttaacggttacgtaacccgttaacgtttaacgtttaacgtttaacgtttaccggtttacgtttcgggttaaccggtttcgggtacgggggttaacccgtaaaccggggtaacccgtaccccgggttaccgtacccccgttcccgtacccccggtaacccgg

SEQ ID NO: 235370 - DNA, 866 bp, Homo sapiens
  misc_feature: GYAE6OF01BHUQ9.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtgggcctcggtgaggtctcgtgcgacgggcctcgtggttactacgttttccgacttatagtatcgtaggttgggtgacgacgtacggtcccgttaggaacgtaagggctttaggaggttaggggtaagtacggggtaggtacggggtacccgtaccggttacggaccgaaaaaccgggaaaggtaagttagggaaggttaacggttacgggtaaccggttaaagggtaacgtttaccggaaggggtaccgtaaaggtaaacgtttaccggttaacgaaacccgtaacgaacggtaacctaccgtacgtacccggaacgggtaccaaccggtacgtaccccgtttaaggttacggaaaccgtcggtaaacggggtaaaccctagggaaacgtaaaccggtaagggaacccgtaccggaaaccgggtacccctaaagtaacgtttaacttttaacgggttcgggtacggtaaccggtacggggtaacgggtccgggggttactttaggtttaacggaaccgttaacttaacgttaacgtttaactttaacggtttaacgttttcggttacgggtacgtttacggggtacggaaacgggtaaaacccgggccgttaccgggtaacctaccccggttaccgtacccccggaacgtaccccg

SEQ ID NO: 235371 - DNA, 672 bp, Homo sapiens
  misc_feature: GYAE6OF01DQKXS.21.67.G01.1.454.CMB.1.raw
  modified_base (284)..(284): a, c, t, g, unknown or other
  misc_feature (284)..(284): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaactaggtgcccactcccagactcaactggtgcagtctggaccgtggaggtgaagaagccgtggggcctcggtgaaggtctccgtgcgagggcctcgtggttactcgttttccgactatagtatcagttggngcgacgaggtcccttggacgaggcgttgaggtggtagtggggagtcggggccgtaccgttcggacgtaacggaaggtagtagggtagtaagtgggttacaaggtactttcggaggtcgtaaggtaacttaccgttgacctaacgacgtactacgactccggacggacacgtacgacgttacgttacggaacgttcggaacgaacctggaacgaagtcggaacgacaaccggaccatacttagttacgtgacgcggtacggtagggttcgggtacgtagtttacgaacgttacgttaactaccgttattacgttactttcggtaggtacgttcggtaggggaccgtaagggtaccgtcggtacctaccgttccgtcccgagtaccccgg

SEQ ID NO: 235372 - DNA, 779 bp, Homo sapiens
  misc_feature: GYAE6OF01EIBNK.21.67.G01.1.454.CMB.1.raw
tcagtcgtcgctcgcacgaccggtgctcgatttagagtatacatattgggtttggggacccaaaaaaccacacccctccttgggagattcccctagatcacagcccctcaccatggactggacctggagcattcctttttcctggtggcagcagcaacaggtcgcccactcccagactcaactggtgcagtctggacctgaggtgaagaacgccgtggggcctcggtagaaggtcctcctgcgacgggcctcgtggtttacgtacgtttttccacgttaactaccgacggacacgcgccttagttacggaactcgaaggaacctgaacgagtggaacgacgaccggaccaacgtattactttagttgtcgacgcgagggtggggactagtttcgtaagaccttaactacgttatttaatttacttcgttacggtacgttggtaggggaactaaagggtcccgtaacggtccgtaaccgttccctaccccgacgtccctacccgaaccgaaccgggtcccctaacgttcccggtttcccctttacccccggtcgggtaccccgtccccgttcgaccccgttaccgaacgggccgaccccgtacccgtaacccgggacgaacggacccctaccgggacccgggtcccggtccccgtaggggtccccgttccgggacccggtaggtttacccgaaaacggttacccgttacccggttacccgggacggttacccggaccgtaccggacgggtacggccgggtacgtcggaccgacggtaccg

SEQ ID NO: 235373 - DNA, 844 bp, Homo sapiens
  misc_feature: GYAE6OF01EWBTE.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtcgccccacctcccagacctacaacgtggtgcgagtcgtcggaccgtggaggtagaaggaacgccggtcggggtccgtcgggtaggtaacggttcctccgtcggcgtacgggtccttcgttcggtttaccgtttacggtttttaccgacgttagttagtacgttacgtaggttggtacgcgacgtacggtccgttaggacgagggtcttggaggtagggtaggtggggtacggtcgggtacccgtaccgttacggaacggaaacggaaggtaggtaggtacggttagtacggtacgtaggttagttacggacggtactaacgtaacgtttacctacgaacctaacgacgtactacgtaccgtaccgacggaccaacgaccggttaccgttaacggtaggaacgtagtaacgggtaactaggtaagtacggacggaacccggaacgtacccggaactaacgtaagtttacgttacggtagggtcggaccgggtaacgggtagggttacgggttacgtttaacggtttacgtaacggttaaccttaccgtttaagtttaaccgttttacgtttaccggttttacggtccgggttaacggttccgggttaacggggaacgttaaaccgggaccccggttacggttaccccgtaccccgttccccgtaaccccgtccggtaaccccccg

SEQ ID NO: 235374 - DNA, 908 bp, Homo sapiens
  misc_feature: GYAE6OF01CDRFV.21.67.G01.1.454.CMB.1.raw
  modified_base (192)..(192): a, c, t, g, unknown or other
  misc_feature (192)..(192): n is a, c, g, or t
  modified_base (246)..(246): a, c, t, g, unknown or other
  misc_feature (246)..(246): n is a, c, g, or t
tcagtcgtcgctcgcacgaccggtgctcgatttagagtatacatattgggtttggggacccaaaaaaccacacccctccttgggagacttcccctagatcacacgcccctcaccatggactggacctggagcattcctttcctggtggcagctagcaacaggtcgcccacctcccagactacaacgtggtcncagtctggacctggagtagaagacgcgtcggggcctacggtagacggtcctcgnggacgtacgggtccttcgttcggtttacgttacggtttttccgacgttaagtaggttactaccggttaggttacgggtacgaccggaaccgtaccgggttacccccggttagggaaacccggtaacggggttcgtttacgggaagggttcggggtaaggtcgggggtaaccggtccggggtaccccgttacccgtttaaccgggacgaaaaaccggggtaacgtaagggttaggggtaacgttacggtaacggggttaccgtaaagggtttaaccggtttaccggaaggggttaactaaacgggttttaacctaacccggtaccggtaaccacgtaacgtaacctcgaaccgtaccggacggacccgtaacctacggtaccctttacggttaacggacgttaacggacgggttaacctaagggtaacgacgggttacgggaaccgtaccgtaacccgggacctaaacgttactttacgtaggttcgtcggaccgggttagggtacgggtcggtacgttaggtttacggaagttacccgttaactttaacgtaagttttccgttacgtttaccgtcgggtccggttaacgggttaacgggaccgttaaaccgggtccccggttacgtaccccctaccgggttcccctcggtacccgtacccgg

SEQ ID NO: 235375 - DNA, 908 bp, Homo sapiens
  misc_feature: GYAE6OF01E3EZN.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcattcccttttcctggtggcagcagcaacgaggtcgcccactcccagacctcaacgtggtgcgtagtcgtggacctggaggtagaagacgtccggtcggggccgtcgggtacgtaacggtcctccgtggccgacgggtccttacgttacggttacttacgttttaccgacttagtagtactcgtagggttgggtcgacgacggtacggtcccgttagggaacggtaacgggttcgttaggacggttagggaggtgggtacggtccggggtacccgtaaccgttaccggaacggtaaaacggggtaacggtaggtaggtaagttaggttaggtacgtaaggttaacgttaggacggtaactaaacgtaaccgtttacgtaacgaaccgtacgtaacgtactacgaccgtaccggaacggtaccgaacgtaaccgtcccgttaacggttacggaaaccggtaggtaaacgggaacgtaggtaaacggtaacgggtaccgaaccggaaccggaaccgtacggtaacttaagtttacgttagttcggacggtaccgggtaacgggtagggtaccggggttacttaacgggtttggttaaaccgttacgttaaaccgtttaaactttaaccggtttaaacgttttacggtttaccggggttaaccggtaacgggtttaccgggtaaacggggggtaaacccgttaaacccggggtaacccgtacccggggttacccctaaaccccccgggtttacccgaacccccgtcccgggttaaaccccccg

SEQ ID NO: 235376 - DNA, 718 bp, Homo sapiens
  misc_feature: GYAE6OF01CJNHO.21.67.G01.1.454.CMB.1.raw
  modified_base (156)..(156): a, c, t, g, unknown or other
  misc_feature (156)..(156): n is a, c, g, or t
  modified_base (297)..(297): a, c, t, g, unknown or other
  misc_feature (297)..(297): n is a, c, g, or t
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacnggtgcccactcccagactcaactggtgccagtctcggaccttggacggtgaagaacgccgtggggcctcgggtgaacggtctcctgcgaggcctcgtggttactagttttccgactatagtatcgtaggttgggtgcgacnggcccttggaacgaagggtcttgagtggatgggatggccgacgtcgacgtaaggaagtntggagtagtggtnaggtattcggaggacgaagttacgtaccgtacgacgacaacgtactacgtaaccgtccgaacgggtccaacgtacggtacccgttacgttaccgggtaacgtacgggaacgggtaaaccccttagggaacgtaacggtacgggaaccgaaccggaaccgtaccgtaacgtaatttaacgttagttacgggtacggaccggtacgggaagggtacgggggtaccttaggtttaccggtagtaccttacgttaacgttactttacgtttacgttccgttacggtaccgtacggtcggggacgtaaacgggtccgtaccggtaccaacccggttccgtcccctagtaccccg

SEQ ID NO: 235377 - DNA, 725 bp, Homo sapiens
  misc_feature: GYAE6OF01AS5H6.21.67.G01.1.454.CMB.1.raw
tcagtcgtcgctcgcacgaccggtgctcgatttagagtatacatattgggtttgggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctcgtggttactagtttttccgactatagtatcagttgggtgcgacaggcccttggacaagggcttggagtggagtgggagtgggccgaccttcgcaacggaaagagtggagtgtggtcaggtaatttcgaggcaagtaattaccgttagaccacagactcactaccgacggaccacgacgcctacgttacggaactcgaacggaacctagaacgtaaagtcgggacgaaccgtaccggacccaacgtaagttaactttagttggttacggaccgacgggtagggtacggggggtacttaagtttaggttaacgtaaccgttaaccgttaacctttaagttttaaaccgttttaaccgttttacgttttaccggggtaccggtttaccggttacgggggggaacctaaaaaccgggggtacccgttaaccccgggtaccgtaacccccgggttaccccgtccccccgtaacggttaccccccgg

SEQ ID NO: 235378 - DNA, 808 bp, Homo sapiens
  misc_feature: GYAE6OF01AWTLM.21.67.G01.1.454.CMB.1.raw
  modified_base (139)..(139): a, c, t, g, unknown or other
  misc_feature (139)..(139): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatcctttccnggtggcagcagcaacgaggtgcccactcccagacctcaacgtggtgcagtctggacctggaggtgaagacgccgtgggtcctggtagacggtctcgtgcgagggcctcgtggttactagttttccgactatagtatcgaggttgggtgcgacgacggtcccgttaggaacgtaaggggtcttaggaggttggagttggggagtcggggacccgtaccgtttcggacgaaacgggtaagtagtgggtaagtagtacgggtgtaaggttacgtttcggagggtacgtaggttaaacgttaccgttacgaaccgtacgtaacgtaccttacgtactacccgaacgggtaccaaccgtacgtacccgttacgtttacggtaaccgtaggtaaccggaacccgttacggaacgtaacggtacggaccgtaaccgtaccgggactaaaccgttaattaacgttagttacggtacgtaccgggtagggtaaccgggtcgggggtacttagttttacgggtaacgttaacccttacgttaaacgtttacttttaaccgttaccggttttacggttaccgggttacggttaccgggttacgggggaacccggtaaacgggtaccccggttacgggtaccctaccccggtttcccctaccccggtacccggtacccccg

SEQ ID NO: 235379 - DNA, 797 bp, Homo sapiens
  misc_feature: GYAE6OF01DM0Y9.21.67.G01.1.454.CMB.1.raw
  modified_base (140)..(140): a, c, t, g, unknown or other
  misc_feature (140)..(140): n is a, c, g, or t
  modified_base (155)..(155): a, c, t, g, unknown or other
  misc_feature (155)..(155): n is a, c, g, or t
  modified_base (161)..(161): a, c, t, g, unknown or other
  misc_feature (161)..(161): n is a, c, g, or t
  modified_base (531)..(531): a, c, t, g, unknown or other
  misc_feature (531)..(531): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcattccttttcnggtggcagcagcaanaggtcncccactcccagactcaactggtgctagtcgtggaccgtggaggtagaagacgtccggtcggggccttcgggtaggtaacggtccttcgcgtacggacggtcccttcggttacggtttaccgttaccggttttccgaaacgttaagttacggttagttcgtaaggggttcgggtacgtaccggaaccgtaaccggttcccgttaaggaacggttaacgggtcttagggagtgggtacggtagggaacgtcgggtacccgtactacggacgtaaacggaatggtaggtactagtacggtagtagggtaacttcggaacggtactaaagttacgttactacgaaactacgagtactacacgtacggaaccggnacgtcgtacctaggagtaacgaggtaccaacggagtaaggtaacgcggaaccgacggtaccgacgtaacgtaatttacgttacgtaggacgtaccgggagggtagggtccgggttaatacggtttaggaaaccttacgttaacttaagtttaacgtttaacgtttacgtacggttacggtaccggttagggaacgggtaaaccgtaacgggtacccccgtaagggtaccctaaccccggtaccctacccggtaaccgtaaccccgg

SEQ ID NO: 235380 - DNA, 669 bp, Homo sapiens
  misc_feature: GYAE6OF01E1PC1.21.67.G01.1.454.CMB.1.raw
  modified_base (652)..(652): a, c, t, g, unknown or other
  misc_feature (652)..(652): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcgagggcctcgtggttactagtttttccgactatagtatcgagttgggtgcgacgacggcccttggacaagggtcttggagtggagtgggagtcgggccgaccgttcggacaacggaagagtggagtagtggtacgaggtaattcgaggcaagtaattaccttgaccacagactacgactccgacggaccacgacgtacctacgttacggaccgtaggacgaaccgtaggaacgaagtacgggacgacgaccggaccaactacttagtttatgtacggccgaggaggtcggggtacgttacgtttaggtaacgtacttaacttaacgttagtttaacgtttaccgtttacggttacggttaccggttacgggttacggggacgtaaacgggaccggtaccggtacctacccggttcccnccccgtacgtacccccg

SEQ ID NO: 235381 - DNA, 814 bp, Homo sapiens
  misc_feature: GYAE6OF01B43OR.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaacgccgtggggcctcggtgaacggtctccgtgcgagggccttcgtggttacgtacgtttttccgaacttatagttatcgtaggtttggggtcgcggtacgaggtcccgttagggaacgtaacggggtcttaggtaggttagggagttaggggtaacgtcggggtacccgtacccgttacgaaccgtaaacgggaaagtaggtagggtaagttaggtcgggtacgaacggttaagtttacggaacgggtacaacggttaacgtttaaccgttacggaaccgaacgaacgttactaccgtacgtacccggacggtacgaacgtacggtacccgttacgttacggtaactacgggaaacgtaaccgtaggaaacgtaacgacgggaacccgaacgaccggaccctacgtaagttacgtttacggtacgtacggtacggtacgggtagggttacggggtacttacgtttagaaccggtacttaaccggttatttaacgtttactttaccgtttacgttacgggtaggtttaccggtcggggaaaccgttaacgggtaaccccggttaccgggtaccgtaccccggttaccctaccccggaccgttacccccgg

SEQ ID NO: 235382 - DNA, 763 bp, Homo sapiens
  misc_feature: GYAE6OF01AO8YO.21.67.G01.1.454.CMB.1.raw
tcagtcgtcgctcgcacgaccggtgctcgatttagagtatacatattgggtttggggacccaaaaaaccaccacccctccttgggagattcccctagatcacacgcccctcaccatggactggacctggagcattccttttcctggtggcagcagcaacaggtcgcccactcccagacctacaactggtagcagtctggacctgaggtgaagagccggtgggacctggtagacgtcctcgtcggcgacgggtccttcgttggttacttacgttttccactactaccggacggtcacgtacgtaccttaacgtcggtaactcgaacggtaccgtagaagtacgtacggaaccgacgaccgactaactattacttagtcgtacgcgacggtaggtcgggtatacggttagaactacttactaagttactttacgttaacgttcgtacggtacgttcggtacggggaacgtaaacggtccgtacgtaccgtaccgtccctaccgacgtccctaccgaaccggaccggacccctacgtcccggtccttacccgtcggcccgtaccgtccaccgtaccggacgggccgtacctaccgtccggaaacgccggaccaccggcggtacccggtaccgggtcggccgttacccggtccgggttaacgtaccggtaacccgttaccgttccccgtttaaccccgttcggttaacccttacgggtacgtacccggggccggttcggtaacgggctaaacccggggtctaacggg

SEQ ID NO: 235383 - DNA, 785 bp, Homo sapiens
  misc_feature: GYAE6OF01B9ZQ0.21.67.G01.1.454.CMB.1.raw
tcagtcgtcgctcgcacgaccggtgctcgatttagagtatacatattgggttttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcgagggcctcgtggttactagtttttccgactatagtatcaggttgggtgcgacgacggcccttaggacgaagggcttggaggttggagtggggagtcggggacccgtaccgttcggaccgaaacgggtaaaggagtagggaagttagttgggtacgtaagggtaattttcggaaggggtccaaggttaaactttacccgttagaacccaacgtaacgtacgtcctaacgtcccggacgggaccacgacgtacccttaacgttacgggaaccgttacggaacggtaaaccccgtaggaacggtaaacgttacgggaaccgtaaccgaaccgggtacccaacgtaacgttaagtttacgtttacggttacggccggtacgggacgggttacggggggtacctttaaggtttttacgtaacgtaaccgttacgtttaacgtttaatttacgtttaaccgtttcgttacgggttacggttccggttaggggaaccgtaaacgggtacccgtaaccgggtccctaacccggttccctcccccgtacgtacccccg

SEQ ID NO: 235384 - DNA, 800 bp, Homo sapiens
  misc_feature: GYAE6OF01E12AV.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcgggtgaaggtctcctgcagggcctcgtggttactgtttttccgacttatagtattcgaggtttggggtgccgtacgacgggtcccttgggaacgaaggggtcttgggagtgggagtggggagtcggggccgtaccgtttacggaccgaaacgggtaaacggtagtcgggaagtagttacggttacgaagggttaaagtttcggaaggggtactaaggtaaactttaacccgtttacggaaccctaacgacggtaactaccgaacgtacccggacgggaccacgacgtaccgtacgttacggaacgtacggaacggtaaacccgtaggaacggtaacggtacggaaccgacgaccgggaccctaacgtaagtttaacgtttagttcgggtacggtccgggtacgggtacggggttcgggggtaccttaaggtttcggtaacgtaaccgttaacttaacgtttaagtttaacgtttaaccgtttacggtttcgggtaacggttcgggtacgggggtaacgaaaccggggtacccgtaaccggttacccgtaaccccggttccctcccccgtaccggtaccccc

SEQ ID NO: 235385 - DNA, 956 bp, Homo sapiens
  misc_feature: GYAE6OF01EEIVH.21.67.G01.1.454.CMB.1.raw
  modified_base (184)..(184): a, c, t, g, unknown or other
  misc_feature (184)..(184): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtcncagtcgtggacctggaggtagaacgaacgccgtggggccgtcggtagaacggtcctcgtgcgacgggtccttcgtaggttactacgtttttaccgacttagttacgtagtcgtaggtttacgggtcgaccggtaccgtacggtcccgtttagggaaccggtaaagggtccgttacggtaagggttcggtaaggttacgggggtacggttacgggggtaccccggttaacccggtttccgggaaccggtaaaaccggggtaaagtacggttacggggtaacggttaggtacggggttaacgtaaacggggttaaccgtttacggaaacgggtacgtaaacggttaaacgtttacccgttacggaacccgtaacgtaaccggtaacccttaccgtaaccggttacccggaaccgggtaccaacccgtaaccggttacccgttaaccgggtttaaacgggtaaccgttacgggtaaccggtaaaccgttacggaaacggttaaacggttaaccggggaacccgggaaccgtaaccccggtacctaaacgttaacgtttaacgttttaacggttccggtaacggtccgggaaccgggttacggggttaacgggggtccttaagggttttagggaacccgttaacgttacggtttaaacttaacgtttaaccgtttacgttaccggttcgggttaaccgttcgggtaacgggtaaccgggtaaaccggtaccgttaccggtaccctacccggttaccgtaccccgcgttaaccccgg

SEQ ID NO: 235386 - DNA, 704 bp, Homo sapiens
  misc_feature: GYAE6OF01B10PF.21.67.G01.1.454.CMB.1.raw
  modified_base (237)..(237): a, c, t, g, unknown or other
  misc_feature (237)..(237): n is a, c, g, or t
  modified_base (369)..(369): a, c, t, g, unknown or other
  misc_feature (369)..(369): n is a, c, g, or t
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagaacgccgtgggcctcggtgaggtctcctgcgnggcctgtggttactacgttttccgacttatagtatcgtagttgggtgcgacgacggtcccgtttaggacgaagggtccttaggaggttggagtgggagtcgggcccgtaccgttcggacgaaacggaaaggngtagggtagtagttggtacgaggtaagtttcgaggctaagaactttaccgttacgacctacgagacctcgaactccgaacggacaccgtaacgcccgttagtacgggaactacggaacgaaccgtacgaagtaacggtacggaaccgacgtaacccggaccaactaacgtttaactttgttacggagcgggtacggtaggggtcggggtatttagtttacgggtactacgttaacttacgttacgtttactttaccgtttggttacggtacgttacggtcgggaagtaaaccggccggtacgtaccgtacccgttcccgccccgtgtaacccccg

SEQ ID NO: 235387 - DNA, 1010 bp, Homo sapiens
  misc_feature: GYAE6OF01DJRZL.21.67.G01.1.454.CMB.1.raw
  modified_base (162)..(162): a, c, t, g, unknown or other
  misc_feature (162)..(162): n is a, c, g, or t
tcagtcgtcgctcgcacgaccggtgctcgatttagagtatacatattgggtttggggacccaaaaaccacacccctccttgggagattcccctagatcacacgcccctcaccatggactggacctggagctattccttttcctgggtggcgagcacgcaacnggtcgcccacctcccagacctacaacgtggtctcgagtctcggacgtagtaggtagaaaggacgtccggtcggggtccgtcgggtagtaacgggttcctccgtggaccggtacgggtcccgtttcggttacggtttaaccgttaccggtttttacccgaacgttaaccggtaccggaaccggggaccaactacgtacccgttacggttaacggtaaccgttacggaaccggtaacctaggaacgtaagggtaccggaaccgggaaccgaacccggaccgaacttaacgtttagtttaacgttacggtcgggaccggtaggggtacgggtacgggggttactttggtttaccggtaacggttaccgttaaaccgttaacgttttaaagttttaacgttttaccgttacggttacgggttacccggtttagggtaacccggggtaaacgggtaaacccgggaaaccccggttaccgggtaccccttaaaccccgggttccccttaacccccggggtaacttcccccggtaaacccgaaccccccggttaaaccgggacccccgttaaccgttttcccccgggtaccccttttcccccggggacccggtcccctcccgggttccaccccgggtttaccgaaccggggtaacccttccccggaaccccggttaccggaaacgtaccacccggtaccgggacccgtcccccgggttacggttcccgcggttccggttaacccggtacgttaccggaaacccgttaccgtttccccgtccccttaacggtttcccgtaaacccggttacggcccgggtaccgggtcgtacgggtacccggtgggtaaccaccgg

SEQ ID NO: 235388 - DNA, 848 bp, Homo sapiens
  misc_feature: GYAE6OF01C723U.21.67.G01.1.454.CMB.1.raw
  modified_base (129)..(129): a, c, t, g, unknown or other
  misc_feature (129)..(129): n is a, c, g, or t
  modified_base (187)..(187): a, c, t, g, unknown or other
  misc_feature (187)..(187): n is a, c, g, or t
  modified_base (716)..(716): a, c, t, g, unknown or other
  misc_feature (716)..(716): n is a, c, g, or t
  modified_base (779)..(779): a, c, t, g, unknown or other
  misc_feature (779)..(779): n is a, c, g, or t
tcagtcgtcgctcgcacgaccggtgctcgatttagagtatacatattgggtttggggacccaaaaaccacacccctccttgggagacttcccctagatcacagcccctcaccatggactggacctggancattccttttcctggtggcaggcagcaacaggtcgcccactcccagactcaacttggngcagtctggacctgaggtagaagaaggtccgtggggccttcgggagtaacgggtccttccgaggccgtaaggggtccttacgttacggttaccgttacggtttttaccgaactactaaccggacgggaccaacgacgtaccgttacggttacggtaacgtaggaaccggaacctggaacgtaacgacgggaaccaaccctaagtacgaccctaaacgtaacttaacgtttagtaggttcggaccggcggtaaggggtcggggtactaggttttacggaacgttaccttaaccgttaagtttaactttaacgtttaaccgtttcggttaacggtaaccggtttccggaagggggtaaccgaaacggggtaacccgtaccggtaaccgtacccgggttacccttacccccgaacggtaccccttacccggaaaccggaacggggtccccttaaaccgttcccggttacccccgtttcccgacggtcccggtcctccggaccgtaccggagtacgaccggaccctcggaacncgacccgtaacgcgggttacccgcgtacggggtcccacggtccgtagggacccttaaccgggnttacccccgttccggtcttacccggttcttaaccggcgggaaccggccgggacttcggggacaaccggg

SEQ ID NO: 235389 - DNA, 647 bp, Homo sapiens
  misc_feature: GYAE6OF01CJL14.21.67.G01.1.454.CMB.1.raw
  modified_base (226)..(226): a, c, t, g, unknown or other
  misc_feature (226)..(226): n is a, c, g, or t
  modified_base (528)..(528): a, c, t, g, unknown or other
  misc_feature (528)..(528): n is a, c, g, or t
  modified_base (542)..(542): a, c, t, g, unknown or other
  misc_feature (542)..(542): n is a, c, g, or t
  modified_base (547)..(547): a, c, t, g, unknown or other
  misc_feature (547)..(547): n is a, c, g, or t
  modified_base (551)..(551): a, c, t, g, unknown or other
  misc_feature (551)..(551): n is a, c, g, or t
  modified_base (556)..(556): a, c, t, g, unknown or other
  misc_feature (556)..(556): n is a, c, g, or t
  modified_base (558)..(558): a, c, t, g, unknown or other
  misc_feature (558)..(558): n is a, c, g, or t
  modified_base (561)..(561): a, c, t, g, unknown or other
  misc_feature (561)..(561): n is a, c, g, or t
  modified_base (631)..(631): a, c, t, g, unknown or other
  misc_feature (631)..(631): n is a, c, g, or t
tcagtcgtcgctcgcacgaccggtgctcgatttagagtatacatattgggtttggggaccccaaaaaccacacccctccttgggagattccccctagatcacagccccctcaccatggactggacctggagcattccttttcctggtggcagcagcaacaggtcgcccacctcccagacctcaacgtggtgcagtctggcctgaggtagaagagcgtgggcctggngaagtctccgtgcgacggccttgtacggttacttagttttccgatacgtagtctcgtaggttgggtagcgacgtacggtcccgttaggaacgtacgggtcttaggagttgggagtgggacggtcgggacccgttccgttacggaccgtaaagggaacgagttagggaacgttagggtggtaacgtaagggtaactttccggaggtactaagttaaccgtttactacggaaccactacggtactactaccgaccgacggacctaccgacgtcttaacgtacgaacgtagacgactagagaacnggacacgacgaccntaatntagngtcgngnggnggtgtctagtgactactattatgttattcgtcggttagactcggagggaccgagtaccgcgtaacgtccnccgtaccgccgtaccc

SEQ ID NO: 235390 - DNA, 806 bp, Homo sapiens
  misc_feature: GYAE6OF01A2MHV.21.67.G01.1.454.CMB.1.raw
  modified_base (235)..(235): a, c, t, g, unknown or other
  misc_feature (235)..(235): n is a, c, g, or t
  modified_base (277)..(277): a, c, t, g, unknown or other
  misc_feature (277)..(277): n is a, c, g, or t
  modified_base (343)..(343): a, c, t, g, unknown or other
  misc_feature (343)..(343): n is a, c, g, or t
tcagtcgtcgctcgcacgaccggtgctcgatttagagtatacatattgggtttggggacccaaaaaccacacccctccttgggagattcccctagatcaccagcccctcaccatggactggacctggagccatccttttcctggtggcagcagcaacaggtcgcccacgtcccagactcaactggtgcagtcgtgacctgaggtgaagagccgtggggcctggtgaggtctccgngcgaggcctgtgtacgtagttttccgatactaccgacggcancgcctagtggaactgacgacctgaagtagaggacgacacggccaatagtattagtgtcgcgacggnggtggggactagttagacgacttactacgtatttaacttacgttcttacggtcgtcgtacgggggacgaaaacgggaccgtaccggtacctacccggttccctaccccggatacccccgttaaccgaacccggaacgggtacccccttaaacggtcccgggtttaccccttaccccccgggttcgggaccccgtccccgtacggtaccccttacccgggaaccggtaccgtaaccccgtaacccgttacccgggaacgaccgaccggtaaccccgtaaccgggcccccgggttacccgggttccggggaccctttccgggaccccgttagggtacccgaaaaaccgggttcccccctttaaaccccggttttccccccgtaccggttacccttacggtaacccggtttcggaacccggggtcccggggtacttaccggggaacccgggtaacgggtacccccg

SEQ ID NO: 235391 - DNA, 835 bp, Homo sapiens
  misc_feature: GYAE6OF01CQUIY.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggaccctgaggtgaagaacgccgtggggcctcgggtgaaggtcctccgtgcgacgggtcctcgttcggttactagttttccgactatagttatcgaggttgggtgcgacgacggtcccgttgggaacgagggtcttaggaggtggagtggggagtcgggcccgtaccttacgaccgaaacgggtaaacgagtagggtagtaggtcggtacgaaggtaacgtttcggaggtacgtaacgttaaacgtttaacccgttagaaacccacggtaactaaccgtcgtacctaccggaccgggacacgtacgtaccttacgttacggaacgtacggtacggtaaaccctaggaacgtaacgtacgggaaccgtaccgaacccgggaccaacgtacgttaagtttacgttacggttaggtaccggacgggtaacggggttcgggggtactttaacggtttaaggttaaccggtaaccgtttaaccgtttaaccgtttaaacgttttaaccgtttacggtttttaccgttacggggttaaccgtttaccggggttacgggggtaaaccggttaaaaccggggtaccccggttaacccgggttaacccgttacccgggttacccccttacccccggtacccggttaaccccccgg

SEQ ID NO: 235392 - DNA, 726 bp, Homo sapiens
  misc_feature: GYAE6OF01EMNKM.21.67.G01.1.454.CMB.1.raw
  modified_base (235)..(235): a, c, t, g, unknown or other
  misc_feature (235)..(235): n is a, c, g, or t
tcagtcgtcgctcgcacgaccggtgctcgatttagagtatacatattgggtttggggacccaaaaaccacacccctccttgggagacttcccctagatcacacgcccctcaccatggactggacctggagcatccttttctggtgcagcagcaacaggtcgcccactcccagactcaacgtggtgcagtctggacctggaggtagaagacggcccggggcgtcggtagaacgtcnccgtgccgacggtcctcgtacgttactagttttccgacttagtagtatcgtaggttggtcggacgtaaccgacgggtccctttacggggaaccgtaaggggtccgtttagggaggtcggaggttagggggacgttcgggggcccgttaccgttacggacgaaacgggtaaatgtagggtaagttagtggtaccgtagggtaacttacggaggactagtaactacgttcgactacgagtactcacgtcgaacggcactagacctacgtagactacgagtaaccgtgagtaagtcgaaccgtacacggaccaacgattaacgttacgtagtcgacggtaggtacgggtacgggtactaggtttaacgtacgtaacggttaactttacgttaatttaacgttacttacggttcggtaacgttcggaacgggtacggaaaccggtacgtaaccggtccgaaccgttcccgaccccgtagttccccgtaaacccgg

SEQ ID NO: 235393 - DNA, 952 bp, Homo sapiens
  misc_feature: GYAE6OF01CU0LO.21.67.G01.1.454.CMB.1.raw
  modified_base (190)..(190): a, c, t, g, unknown or other
  misc_feature (190)..(190): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcacttcccttttcctggtggcagcagacaacaggtcgcccactcccagactacaacgtggtnctagtcgtcggaccgtgaggtagaagacgccggtagggcctcgggtagtacggtctccgtgcgacggtccttcgttaggttacttacgttttccgacgtacgtaccgtacggctacgtcgtaccttacgtacgtacgtacggacggtaaccgtggaagtacgtacggaaccgacgacccggtacccaagtagtttagttacgttaggtacggtcgtagggtacgggtgggtaacttaggtttaccggtaacgtacttaacttaacgtttaatttaacgttttaccgttacggtttacggtaaccggttcgggttacggggaaaccgtaaaccgggggtacccttaacccggggtcctaaaccccccggttcccgtaacccccgtaccccgtacccccggtaaccccggaacccgttaaccccgggaacccccgttccggtttacccccggtttaccccccgttaccccccgggtcgtacccccggttccccgttacccgtcccggtaacccgaccgggtaccccgaaccccgtaccccgttaccggaaacggacccggtacccgtaaccgggaacccggggtcccccggttcccgggtaccgggttaccccgcggttacccccggttacgggtaaacccgttaccgggttaccccttaccccccgttttacccggtacccgttaccccgtttaaccgggtcccgttacgggtacccgggggttccccgtagggtaaccccggggaccgtaaccggtcccggg

SEQ ID NO: 235394 - DNA, 1075 bp, Homo sapiens
  misc_feature: GYAE6OF01ENF43.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacgaggtcgcccactcccagtacctacaacgtgggtgcgtacgttcgtacggtaccgtgggaggtaggaaacggtaccggtccgggtacggggtccgttacggggtacggtaaccgggttccttccggtgggaccggtaccgggtcccgtttcgggtttaacggttttaaccgttttaccggtttttaccgtaacttagttaacgttacgtacgggtttagggttcgggtacgaccggtacggtaccgggtccggttacggaacgggtacggtacgttagggagggttagggtaggtacgggggtacggttacccgggtaccggttaaccgtacggaaaccgggtaaaacgggtaagggttaacgggttagggtaacggtttcgggttaacgggtaacgggttaaacgttttaccgggtttaaacggggaacgggtaaccgtttaaaacggtttaaccgtttaacccgtaaccggaaacccgtaacggtaaccgtaaccgtttaaccgtaacccgggtacccggtaaccgggtacctaacgtaacccgggtttaaccgttaacgttaacggggtaaaccgttaacggggaaaccgggttaactaaccgggttaaagggaaacgggttaccggaaacccgggtaccggaaaccgttaacccttaaaggtttactttaaacgggtttaccgggttacgggaaccgggttaccggggaacggggttacggggtggggtttaaaccgttttaacgtttcggggtaaaccctttaaccttacggttttaaacttttaccggttttaccgttaacccgggtttagggtaccggggttaacgtaccggggtaaagggtaaacccggttaaaccgggtcccggttacggtaccccgttaccccgtacgtccccgtacccggtaaccccg

SEQ ID NO: 235395 - DNA, 824 bp, Homo sapiens
  misc_feature: GYAE6OF01C8ZEH.21.67.G01.1.454.CMB.1.raw
  modified_base (553)..(553): a, c, t, g, unknown or other
  misc_feature (553)..(553): n is a, c, g, or t
  modified_base (582)..(582): a, c, t, g, unknown or other
  misc_feature (582)..(582): n is a, c, g, or t
  modified_base (598)..(598): a, c, t, g, unknown or other
  misc_feature (598)..(598): n is a, c, g, or t
  modified_base (601)..(601): a, c, t, g, unknown or other
  misc_feature (601)..(601): n is a, c, g, or t
  modified_base (677)..(677): a, c, t, g, unknown or other
  misc_feature (677)..(677): n is a, c, g, or t
  modified_base (815)..(815): a, c, t, g, unknown or other
  misc_feature (815)..(815): n is a, c, g, or t
tcagtcgtcgctcgcacgaccggtgctcgatttagagtatacatattgggtttggggacccaaaaaccacacccctccttgggagattcccctagatccacgacgcccctcaccgatgggactgggaccctgggacgctacttcccttttcctggggttcggcgacgccaggccaaacgtgggttcggccccaccttacccgacggaacccttacccgaaccgttgggttacgccgtaacggttcgtcgggacccgttagggacgggttaggaaacggtaacggtccggttcggggggtcccgtacggggtaggtaaccgggttccttacccggttcggaccgtaacggggtcccttggttacgggtttaccgtttacggtttttttacccggaactttacgttaggttaacgttcgtaacgggtttcggggttacgacccgggaacgtaccgggttccccggttaaggggtaaccgaacgggggttctttacgggtaggtacgggtagggttcgggggacttcgggacccgtaccgttgacgaacggtaagngtagtgtacgcggtagacgtattcggagngtaacgtactccgtanacngacgtatcgactcgtcgactactcgcttcgacgagtacggtacgaactaggacgacgtacggactacgacccggtnaacgtagtttatacggttgtcgacgtgggacgtcggggtacttagtcgtaacgtacgtacttattaggttacttaccgttggttacgtggtaggttcgggacgaacggtccgtaacgtccgtaccggtccctacccgngtaccccgg

SEQ ID NO: 235396 - DNA, 890 bp, Homo sapiens
  misc_feature: GYAE6OF01BQQ5B.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtgggcctcgggtgaaggtctccgtgcagggtcctcgtggttactcggttttccactactaccgacgggcaacgacgccttacttggaacgtgacgaactgagaagtggacgacgacggccatatattagtgtgccggcggtaggtggggtctagtttcgagtacgttactacttattactttacttcgttcgggtacgttcggtaggggtaacgtaaaccggggaccgaccggttaccaccccgggtacccttaccccgacgtcccgtaccccgaacccggtaaaccggggtccccctaacggttccccgggtttcccccctttaccccccgggtcccgggtacccccggtccccccgttcggtaccccgttacccggaaccgggtaacccgtacccccgtaaaccccgggttacccgggaaacggtacccgggtaccccgtaaccggtaacccggggtcccccggggttccccggtaccgggggtacccggtttcccgggttaaccccgttacgggggttacccgggtaaaaacccgggttaccccggtttaacccccggttaccccccggggtaacgggtaaccccccggggaaccgggtttaaaccccggttacggggggaaaccgggtcccccggggggttaccgggtacgggtccccgggggaaacgggtaacccg

SEQ ID NO: 235397 - DNA, 950 bp, Homo sapiens
  misc_feature: GYAE6OF01C6B62.21.67.G01.1.454.CMB.1.raw
tcagtcgtcgctcgcacgaccggtgctcgatttagagtatacatattgggtttgggggacccaaaaaccacacccctccttgggagattcccctagatcacagcccctcaccatggactggacctggagcattcctttcctgggtggcagcagcaacaggtgcccactcccagactcaacgtggtgctagtctggacctggaggtagaaggacgtccggtggggtcctcgggtagtaacggtctaccgtcggcgacgggtcctcgttaggttaccttacgttttccgaactagtagttacgtacgtagggttagggcgtacggaacctacggtacccgttagggaaccgtaagggtcttaggtaggtagggtaggttaggggtacgtacggggacccgtaccgttaccggaacggaaaccgggtaaggaggtacgggtaagtacggtggtacgtaaggtacgttcggaacggtacaacggttaacgttaccgttagaacccgtaacgtacgtaacccttactaccggtacccggacgggtaacccacgtaccggttacccgtaaggtttacggaaaccgtcggtaaacggtaccgttaacggaacggttaacgtaagggaacccgaccggtaaaccggtaccctaaacgttaacttttaacggtttactttaacggggcccggggtaccgtagggggttacgggttaacgggggtactttaagggtttttacggaaaccgttttaaccgtaaccgtttttaaccgggtttaaactttttaccggttttaaccggttacgggtttaaaccggggtaaccccgggttttccggggtaaacgggggggtttaaaaccccggaaacccggggtttaaaccccgggttcccggtaaacccgtttaccccccgggttacccggttaaccccccgtacccgggtttaaacccccccg

SEQ ID NO: 235398 - DNA, 981 bp, Homo sapiens
  misc_feature: GYAE6OF01DA43N.21.67.G01.1.454.CMB.1.raw
  modified_base (962)..(962): a, c, t, g, unknown or other
  misc_feature (962)..(962): n is a, c, g, or t
tcagtcgtcgctcgcacgaccggtgctcgatttagagtatacatattgggtttggggacccaaaaaaccacacccctccttgggagattcccctagatcacagcccctcaccatggactggacctggagcattccctttttccgtgggtggcacgcgagaccaaacgaggtcgccccacctcccaacgacctacaacctgggtgctagtcgtggacctggaggtaggaagaacggccggtcgggggtccgtcgggtacggtaacggttcctccgtcggcggacgggtcccttcggttacggtttaccgtttacggtttttccgaacttaccgtaacccggacgggacctaccgacgtaccgttacggttacgaaccgtacggaaccggtaacgtaggaacgtaacggacgggaacccggtaaccggaacccgggtaccaagttaacgttttaagttttcggttcgggtacgggacgggtacgggggtaacgggggttcgggggtaacgtttaacggttttacgggtaacgttaaacctttaaccggtttaaactttttaacgttttaacttttaccggtttacgggtttacgggttaccgggttccggggtaacgggggtaaaccggtaacccgggggtaaccccggtaccggttacccgtacccccggttacccccgtacccccggaaccgtttacccccggaaccccggtaaccggggaacccgggttacccccttaccgggtttaccccggtcccccgtttcccccgggtccggccccggttacccggtcgtaaccccgtcggaacgggtaccctaccggaccccggtacgacgcgaacccggccggacccggcccggtccgggtggcccgtggttaccccggtaggtaacccgtaccggttaccccgttcccgttaccccttcgttccgtaccgcggtaaccgggcgggtaccgggtntaccggggcgtacggccgg

SEQ ID NO: 235399 - DNA, 735 bp, Homo sapiens
  misc_feature: GYAE6OF01APCEX.21.67.G01.1.454.CMB.1.raw
  modified_base (142)..(142): a, c, t, g, unknown or other
  misc_feature (142)..(142): n is a, c, g, or t
  modified_base (234)..(234): a, c, t, g, unknown or other
  misc_feature (234)..(234): n is a, c, g, or t
  modified_base (430)..(430): a, c, t, g, unknown or other
  misc_feature (430)..(430): n is a, c, g, or t
  modified_base (462)..(462): a, c, t, g, unknown or other
  misc_feature (462)..(462): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcattccttttccgnggtggcagccagcaacaggtcgcccactcccagacctcaacctggtgcagtctcggacctggaggtgaagacgtccgtcggggcctcgggtnaaggtcctcgtgcgacgggtccttcgttcggttactacgttttccgacttagtacgtatcgtaggttggtcgaccgtacgcgggtaccgttggaacggtagggtcttaggacggtggtacgtgggtacggtccggaccgtccgttacggaacgtaaacggagtagtcggtagtacggtgacaggtattcgaaggtntaacgtactttaccgacgaccaacgcgtaccncgacgtcccggaacggacacgtacgaccgtttagtacggaagtacggtacggaacttaaggaagtagtaacgggcctaaccggacgtaccgaattacgttagttaactcgggtacggaccgtaacgggtgggtacgggtactttaggttacaaccttcgttaactacgttaacgttttcgttaaacttcggttacggaccgtttcgggaacggttacgaacgggtttacccacgggtttaccaaccccggttcctacccggtccgtaacccgg

SEQ ID NO: 235400 - DNA, 755 bp, Homo sapiens
  misc_feature: GYAE6OF01AH5WZ.21.67.G01.1.454.CMB.1.raw
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctggaggtgaagacgccgtggggcctggtagaacggtctccgtgcgacgggtcctgttcggttacttacgtttttccgacttagtagttatcgtaggttcgggtgacggaccgacggtcccgttaggaacgtaacgggtcttggaggttggacgtgggtagtcgggccgtaccgttcggacgaaacgggaagacgtaggagtaggttcggtacgaaggtaagttttcggaacggtcgtaaaggttaacttaccgttacgaaccgacgagtacgtaccacgtacccggacgggacaccgacgtcctacgtaggtaccaggtaaccggtacgtaggaagtacgtaggaccgacgaccggactacgtaattacgttagttcgtcggaccggtacgggtacgggtcggggtacgtttaggttacggttaccgtaacgttaacgttaacgttattttaaccgtttaaccgtttacggttcgggtacgtttcgggtacggggtaaccgtaaacgggtacccgtaccggttaccggaccccgttccgtaccccgacccgttaccccgg

SEQ ID NO: 235401 - DNA, 625 bp, Homo sapiens
  misc_feature: GYAE6OF01E5KDO.21.67.G01.1.454.CMB.1.raw
  modified_base (200)..(200): a, c, t, g, unknown or other
  misc_feature (200)..(200): n is a, c, g, or t
  modified_base (504)..(504): a, c, t, g, unknown or other
  misc_feature (504)..(504): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctgggtggcagcagcaacaggtgcccactcccagactcaactggtgccagtctggaccctgnggtgaagagcctggggcctcggtgaaggtctccgtgcagggcctctggttactacgttttccgactatagtatcagttgggtgcgacacggcccttggacgtaagggtcttggaggtggagtgggagtgggccgtaccgttcgaccgaaacgggaagagtggtagtagtggtacgaggtaatttcgaggtcaaggtaacttacccgtagaacccagacgtactaccgctaccgacgggaccacgacgtcctacgtacggtacgtagacggacgtagagagtcggacgacaccggcactatattntgtgcgcggtaggcgggtatagttgtagacttatacttattacttacgttcgtcggtacgttcggtggggaaccgtaagggtacccgaggtacccacccggtccgtccccgacgtaccccg

SEQ ID NO: 235402 - DNA, 742 bp, Homo sapiens
  misc_feature: GYAE6OF01EXKQ6.21.67.G01.1.454.CMB.1.raw
  modified_base (595)..(595): a, c, t, g, unknown or other
  misc_feature (595)..(595): n is a, c, g, or t
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtagaaggtctcctgccagggccctcgtggttactacgtttttccgacttatacccgacgggcacagcctacgttggaactgaggaacctgagaatggacgacgacggaccacgaattattattggtgacggccggtaagggtggggggtactagttttgaagtacctaacgttaacttatttacgtttacgtttcgtttagggtacgttcggttggggaaccgtaaaagggggaccctaaccgggtacctacccgttccccttaccccgagtcccctacccgaacccgaacgggcccctaacgttccggtcccttacccccgtggcccgtccctcgcctaccccgaggaaccgcccaacccgtccgacggacnccgtaacggacgtcccgggaccgtcgggccgtcggacccgttcggtaccggtaaccggtacccgtttaacccgtttccccgttaccggttccttaccgtacgttacgaccggggtccgggtaaccgtggggtcccgaaaggtcccgg

SEQ ID NO: 235403 - DNA, 767 bp, Homo sapiens
  misc_feature: GYAE6OF01AC5TL.21.67.G01.1.454.CMB.1.raw
tcagtcgtcgctcgcacgaccggtgctcgatttagagtatacatattgggtttggggacccaaaaaccacaccccctccttgggagattcccctagatcacagccccctcaccatggactggacctggagcacttccttttcctggtggcagcagcaacaggtcgcccactcccagacctcaacgtggtgcagtctggacctggaggtagaagaacgccgtggggcctcggtagaacggtcctccgtgccgagggtccttcgtacggttacttacgtttttacccgacttagtagttactcgtaggtttgggcgtaccgacgtacggtcccgttacgggacgtaacgggtcgttaggacggtggtaggtggggacgttcgggccgttaccgttacggaacgaaacggtaagtacgtagggtaagtagtggtacgtaaggtacttcggaggtacgaagtaacttaccgtacgaaccacgaacgtactacgaccgccgacgggtcacgtacgtccgtacgtacggtaactaggaacgtaccgtaagacgtaacgacggaaccgtaccgacgtaccctagtaatttacgttagttcgggtagcggtaccgggtagggtcgggtacttagttacggtacgtacgttaacttacgttactttaccgttagttaccggttggtaccgttacgggtacgggtaacccgaaacgggtacccgttaacccgggttaccgtacccccggtccctaccccggaccgttaaccccccgg

SEQ ID NO: 235404 - DNA, 823 bp, Homo sapiens
  misc_feature: GYAE6OF01DBU22.21.67.G01.1.454.CMB.1.raw
  modified_base (129)..(129): a, c, t, g, unknown or other
  misc_feature (129)..(129): n is a, c, g, or t
  modified_base (142)..(142): a, c, t, g, unknown or other
  misc_feature (142)..(142): n is a, c, g, or t
  modified_base (158)..(158): a, c, t, g, unknown or other
  misc_feature (158)..(158): n is a, c, g, or t
  modified_base (190)..(190): a, c, t, g, unknown or other
  misc_feature (190)..(190): n is a, c, g, or t
  modified_base (633)..(633): a, c, t, g, unknown or other
  misc_feature (633)..(633): n is a, c, g, or t
tcagtcgtcgctcgcacgaccggtgctcgatttagagtatacatattgggtttggggacccaaaaaccacacccctccttgggagattcccctagatcacacgcccctcaccatggactggacctggancattccttttcgnggtgcagcagcaacgnggtcgcccactcccagacctcaacgtggtacncgagttcgtcggaccgtaggacggtagaacggacgccggtcggggcctcgggtagtacggtcctccgtagacggtacgggtccttacggttacgttacgttacgttttacccgagttagttacgttacgttacgtagggttcgggtacgaccgtacggtaccggtccgttacggaacggtaacgggtcgttacgggaggtttcgggacggttggggtaacgtccggggacccgttaccggttacggaaaccggtaagggtaagtacgggttagggtaacgttacggttacggtaacggttaggttaaccgttaggggaacgttacgtaaacgttacgttaccgtacgaaccgaagtaccgttacaccgtacgtccgacggactaccgacgtacgttacgtacgacggtacgaacgtaccgaggtaacgtacgtaggaacccgngtaccgacctaattccggttaattcggtacgcggaacggtgggaacgggtttcgtacttaggttactaacggtacttacgttagttaccttacgtctttacggttacgggtgttaacggtcgggtaaaccggtaacccgttcggtaacccgtacccgtaccggttaccccaacgggtccgtaacccccgg

SEQ ID NO: 235405 - DNA, 857 bp, Homo sapiens
  misc_feature: GYAE6OF01DLRZB.21.67.G01.1.454.CMB.1.raw
  modified_base (139)..(139): a, c, t, g, unknown or other
  misc_feature (139)..(139): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatcctttccnggtggcagcagcaccgaggtcgcccactacccagaccacaacgtggtgcagtcgtacggacctgaggtagaacgaacgtccggtagggcctggtacgaaggtcctcgtacgcgacgggtcctggtacgttacgttacggttttccaacttagtacgtactacgtaggtggtacgcgacgtacggtccgttacggaacggtacggtcgttcggaggttaggtaggtagggtaacgcggggttaccacccgttaggaaccggaacgggtaaagtcggtaccggtaagtacggttacggtacgttaacggtaagtttaccggggaacgggtactaaacggttacgttaaccgttacgaacccgtaagaccgtaaccgtcgtaaccgtccggaaacggttacccgaacgtaccgtacccgtaacgttaaccggtaaccgtacgggtaaacgtacccggtaacggtaacggtaaccggtaacgggaacgtaaccgaaccggtaaccgtaaacgtaacgttaacgttaggttaccggacggttaccggtacgggtacgggttacgggtacgttaggttaccggttaacgtaccgttaaacggttaccttacgttacgggttaccttacgggttaccggttaccggtcggttaaacgggaccggtaaaacggtccggtaaccggttaccgtaccccggttaaccctcccgtaccgtaacccccgg

SEQ ID NO: 235406 - DNA, 813 bp, Homo sapiens
  misc_feature: GYAE6OF01DQXA0.21.67.G01.1.454.CMB.1.raw
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcacgggcctcgtggttactagttttccgactactaccgacgggcacacgcctacgttggaactgaggaacctggagaatggacgacgacggccaacatattagttgtgcggcggaggtggggactagtttagtagtactattacttaattatttacgttcgttaggtacgttcggtaggggaacgtaaacggggacccgtaacgggtcctaacccggttcctcccccgacggtaccccttccccgaaacccgtaacggggtacccctacgttcccgggttcccctttaccccccgtgggccccgtaccccgttcgaccccgttacccggaagggtaccggtacccgtaacccgtcccggaaacggtacggacccgaaacccgacgggccccggggtccccgttcgggggcccttcggtacccccggttcgggtaaccgtaaacccgggttaccccgttttaacccccgttttccccggttacccggttttacccctacccggtttaaccggttaccggggtaccgggggacccggggttacccgggttaacgggacccggtaaaggggtacccccggg

SEQ ID NO: 235407 - DNA, 765 bp, Homo sapiens
  misc_feature: GYAE6OF01EGNM7.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtgcccactcccagactcaactggtgcagtctggacctgaggtgaagagccgtggggcctcggtgaaggtcctcctgcgagggccttcgtggttacttcgtttttccgacttagtagtagtcgtaggttgggtgcgacgacggtcccgttaggaacgtaagggtcttaggaggtggtagtgggagtcggggaccgtaccgttcggacgaacggaagagtggagtagtcggtacgaggtaacgttcggaggtacgtaagtaacgtttaccgtacgaaccgtaaccgtaagactaccgacgtacccggacgggtaccacgtacgttaccgtaacggttacggaaacgtggaaaccggtaacgtaggaacgtaacggtcggaaccgaaccgaacccggactaacttacttagttttacgtggtacggacggtacgggtaggggttcgggtacgtttaaggtttacggtaacttaccgttaacgttaagtttaaactttctttaacgttttcgttacgggttaccggttacgggtacgggaaccggtaaacccgggtaccggttacccggttacccgttacccggttcccgtaccccgtccggtaaccccg

SEQ ID NO: 235408 - DNA, 759 bp, Homo sapiens
  misc_feature: GYAE6OF01BILLR.21.67.G01.1.454.CMB.1.raw
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtcctccgtgcgacgggcctcgtggttactacgtttttccgacttagtagtatcgtaggttgggtgtcgacgtacggcccgttggacgaagggtcgttgagtggtagtggggtagtcgggtccggtaccgttcggacgaaacgggaaagtacgtaggtacgtagtaggtacgaggtaacgtttacgaggacagtaacttacgttcgacctagacgtactacgacgtccgacgggcaacgtacgtccttaacgttaggaacgttacggaacggtaacccgtagaacgtaagtacgggaaccgtacgaacccgggtacccaacgtaacttaacgttttacgttaggtcggtacggtacgggtacgggttagggggtactttaggtttagttacgtacttaacgttaacttaacgtttttaacgttaccgttttacggttcggttacgggtttacggtacggggtaaaccgtaaacgggggaacccgtaccgggttacccgaaccccgttccctacccccggtaggtaccccccg

SEQ ID NO: 235409 - DNA, 936 bp, Homo sapiens
  misc_feature: GYAE6OF01EELKY.21.67.G01.1.454.CMB.1.raw
tcagtcgtcgctcgcacgaccggtgctcgatttagagtatacatattgggtttgggggacccaaaaaccacacccctccttgggagattcccctagatcacagcccctcaccatggactggacctggagcatcctttcctggtggcagcagcaacgaggtcgcccactcccagactacaacgtggtgctagtcgtggacctggaggtaggaaacgtacgccggtacggggccgtcgggtaggtaacggtcctccgtcggaccgtacgggtcccttacggttacggtttaacgtttaccggtttttacccgaacgttagttaacgttacgttacggtacgggttggggtacgtaccggtaaccggtaccgggttccccgttagggaaccggtaaggggttccgttagggtacgggttaggggtaacggtacggggggtacggttacccgggggtaccccgttaacccggttaccgggaaaccggtaaaacggggtaaaccgggtaggttagggtaacggttagggttaccggggtaacgtaacgggtttaacgttaccggggaacgggtaacgttaaacggttaacccgtttaccggtacgacccgtaaacgtaccgtaactaccgtaccgtaccggaaccgggtaccaaccggtaccgttaccgttaacggtaacgggtaaccgtacgggtaaaccggtaacgtaacggaaacggtacggtaacccgggtaacgtacccggaaccggtaccgtaacgttaacgttagtttacggtcggacggtccgggagggtacgggtcgggtattacgttacggaacttacgttaaccgttagtaacgttttaccgtacgtttacgggtacgggtacgttacgggtacgggaaacggtacggaccgttacgacccggtacccgtacgtccccgtagtacccccg

SEQ ID NO: 235410 - DNA, 790 bp, Homo sapiens
  misc_feature: GYAE6OF01DA0O1.21.67.G01.1.454.CMB.1.raw
  modified_base (547)..(547): a, c, t, g, unknown or other
  misc_feature (547)..(547): n is a, c, g, or t
tcagtcgtcgctcgcacgaccggtgctcgatttagagtatacatattgggtttgggggacccaaaaaaccacacccctccttggggagattcccctagatcacacgcccctcaccatggactggacctggagcattcctttccgtggtgcgagcgagccaacgaggtcgaccccacctcccaagacctaccaacgttgggtcgcctaggtccgtacgggaccgtagggtagggtaggaaaggtaacggcccggtcgggggtcccgtacgggtacggtaacggttcctccgtcggacgtaccgggtccttcggttacggtttaccgtttaccggttttaccgaacttagtaagttacgtacgtagggttggtacgacgacgtacggtcccgttaggaacgtagggtcgtaggaggtaggtagggtacggggacgtcgggtcccgtaccgttccggaacggaaaggaacgtaggtaggtaacgtagttaggaacgtaggtacgttacggaggtactaaacgttacttacgtacgaacgaacgagtaccncgtaaccgtccggaacgtcactaccgtcgtacgtaggacgtagaccgagtaggaagtagcgaacgacgacgtactatacttagtacgtcgacgcggtagggtacgggtgggtacgtagttacggtaacgtacttaacttacgttattaccgtttcgttacggtacggtacggttacgggtaacgggtaaccggaaacggtccggtaccggttacccgaccgtcccgcccgtacccggtacccg

SEQ ID NO: 235411 - DNA, 782 bp, Homo sapiens
  misc_feature: GYAE6OF01BUC3O.21.67.G01.1.454.CMB.1.raw
  modified_base (138)..(138): a, c, t, g, unknown or other
  misc_feature (138)..(138): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatcctttcnggtgcagcagcaacaggtgcccactcccgagactcaacgtggtgctagtctcggacctgacggtagaagaacgccgtagggtccctcgggtagaaggtcctccgtgacgagggtcctcgtacggttactagttttccgatacgtagtatcgtagttggtcgacgtacgaccggtcccttaggaaccgaggggtacgtttacggaggttacgggtaggtagggtaacggtcggggtacccggtaaccgtttccggacggaaacggtaaggtacgtaggtaaggtagtggtacgaacggtaagtttcgaggtactaaacgtaacgttaccgttagtacccaacgtaaccgtaactctaacgtaccgtacggaccaaccgtacgtaaccgtacgttaacgtaacgtacgggtaacggtaaccgtaggaacggtaaggtaccggaacgaaccgtacccggaactaacgtattaacgtttagttcgggacgtccggtagtacgggtagggtacgttacgttaaggtacgtaccgttaacgttaattacttttaacgttacgttacgttagggttaccttgggtaccggtaacgggaaaccggtaaccgtaccggttacccaccggttccctaaccccgcgtaacccccg

SEQ ID NO: 235412 - DNA, 885 bp, Homo sapiens
  misc_feature: GYAE6OF01CKB98.21.67.G01.1.454.CMB.1.raw
  modified_base (129)..(129): a, c, t, g, unknown or other
  misc_feature (129)..(129): n is a, c, g, or t
  modified_base (158)..(158): a, c, t, g, unknown or other
  misc_feature (158)..(158): n is a, c, g, or t
  modified_base (467)..(467): a, c, t, g, unknown or other
  misc_feature (467)..(467): n is a, c, g, or t
  modified_base (682)..(682): a, c, t, g, unknown or other
  misc_feature (682)..(682): n is a, c, g, or t
tcagtcgtcgctcgcacgaccggtgctcgatttagagtatacatattgggtttggggacccaaaaaaccacacccctccttgggagattcccctagatcacagcccctcaccatggactggacctggancattccttttctggtggcagcagcaaacnggtcgcccactcccagacctacaacgtggtgctagtcgtggacctggaggtagaagacgtccggtcgggccgtcgggtagtacggtcctccgtggacgtacgggtccttacggtttacggttaccgttacggtttttaccctaaccgtaacggtaccggacccgggtacgtaaccgtaaccgtaccgtaaccgtaaccgggtaaacgttaacggaaccggtaacgtaacgaacggtaaggtaccggaacggaccgtaaccggacctaactagttaacgtttgtacgtggcggacgggtagggtacgggnttagttagtaacgtacttaaccgttattactttaactttcgtacggttacgtacggtcgggtacggaaccgggtaaacggaccgttacggtacccgtaacccggtcccttacccgacgtccccgtaccgaaccgtaacccggccgttaccgtaccgttcccgtcccgtacggccctcccgcgtccgtaccgacggccgaccgtaccgtaccgganaccggtaccggaccgggtacccggtccggggtcccggtaacgggcccggttacgtacccgggttaccggaaacccgttaccccggttacccgggtttacccccgttaccgtttaccccgggtttcccttaccgggtacccgggttacggggaaccccggaccggggtttaaccgacccggggttaccgggtacgggtaacccg

SEQ ID NO: 235413 - DNA, 806 bp, Homo sapiens
  misc_feature: GYAE6OF01AFILV.21.67.G01.1.454.CMB.1.raw
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagaacgccgtggggcctcggtgaaggtcctcctgcgagggcctcgtggttacttagtttttccgacttagtagtatcgtaggtttgggtgcgacgacggtcccgttaggaacgtaagggtcgttggaggtggagtaggggagtcggggcccgtaccgttcggacgaaacgggaaagtagtagggtagtagtggtacgaaggtaacgtttcggaaggactaacggtaaacgttacccgtttacgaaccctaacgaacgtactaccgtaaccgtacccgaaccggggtaccaacgtaccgtacccgttaacgttacggtaacgtacggaacggtaacccgtaggaacgtaacggtacgggaacccgtaaccggaccggtaaccctacgttaacgttagtttacgttcggtacggtccggtacgggttacgggtcgggggttactttaacggttttaggtaaccgttaccgttaacttaacgtttatttaacgttttaccgttacggtttacgggttaccggttacgggttacggggtaaccggtaaacggggttacccgtaacccggtcccgtaacccggttccccgtccccgtacgtacccccg

SEQ ID NO: 235414 - DNA, 796 bp, Homo sapiens
  misc_feature: GYAE6OF01DB1Z8.21.67.G01.1.454.CMB.1.raw
  modified_base (128)..(128): a, c, t, g, unknown or other
  misc_feature (128)..(128): n is a, c, g, or t
  modified_base (139)..(139): a, c, t, g, unknown or other
  misc_feature (139)..(139): n is a, c, g, or t
tcagtcgtcgctcgcacgaccggtgctcgatttagagtatacatattgggtttggggacccaaaaaccacacccctccttgggagattcccctagatcacagcccctcaccatggactggacctggancatcctttccnggtggcagcagcaacaggtcgcccacctcccagtactacacgtggtgcagtctcggacctgaggtgaacgacgccgtgggacctcggacgtaaggtcctccgtgcgacgggtcctcgttaggttacttacgttttccgatatagtacgtctaggttggtacgcgacgacggtcccgtaggaacggaggtacgttaggaggtggtagtagggtacggtcgggtacccggtaccgttaccggaaccggtaaacgggaaacggtaggtacggtagttaagggttcgtaacggtaaggtaacgtttcgaacgggtactaaaggttaaacgtttaacccgttacggaaaccccgtaacggtaaccgtaacgttacccgtaaccgtaccccggtaacggggaacctaacgtacccggtaaccgttaaccggttacgggttaacctaccgggtaaacgggtaaacccgttacggaaacggtaaggtaccggaacccgaaccgaacccggtaccgtaaactaaccggttatttagtacgtacggtacgtacgggcggttaggtacgtagttagttactactacgttactagttactcgttcgtcggtacgttacggcggtaaccgacggtacgtaccgactacccgtccgtacccgcgtaccccg

SEQ ID NO: 235415 - DNA, 882 bp, Homo sapiens
  misc_feature: GYAE6OF01DAJ2I.21.67.G01.1.454.CMB.1.raw
  modified_base (366)..(366): a, c, t, g, unknown or other
  misc_feature (366)..(366): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtcgcccactcccagactcaactggtgcagtctcggacctggacggtaggaagaacggtccgtcgggggccttcgggtacggtaacggtccgtccgtgcggaccgggtccttcgttacggttacgttacgtttttacccgatagttagtactcgtagggttcggtcgacgtacgtaccggtcccgttaggacggtaaggtcgttaggnggttagggtacggtggggtaggtcccgggtacccgtttaccgttaccggaaccgtaaacgggtaaagtagttagggtacgttaagggtaccgggttaaggtaaaccggttagtttaccggaacggttacgtaaacggtttaacttaccgtacgtaaccgaaccggtactaccgtacgacgtaaccccggacggtaccgaccgtaccgtacccgttacgtaaggacccgttaggaaccgtaccgtaaggacggaacgtcggaccgaccgtaacggctaactagtaacgtttaggtacgtacggtcgtacgggtagggtacggggtcgtttaaaggtttaccggttaacttaccggtttaacttaaaccgtttagggttttaccctttttaaccggtacgggttttaccgggttaccgggttacgggttaacccggggaaccggttaaaccgggtacccgggttaacccgggttacccgtacccccggttacccctccccgggtacccgtacccccgg

SEQ ID NO: 235416 - DNA, 975 bp, Homo sapiens
  misc_feature: GYAE6OF01D863C.21.67.G01.1.454.CMB.1.raw
  modified_base (140)..(140): a, c, t, g, unknown or other
  misc_feature (140)..(140): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttccnggtgcagcagcaacaggtgcccactccagactcaacgtggtgcagtcgtcggacctgaggtgaagaacgccgtgggcctcggtagaaggtctcgtcgcgaggtcctctaggttacttcgttttaccgacttacgtaccgacgggtacacgtacgtccttacgttacggaacgtcggaacgaaccgtaggaacgaacgtacggaccgaaccgaccggaccaagtaacgtttatttagttcggcggtccggtacgggtagggtttcggggaccttaaggtttacggtaacgtaacccgtttaaacgttaacctttaaacgttttaacttttaaccgtttacgggtttacgggtaaccggtttccgggtaacgggggtaaaccggtaaaaaccggggttaccccggttaaacccgggtttaccccgtaaaccccggtttcccgtaaccccccgggtaaacgttcccccccgttaaaccccggaaaccccgggtaaaccggggtaccccccttaaacgggtttaccccgggtttccccccgtttaccccccggtacggggtcccccgtttacccccgttacgggtacccccttaacccggggtaaccggtacccggttaacccctaccccgggttaaacgggaaccggtaacccggaacccggtaacccgggtaccgggtccccgggtttccccggtaagggtcccccggtttaccggaccggttacccgggaaacccgttaaaccggttcccctttacccgtttaccccgttcggttacccgttaaccctcggtacccgggtacgggtccggaaccgttcgggaccgttaaccggccg

SEQ ID NO: 235417 - DNA, 760 bp, Homo sapiens
  misc_feature: GYAE6OF01DEJMD.21.67.G01.1.454.CMB.1.raw
  modified_base (129)..(129): a, c, t, g, unknown or other
  misc_feature (129)..(129): n is a, c, g, or t
  modified_base (141)..(141): a, c, t, g, unknown or other
  misc_feature (141)..(141): n is a, c, g, or t
  modified_base (187)..(187): a, c, t, g, unknown or other
  misc_feature (187)..(187): n is a, c, g, or t
  modified_base (390)..(390): a, c, t, g, unknown or other
  misc_feature (390)..(390): n is a, c, g, or t
tcagtcgtcgctcgcacgaccggtgctcgatttagagtatacatattgggtttggggacccaaaaaaccacacccctccttgggagattcccctagatcacagcccctcaccatggactggacctggancatccttttccnggtggcagcagcaacaggtcgcccactcccaagactcaaactggtncagtctggacctgaggtgaagagccgtggggcctcgggtagaacggtcctccgtcgcgacgggccttcgttaggtacttcgttttacccgattaatagtactcgaggttcgggtagcgaatacggtccccttaggacgtaaggtcttaggaggtggagtgggtaacgtcggggaccctacgttccggaacgtaaacggaaagngttaggtagtaagtcggaacgtaggtactttacggaggtaccaagttaaaccttcgttaacgaacctaacgacgtaaccgtctaacgtaccgaaacgggactaacgtacgaaccgttacgttacggaacgtacggaaacggtaccgttagaaagtaagtaccggaaccaacgaaccggaccaactacttaacgttacgtttgtaggaccgtaggtacgggttacgggggtacttagtttagaacgttaacttaacgttaaccgtaatttacgttacgtttacggttacggtacggttcggtaacggggaaccgtaaacgggaacccgtaccggttaacccgtacccgtaccccgtcccgcggtaaccccg

SEQ ID NO: 235418 - DNA, 818 bp, Homo sapiens
  misc_feature: GYAE6OF01CUUPS.21.67.G01.1.454.CMB.1.raw
  modified_base (128)..(128): a, c, t, g, unknown or other
  misc_feature (128)..(128): n is a, c, g, or t
  modified_base (185)..(185): a, c, t, g, unknown or other
  misc_feature (185)..(185): n is a, c, g, or t
tcagtcgtcgctcgcacgaccggtgctcgatttagagtatacatattgggtttggggacccaaaaaccacacccctccttgggagattcccctagatcacagcccctcaccatggactggacctggancatcctttcctggtggcagcagcaacgaggtcgcccactcccagactcaacgtggtnctagtcgtggacctaggaggtagaaacggacgtccggtcggggtcctcgggtagtaacggttccttccgtaggccgtacgggtcccttacggttacggtttaccgtttacggtttttaccgaacttaagttacggttacgttacgtagggtttcggggacgccggtaccgtaaccgggttcccgtttaagggaaccggtaacgggttgtttaggagggttacgggtaagggtcgggggtaacgttccgggggtaacccgtaccggttacggaaccggtaaacggggtaagtacggtagggtacgtaggttcggacgtaaggtacttacggaggtacaacgttaacgtccgtacgaaacctcgtaaggtacctaccgtacgtacccggacgtacaccgtcgtacgttaccggtaggaaccgtagaaccgtaacgtgaacgtacgtacggaccgacgaccgtacaacttagtttagttacgttggaccggagtaccggggtagggttcgggtacttgttaacggtacctagttaactaacgtttagttactttacgtcgttagggtaccgtaggggtaacggaccgtaacgggtccttaaccggtcctacccgcccgtcccgtaccggtaccccg

SEQ ID NO: 235419 - DNA, 926 bp, Homo sapiens
  misc_feature: GYAE6OF01AVIEE.21.67.G01.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatcctttcctggtggcagcagcaacaggtgcccactcccagactcaactggtgcagtctggacctgaggtgaagaggccgtggggcctcggngaaggtctcctgcgagggcctcgtaggttactagtttttccgacttatagtatcgtagttgggtgacgacgtacggtcccgttaggaacgaaagggtctttcggaacggttggaacggtgggggtaacggttccgggggtaccccgttaaccgtttaccggaaccggtaaacgggtaaaacggtacggttagggtaaccgttaagggttacgggtaaccgtaagggttaaacgttttaccggaacgggtacgtaaacggttaaacgtttacccgttacggtaaacccgaacggtaacggtaacccgttaccgtaacgttacccggaaccgggtaccgtaaccggtaaccgggtaccctttaacgggtttaaccgggaaccgttaacggtaaccgggaaacccgttaacgggaaacggttaaacggttacggggaacccgtaacccggaacccggggtaaccctaacgttaaacgttacgtttaacgttacggtacgggacggtaccgggtaagggggttacgggggtactttaacgggtttacggttaacgtaaccgtttaaccgtaactttaacgtttaactttacggttttaccggtcgggtttacccggttacgggtaccgggggtaaccggtaaaacggggttccccgtaaacgggtaccccgttaacccggtccccgtcccccgtaacggttaccccccg

SEQ ID NO: 235420 - DNA, 756 bp, Homo sapiens
  misc_feature: GYAE6OF01EVJ8S.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctggaggtgaagagccgtggggcctcggtgaaggtctccgtgcagggcctcgtggttactagttttccgacttagtagtatcgaggttgggtgtcgacacggtcccgttggacgaagggtcttggaggtggagtggggtagtcggggacccgtaccgttcggacgaaacgggaaagacgtgggaagttagtggtacgaaggtaatttcgaaggactagtaacgttaccttgacctaacgacgactacgacgtccgtaacggcaacgtacgtacctaacgttacggaaacgtggaacggtaacgtagaaggtaagtacgggaaccgaaccgaccggaccaactaagttaactttagttacggtacgccggtagggtagggtcgggggtacttaacggtttacgggtaacgtaaccgttaaccgtaacgtttaactttaaacgttttaaccgtttacggttcggtaacgggtttaccggtagggggtaacccggaaaacggggttaaccccggtaccgggttacccgtaaccccggttcccgtacccccgtccggtaaccccccg

SEQ ID NO: 235421 - DNA, 881 bp, Homo sapiens
  misc_feature: GYAE6OF01D69P3.21.67.G01.1.454.CMB.1.raw
  modified_base (137)..(137): a, c, t, g, unknown or other
  misc_feature (137)..(137): n is a, c, g, or t
  modified_base (153)..(153): a, c, t, g, unknown or other
  misc_feature (153)..(153): n is a, c, g, or t
tcagtcgtcgctcgcacgaccggtgctcgatttagagtatacatattgggtttgggacccaaaaaccacaccctccttgggagattcccctagatcacagcccctcacatggactggacctggagcatccttttccnggtggcagcagcaacnggtgcccactcccagactcaactgtgcagtctggaccttgaggtagaagagcctggggcctggtagagtcctcgtgcgaggcctcgtggttactagttttccgagttactaccgacggtacacgacgaccgttacgttcggaacttggaaggtaacctgaacgtaagtacggacgacgacggaccatagttagttacgttggtcgacggaggtaggttacgggggcttagttttacggaacgtaccgttaaccgttaactttagtttaagttttaaccgtttacgtttacggggtaaccgtttcggtacgggggtaacctaaaacgggggtacccgtacggtaccgttacccggttacccgttaccccaccgggtacccgttacccgaaccgaaaccgggggtccccttaacggttcccggtacccgtttcccccgtcggtacccgggcccttccggtcccgttacccgtaacgggacgtaccccgtacccgttacccggaaccggtacgtaccggaaaccggtacccggtaccccggggtccccggttaaccggggtacccgttccggggtacccccggttaacgggttaccggttaaaaccgggttaccccgttttaccccgggtttccccctttacgggttaccccgtttaccccgtaaagttcccgggggtaacccgggtaccggggtaccggtttccggggaaccggtaaaccgggtcccggg

SEQ ID NO: 235422 - DNA, 751 bp, Homo sapiens
  misc_feature: GYAE6OF01ADUM0.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtgggccgtcggtgaaggtctccgtgcgacgggtccttcgtacggttacttacgttttaccgacgttagttagtatcgtaggttgggtgtccgaacgacggtcccgttaggacgaacgggtcttggaggtggagtcgggtagtcgggacccgtacgttacggacgtaaacggaagtagtaggagtagtcggtacgaggtaattggacggagtaacgtaacgttaccgtacaccgacgaagtactaccacgtaccggacggaccacgacgtcgttacgtacggtacgtacggaacggtaacgtaggaacggtaacgtacggaacggaaccgaccggtacaacgttagttaactttaggtcggtacggtcggtacgggtacggggtaggggtacttaggtttaacggtacggttaacgttacctttacgttaactttacgtttaaccgtttcggttaaccggttacggttaccgggacggggaaccggttaaacggccggttaaaccgtcccggtaccgtccccgtaacccgtccgtacccccg

SEQ ID NO: 235423 - DNA, 907 bp, Homo sapiens
  misc_feature: GYAE6OF01CE8F9.21.67.G01.1.454.CMB.1.raw
tcagtcgtcgctcgcacgaccggtgctcgatttagagtatacatattgggtttggggaccccaaaaaaccacacccctccttgggagattcccctagatcgacacgcccctcaccatggactggacctggagcattcctttccgtggtggcagcagcaacgaggtcgcccaacctcccagacctacaacgtggtcgacacgtcgtcggtaccgtggagggtaggaaggaacgtccggtcggggtccgtcgggtaggtaacggtcctccgtcggcggacggtccttcgttacggttacgttacggttttaccgtaacgttagtagttacgttcgtagggttcgggtcgtacggtacgtaccggtacccgttagggaaccggtaacgggttcgttagggtaggtaggggtacggtagggggtacggtccgggtacccgtaccggttacggacggaaacggtaaggtacgtaggtacggttaggtaggtacgtaagttacgtaccggtaggacgttaaacgttaacggttaccgtaacgaccgtaacgagtaccgtacgtacgtacccggacggacgaacgtacccgttaccgtaggtaaacggtaaccggtacgtaaccgtaacgggtaggaaacggaacgtccgggtaaaacccggccggtaaccgtaaccgtaaacgtttagttaacggttcggtcgggttaacggccgggttaagggttcggggttcggggttaacctttggttaacggtaacgtaacgttaacgtttaccgtttaaattttccgttacggtttacggttacgggttaccggtaggggtaaccggtaacccgggaaacgggttccccggtacccgggttaccccgtacccggttcccccgaaacccccggttcggtaaacccccgg

SEQ ID NO: 235424 - DNA, 810 bp, Homo sapiens
  misc_feature: GYAE6OF01CF8B7.21.67.G01.1.454.CMB.1.raw
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctggaggtgaagaagccgtggggcctcggtgaaggtctccgtgcgagggcctcgttgttactagtttttccgactagtagtatcgtaggttgggtgcggacgacggtcccgtttagggaacgtaagggtccgttggaggtaggagtaggggagtcggggcccgtaccgttcggacgtaaacggaaagagtagggtaagtagtaggtacgaagggttagtttacggagggtacgaagtaacttaccgttagaccgaactagtaacctcgtaacgtacccggacgggacaacgaccgtaccgtacgttacggtaacgtacggaacgtaacccgtaaggaacggtaagtacgggaaccgaccgaaccggaccaacggtattaacgtttagttacgtacgggaccgtacgggtaagggttcgggggtactttaggtttaacggtaccggttaactttaaacgttaaccgtttaattttaacgttttaccggtttacggtttaaggggtacccggtttacgggtaaacggggggtaacccggaaaaccggggttacccggtaaccgggttacccgttaacccggttacccccgttaacccccgtaccggttaaccccccgg

SEQ ID NO: 235425 - DNA, 763 bp, Homo sapiens
  misc_feature: GYAE6OF01EFQ8F.21.67.G01.1.454.CMB.1.raw
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacgaggtcgcccactcccagactacaactggtgcagtcgtggacctgaggtagaagagccgtgggcctcggtagaggtctctgcgcggcctgtggttactacgttttacgattatagtatcgtaggttcggtgacgacgacggtcccgttaggaacgtaacgggtcttaggacggtggtaggtggggacgtcgggtaccgtaccgttcggaacgaaacggaagtagtaggtaacgttaggtcggtacgtaaggttaacgttacggaacgggtaccgtaagttaacgttaacccgtagaacccgtaaacgtacgtaacctaccgacgtacccggaacgggtaccacggtaacctccgttaacggtacggaacgtcggaaacgtaaccgtaggaacggtacggtacgggaacccgaccgaccggaccctaataagtttacgtttagtggtacggtaccggtacgggtagggtcgggttacttaggtttacgtaacgtactttaactacgtttaactttacgttaccgtttcggttacggtacccggtagggtacgggaaaccggtaacggtaccggtaccgtaccgaccccgttccgcccgcgtaaccccg

SEQ ID NO: 235426 - DNA, 601 bp, Homo sapiens
  misc_feature: GYAE6OF01B4GQC.21.67.G01.1.454.CMB.1.raw
  modified_base (388)..(388): a, c, t, g, unknown or other
  misc_feature (388)..(388): n is a, c, g, or t
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcacgggcctcgtggttactagttttccgactatagtatctaggttgggtgcgacaggcccttggacgaagggcttggagtggagtggggagtcggggcccgtaccgttcgacgaaacggaaagagtaggagtagtggtacaggtattcgagganagtaacttacgtgaccacagtactacactccgacggacacacgtcctacgtagacgtagacgtactagacgagtacggacgacgacgctacattagtatgtgcgaggtggtgggtacttagttgtacgtactactacttattacttacgttgtcggtagttcggtagggtacgaacgggacgtacggtccgaccgtccctcccgcgtaccccg

SEQ ID NO: 235427 - DNA, 934 bp, Homo sapiens
  misc_feature: GYAE6OF01EH0GL.21.67.G01.1.454.CMB.1.raw
  modified_base (132)..(132): a, c, t, g, unknown or other
  misc_feature (132)..(132): n is a, c, g, or t
  modified_base (170)..(170): a, c, t, g, unknown or other
  misc_feature (170)..(170): n is a, c, g, or t
tcagtcgtcgctcgcacgaccggtgctcgatttagagtatacatattggggtttggggacccaaaaaaccacacccctccttgggagacttcccctagatcacacgcccctcaccatggactggacctgganctacttcccttttccgtgggtcggcagcagccaaacgnggtcaccccacctcccgaagtacctaccaacgtgggtcgacgtagtcgtacggtaccgtgggtaacggtaggaacggtacggtccggtcggggccgtagggtacgtaacggttcctccgtcgcggtacgggtccttacggttacggtttacctttacggttttacccacgttaaccggtacccggacgggtaccacgtaccggtacctttaacggtacggaacgtacgggtaaaccgtaacgtaggtaacgtaacggtacggaacccgaccggacgtacctaattaatttacgttcggtacggcggtacgggtacgggtaggggtcgggtaactttaggttacgaacttaaccttaacgttaaagtttacttttaacgttccggtttacggttacgggtaccggtacgggtaaccgggaaaccggtaaaccgggtcccttaaccggggttaccctcccggtaccccgtaccgaaccgttacccacccgggtaacgaaccggtccccttaaccggttccccgttaccccttcccgggaccggtccccgttacccgcgtacccgtcggaacccggttcccgaacccgtccggtaaccggaccgtaaccggccctaaccggggtccccggttcggtacccggtccgggaccttcccgggtaccgtacggttaaacccgtaccgttccccggttccttacccggttccgttcggttacccgtacgggtcggtccggggaccgggtacccacggtccggggaactcggg

SEQ ID NO: 235428 - DNA, 893 bp, Homo sapiens
  misc_feature: GYAE6OF01CBDM1.21.67.G01.1.454.CMB.1.raw
  modified_base (286)..(286): a, c, t, g, unknown or other
  misc_feature (286)..(286): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctgggtgaaggtctcctgcgagggcctcgtggttactacgttttccgacttagtagtatcgtagttgggngcgacaggcccttaggacaagggtcttggagtggtacgtggggagtcggggccgtaccgtttcggacgtaaacgggtaaagacgttagggaagtagttggtaccgtaaggtaacgtttccgaagggtacaagtaacgtttacccgtttacggaacctaacgaacggtactacccaacgttacccgaaccgggacaacgtacgtaccgttaacgtttacggaacgtaacggaacggtaaaccgtacggtaacggtaacgtacgggaaccgtaaccggaaacccggaccgtaacgtaaacgtttaacgtttaacgtttacgggtacggtaccgggtaccgggtaacggggttcggggggtaacctttagggtttttaacgggttaaccggttaaccgtttaaaccgtttaaaccgttttaaacgttttaaaccgtttttaaaccgttttaccggtttaaccggggtttaacccggttaccggggttaacggggggaaacccggttaaaaaccgggggtaccccccggttaaaacccggggttaccccgttaaacccccgggtttacccccgttaaccccccgggtaaccccggtttaaacccccccggg

SEQ ID NO: 235429 - DNA, 847 bp, Homo sapiens
  misc_feature: GYAE6OF01CTPLL.21.67.G01.1.454.CMB.1.raw
  modified_base (602)..(602): a, c, t, g, unknown or other
  misc_feature (602)..(602): n is a, c, g, or t
tcagtcgtcgctcgcacgaccggtgctcgatttagagtatacatattggggtttggggacccaaaaaccacacccctccttgggagattcccctagatcacagcccctcaccatggactggacctggagcatccttttcctggtggcagcagcaacaggtcgcccactcccagactcaactggtgcagtcctggacctgaggtgaaggacgccgtggggtccgtcggtcgaaggtcctccgtgccgacgggtcctcgtggttactacgtttttacccgacgtaacttaccgaccggggtacaaccgtacgcccgtttaacgttacgggtaaaaccgtggtaacgggtaaccctggaaagaacgttacgggacgaccgacggtacccataacttacgttagtcggtggacggcgggtagggtcgggggtattagtttacggtacgtacttacttacttaacgttaactttacgttcgttaggtacgttccggtagggaccgtaaaacggggccctaacggttcccaaccgttaccgtcccccgaacgtacccctccggtaacccgaaggggtccccctagttaccccggtcccgtttcccccngggtcccgaccccgtcggtacccgtacccggaacggtacccggtacctaaccccggtaccggaacgtaaccgtccgtaaaccggtccgggttaccccgggaccccgtggggtcctccggtaccccgggtacggtacccgttaacgggccccgtttaccgttcccccgttcggttaaccgtccgttaaaccgggcggtaacccggggtcggggttccccggtacgggaacccggtaggggtacccg

SEQ ID NO: 235430 - DNA, 849 bp, Homo sapiens
  misc_feature: GYAE6OF01BLFJR.21.67.G01.1.454.CMB.1.raw
  modified_base (788)..(788): a, c, t, g, unknown or other
  misc_feature (788)..(788): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagacgccgtgggcctcgggtgaacggtctccgtggcgacgggccttcgtggttactacgtttttccgaacttacgtaccgacggggcctaacgacggtccttaacgttggaaccttggaaggaaccttaggaagaagtcggacgaacgaccggaccactattaattacgtgtcgacgcggtaagggtcggggacttagtttggaacgtaccttaacttaacgttaatttaacttacgttacgttgggtaaccgttcggtaggggtaaccggtaaaacggggtacccgtaccggttaccgtaacccgtcccgttaccccccgacggtcccccttaacccggaaccccggtaaaccgggggtccccctaaacgggtttcccccgggtttaccccctttaccccccgggtacggggtaccccctcccccggtttacggaccccgttaccccggaacggggtacccggtaccctaacccccggtacggaacggaccctcgaaacccgtccgggacccggttcccgggtcgggacccgtcggtacccgtacgggttacccaaacgggtttacccccttaccggtttccccnccggtttacctccccgtttaagcccgggtacgggacccgggtcgtacgacggaacgggtcc

SEQ ID NO: 235431 - DNA, 873 bp, Homo sapiens
  misc_feature: GYAE6OF01CPSDH.21.67.G01.1.454.CMB.1.raw
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaacgtggtgcagtctggacctggaggtgaaggaacgccgtggggtctcgggtagtaggtcctctggcgtacgggtccttcgttaggttacgttacgtttttccgaacgtaattagtagtgtaggttgggtcgtacgacgtacggtccgttaggaacgtaagggtcgtttaggtaggtaggtaggtagggtacggtcgggtccggtaccgtacgaacggaaaggtaaacgtacggtaggtaagttacgtaggtacgtaaaggttacgttacggaggaacgttaagtaacgtttaccgtacgaaccgtacgtaacgtactacgtacgtaccggtaccggaccaaccgtacggttacccgttaacgttaacgggtaaccgtacgggaacggtaacgtaagtaaggtacggtaccggaacgaaaccggaccgaacctaagttaacgtttaagtttacgttacgggacggtcccggagggttacggggtacgggttatttaacgggtttacgtaaaccttacgtttaaaccgttaacgttttaacgtttaaacgtttttcccggtttaaggtttaacgggttaccggtttaaacggggggtccgggttaaaaaccgggaaaccccgggttacccggtaaacccggtttaccccggggttcccgaaacccccggttcccggggtaaaccccttacccccgggg

SEQ ID NO: 235432 - DNA, 860 bp, Homo sapiens
  misc_feature: GYAE6OF01BJNK5.21.67.G01.1.454.CMB.1.raw
  modified_base (87)..(87): a, c, t, g, unknown or other
  misc_feature (87)..(87): n is a, c, g, or t
  modified_base (130)..(130): a, c, t, g, unknown or other
  misc_feature (130)..(130): n is a, c, g, or t
  modified_base (142)..(142): a, c, t, g, unknown or other
  misc_feature (142)..(142): n is a, c, g, or t
tcagtcgtcgctcgcacgaccggtgctcgatttagagtatacatattgggtttgggggacccaaaaaaccacacccctccttggganattcccctagatcacagcccctcaccatggactggacctggancatccttttccnggtggcagcagcaacaggtgcccactcccagactcaacgtggtgcagtctcggacctggaggtagaacgacgccgtgggcctcggtagacggtcctaccgtgccggacggtccttcgtgttaccgttacgttttaccgactactaccgacgggcacgacgtacctacgtacggacttcggaacgtaacctggaaacgaacgtcggaaccgtaccgaccgggtacctaactaacgttacgtttaggttcggtacggaccggtacgggttaggggtacggggtactttaaggttttacggaacttaaacccgttacgttaactttaaagtttacgtttaccgtttacggttacggtacggttacgggtacgggggtaacgaaaacccgggtcggttaaccgtacccgtaccggtttacccctacccgacggttacccctaacccggaaacccggtaccgggtaccccaccggtttcccggtaccccttacccccggtggtaaccccgtccgtcccggtactaccggtacgaccccggttccacccgggtgacccgtagaccctaccgggaccggaccggttcccggtaggtaccctacgggttcccgtaagggtacccgtaaacccgtttaccccgtttccgttcccccgtacgtttacccgtccgttaacccgggcgttacgggtacccggggttaccaccggggactaacgggacccg

SEQ ID NO: 235433 - DNA, 925 bp, Homo sapiens
  misc_feature: GYAE6OF01D9TH1.21.67.G01.1.454.CMB.1.raw
tcagtcgtcgctcgcacgaccggtgctcgatttagagtatacatagttgggttggggacccaaaaccacacccctccttgggagattcccctagatcacacgcccctcaccgatggactgggacctggagcctattcctttttcctgggtggccagcagacaacgcggtcgcccaacctcccagacttaccgtaacgtggtcgcgtacggtcgtacgggtacccgtggtaacgggtaagaacggaaccggtacccggttcggggggtcccgttagggtacggacgggttccttcccgtagggccgtacggggttccccttacgtttacggtaccgttttttacccggtacctaacgttaacccgaaccgggccgaaccctagacccgtttaaccgttcggtaaccgtaggtacggaaccgttacggaggtaattaccgggaacggaccggtaaccgggtccctaaacgtacgtttaacggtttacggttacggttttacgggaacggggggccggttaaggggtttccggtaagggttacgtacccgttaacgttacgtaacgttaacttacgttacgtacgttacgtacggtacgtacggaccggtacgggtacgtacgtaccgtacccgtacgtacccgtaccgtaccgtaaccgtacccgtaccggtaccgtacccggttaccccggttacccggtcccggtccggtcccggtcccgtaccggaccggtaccggtaccgtacccgaccggtaaccgtacccgaaccgtaaccgtaccggaccggtacccgggacccggtccggtaccggtaccggtaccggttaccggtaccggtaaccgtaccggtacccgtacgttcccgtacccgttaccgtccgtacgtacggtacggtccggtacggacggtcggtacggtagtacg

SEQ ID NO: 235434 - DNA, 823 bp, Homo sapiens
  misc_feature: GYAE6OF01B2KD6.21.67.G01.1.454.CMB.1.raw
  modified_base (159)..(159): a, c, t, g, unknown or other
  misc_feature (159)..(159): n is a, c, g, or t
  modified_base (650)..(650): a, c, t, g, unknown or other
  misc_feature (650)..(650): n is a, c, g, or t
  modified_base (734)..(734): a, c, t, g, unknown or other
  misc_feature (734)..(734): n is a, c, g, or t
  modified_base (745)..(745): a, c, t, g, unknown or other
  misc_feature (745)..(745): n is a, c, g, or t
tcagtcgtcgctcgcacgaccggtgctcgatttagagtatacatattggggtttggggacccaaaaaaccacacccctccttgggagattcccctagatcacagcccctcaccatggactggacctggagcattccttttcctggtgcagcagcaacgnggtcgcccactcccagacctcaaccgtggtcactagtcgtcggacctggtaggtagaagacgtcggtacggggtcctcgggtaggtaacggtcctacgtcgacggcgggtccttcggttacggttaccgtttacgtttttccgagttagttacgtaacgtggttagggttttgggccgtacggtaccgtacggggtcccgtttaggggaaacccggtaagggttccgttaacgggtaggttaacgggggaagttcgggggtacgtaccggggggttccccttaaccggttacggtaaacgggaaacggtaaaggttaccgtaggggtaaaccttgggtaaccggggtgttaaaacgggtacggtttccggtaagggtaacgtaacggtttaaacgtttaccccgaaaggttaacccaacctaaggtacttaccgacgttccggaacggtcaacgtacgtacctgtaacggacgtacgtaacgaccgtaaancggtaaagaccgggaactacgacggtccaagttattaacgtagttcggactcggacggtacgggtagggtctagtttcgtaacncgttaacgttnttaaactttgttaacttcggtaggttccggtacgttcgggacgtaaccggtgtaccgtctacgccctcgacgtacccg

SEQ ID NO: 235435 - DNA, 797 bp, Homo sapiens
  misc_feature: GYAE6OF01DMXU9.21.67.G01.1.454.CMB.1.raw
tcagtcgtcgctcgcacgaccggtgctcgatttagagtatacatattggggtttggggacccaaaaaccacacccctccttgggagattcccctagatcacagcccctcaccatggactggacttggagcattccttttcctggtggcagcagcaactaggtcgacccacctcccagactactaactggtagctagtcgtcgacctgaggtagaagacgcgtgggcctgggtagagtctctgcgaggcctcgtaggttactacgttttccgactatagtatacgtaggttggagcgaacgtcggtcccgttaggacgtacgggtcttaggaggtaggagtagggacgtcgggacccgtacgttacggaccgtaaacggaacgtagtacggtaagtggtacggttagaaggttacgttcggaacgggtactaacgttaacggttaccttaacgaaccgtactaagacccgttacgaacgttacccgacgggtacctaacgaccgttacccgtaacgttagggaccgtaacggtacgggtaaaccctgggtaacgtaaggttaccggaaccggtaccggtaacggacccgtaaccgttaagttaccgtttaagttcggtacggcgggtaacgggtacggggtacggggttaacttacggttaaggtaaccggtacttaaccgttaacgtttaacgtttacttaaccggtttggtaaccggtacggttacggtaaggggaccgtaaacgggaacccgttaccgggaccctacccgttacccgtccccgtcgtaaaccccg

SEQ ID NO: 235436 - DNA, 971 bp, Homo sapiens
  misc_feature: GYAE6OF01ERSCV.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacgaggtcgcccactcccagactcaacgtggtgacagtcgtggacccgtggagggtagaaggaacgtcccggtacgggggcccgttagggtacgggaaccgggttccttcccgtggaccgtacgggggtcccttacgttacgggtttaccgttacggttttttaccggacttaacgttagtaacgttcggtaagggtttcggggtacggtaccggactaccggggttcccgttaggggtaaccgtaaacgggggtacgtttagggaagggttaggggtaacgggttagggggtacggtccgggggtacccggttacccggtttaccgggaaccggaaaaccggggtaaaggtagggttaacgggacgggttaggttacgggttaggaacgggttacgttaacggaacgggtcgtaaaggtaaccgtttaacccgttacggaacccgtaacggaacgtaccgttaccgtaaccgttaaccccggaaccgggacctaacggaccggttaccgtaaccgggtttacggaaaccgttacgggaaacccggtaaaccgtagggaaacggtaacggtaaccgggaaccgtacccggaaacggtaacccctagttaacgttaagtttacggtcggtacggcgggttacgggaggggttcggggtacgtttacggttaggtaaccgttacgttaacgttaactttaacgttttacgtttcctttagggtttacggtacgggtttaccgggacgggggtacgtaaacccgggtaccggacggttacccgttaccccggtaccccgttacccggaccgtacccccggg

SEQ ID NO: 235437 - DNA, 983 bp, Homo sapiens
  misc_feature: GYAE6OF01DPNI8.21.67.G01.1.454.CMB.1.raw
tcagtcgtcgctcgcacgaccggtgctcgatttagagtatacatattgggtttggggacccaaaaaccacacccctccgttgggagattcccctagatcacagccccctcaccagtggactggaccgtggagcacttccttttcctgggtcggcaggcacgacaacgacggtcgcccaccttcccacgacctaccgaacgtgggtcgccgtaggtccgtcggtacccgttgggacggttacggaaacggacggtccggtcgggggtccgttacgggtacgggtaacggttccgttccgtacgggccggtacgggtccttcgtttacggtttacgttaccgttttacgacgttagttacgttactacggtaggttcgggtcgaccgacggtaccggtccgtttacggaacggttacgggtcgttagggaggttagggacggttacgggggtacggtacccggggtacccgttacccggttacggaaccgggtaaacggtaaggtagggtaccggtaggttacgttacggtacgggtaacgttacggttcggaaggtaccgtaaacgtttaccgttaccgtaccgaacccgtacgagtacctacctacggaccgacgggtaccacggtccgtaccgtacgttacggaacgtacgggtaaccgaacggttaggaaccgggtacgtaaccggaacccgtaccggaaccgttaccgtaacgtttaacggtttacggtttaccggttacggtacccggtaccggggtaacgggttccgggggtaacggggttaccgtttaacgggttttaacgggttacccttaaccggtttaacggttaacctttttacggtttaaccgtttaacgggttttcgtaccgggggtttacggttaaccgggtacgggggtaaccgttaaaccccgggtccgttaaccgggttaccccccttaccggtaccccggttaaccccggtccgtaaacccccggg

SEQ ID NO: 235438 - DNA, 816 bp, Homo sapiens
  misc_feature: GYAE6OF01ESOE8.21.67.G01.1.454.CMB.1.raw
  modified_base (234)..(234): a, c, t, g, unknown or other
  misc_feature (234)..(234): n is a, c, g, or t
  modified_base (629)..(629): a, c, t, g, unknown or other
  misc_feature (629)..(629): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtgggcctggtgaaggtctctgcgnggtcctcgtggttactagttttccgacttactaccgacggcacgacgtaccgttacgtacggaactaggaacgtaaccgtggaagaacggttacgggaacctacggaccggtaccgaacgttattaacgttagttcggtgaccggacggttagggtcggggtacttagttttaggacgtaaccgttaacctaacgttaagtttactttacgtttccgttagggtaccgttccgggaggggtaacgaaaacggggtcccctaacgggtacccgtacccggttaccccgtaccccgcgtacccctacccgaacccggaacgggtcccctaacggttccccgggtttacccctccccggttacggccccgtccttaccggacccttaccggaggtacncccgtacccgacgagtaccggtaccaaccgggcggtacccggtcccggtaggtaccgttcacccgggttcgtaaaccggtaaccggttaacgttcccccggtaaccgggtaacgtcccgggaaccccgtaacgggttaccgggtccgggaccgggttaccggacgggttaaacgccgggtaacccgg

SEQ ID NO: 235439 - DNA, 834 bp, Homo sapiens
  misc_feature: GYAE6OF01BY6OO.21.67.G01.1.454.CMB.1.raw
  modified_base (163)..(163): a, c, t, g, unknown or other
  misc_feature (163)..(163): n is a, c, g, or t
  modified_base (645)..(645): a, c, t, g, unknown or other
  misc_feature (645)..(645): n is a, c, g, or t
tcagtcgtcgctcgcacgaccggtgctcgatttagagtatacatattgggtttggggacccaaaaaccacacccctccttgggagattcccctagatcacacgcccctcaccatggactggacctggagcattccttttcctggtggcagcagcaacaggtcncccactcccagacctcaacgtcggtgcgtagtcgtggaccgtggacggtagaacgacgtccgtcggggaccgtcgggtagtaacggtcctccgtggccgacgggtcctcgtcggtttacgttcggttttaccgtactagtgttatcgtaggttgggtacgccgacgtacggtacccttagggaaccgaggtacgttcggtaggtaggacgtggggtacggtccgggtacccgtaccggttcggacgaaacggaggtaggtcggtagtgtaggtacgtaaggtacttcggacggtactaagtaaccgttcgtaacaacgtacgaacgtctacgtacgtcccgaaacggtaccaacggtaccgttacctacgggttacgtaaccgtaggaaaccggttacgtaagggtaacgtaaggtaaccggtaaccggacccgaaccggtacctaaccgttagtaacctttaggttccgacgggtaccggngggttaacgggtcggggtttaacttaacgggttttcgaacgtttaaaccgttacggttaacttttaacttttaacggtttacccgtttacgggtccggtttaacggtacggggaacgggtaaacccggttaacggtacccggaccgttccgggtaaccccgttacccgtccccggacccgttaccccgg

SEQ ID NO: 235440 - DNA, 723 bp, Homo sapiens
  misc_feature: GYAE6OF01BKWDW.21.67.G01.1.454.CMB.1.raw
  modified_base (128)..(128): a, c, t, g, unknown or other
  misc_feature (128)..(128): n is a, c, g, or t
  modified_base (139)..(139): a, c, t, g, unknown or other
  misc_feature (139)..(139): n is a, c, g, or t
  modified_base (184)..(184): a, c, t, g, unknown or other
  misc_feature (184)..(184): n is a, c, g, or t
  modified_base (205)..(205): a, c, t, g, unknown or other
  misc_feature (205)..(205): n is a, c, g, or t
  modified_base (643)..(643): a, c, t, g, unknown or other
  misc_feature (643)..(643): n is a, c, g, or t
tcagtcgtcgctcgcacgaccggtgctcgatttagagtatacatattgggtttggggacccaaaaaccacacccctccttgggagattcccctagatcacagcccctgaccatggactggacctggancatcctttccnggtggcagcagacaacaggtgcccactcccagacgtcaactggtnccagtactcggacctgaggtnaaggtagccctggggcctgggtgaacggtctccgtgacgacggtcctgtagttactacggttttccgatatagtactgacgttggtgtcgacacggcccttaggactaagggtctagacgtggagtgggtagtacgggtaccgtaccgttacggaccggtaaacccggaaaggtaaccggtagggaacgttaacgggtcggtaccgtaaagggtaacggttttacgaacggggtactaaaggttaaacgttaaccgtttacgggaacccctaacgaacggtaacctaccaagttaccccgacgggtacaaccgtacgtacccgtacgttacggaaccgtaggtaaacgacccgttaagaacggtaagtacgaacgtacaacggccaagtactatacgttgcgacggtagcggagggtacctagttacgtagaccttanaccgttattactaccgttagtacgtcggttacggacgggagaaacggtacgacgttaccgatcccgtaacctcgaccccg

SEQ ID NO: 235441 - DNA, 538 bp, Homo sapiens
  misc_feature: GYAE6OF02I9QCJ.21.67.G01.1.454.CMB.1.raw
tcagtcgtcgctcgcacgaccggtgctcgatttagagtatacatattgggtttggggacccaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgaggaacctgagaatggacgacacggccacatattattgtgcgcgagtgggggcatttgtagactactactattattacttcttggacgtctggggcaaagggaccacggtcaccgtctcccagcctcaccaagggccatcgtctcccctggcgccctgctccaggagcacctccgagacgcacagcggccctgggctgcctggtcaaggactacttccctcgtcctctactgagccggctggcaggcg

SEQ ID NO: 235442 - DNA, 544 bp, Homo sapiens
  misc_feature: GYAE6OF02IKNR0.21.67.G01.1.454.CMB.1.raw
  modified_base (516)..(516): a, c, t, g, unknown or other
  misc_feature (516)..(516): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgaggaacctgagaatggacgacacgggccacatattattgtgcgcgagtgggggcattttgtagactactactattattacttcttggacgtctggggcaaaaggggaccacggtcaccgtctcccagcctcaccaagggcccatcggtcttcccctggccgccctgctccaggcgccacctccgagacgcacagcgccctggctgcctggtcaggctacttcccncgtctctactgacgcgggctggcaggcg

SEQ ID NO: 235443 - DNA, 543 bp, Homo sapiens
  misc_feature: GYAE6OF02HTXOZ.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgaggaacctgagaatggacgacacggccacatattattgtgcgcgagtgggggcatttgagactactactattattacttcttggacgtctggggcaaagggccaggtcaccgtctcccagcctcaccaagggcccatcggtcttcccctggccgccctgcctccaggacgcacctccgagacgcacagccggccctgggctgcctggtcaaggctacttccctcgtcctctactcgacgcggctggcaggcg

SEQ ID NO: 235444 - DNA, 536 bp, Homo sapiens
  misc_feature: GYAE6OF02HW1T0.21.67.G01.1.454.CMB.1.raw
  modified_base (448)..(448): a, c, t, g, unknown or other
  misc_feature (448)..(448): n is a, c, g, or t
  modified_base (508)..(508): a, c, t, g, unknown or other
  misc_feature (508)..(508): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgaggaacctgagaatggacgacacggccacatattattgtgcgcgagtgggggcagtttgtagactactactattattacttcttggacgtctggggcaaagggcacggtcaccgtctcccagcctccaccaagggcccatcgtcttcccctgcgccngctccagacgcacctccgagacgcacagccggcctgggctgcctggtcaggctacttccncgtctctactgacgcggctcggcaggcg

SEQ ID NO: 235445 - DNA, 559 bp, Homo sapiens
  misc_feature: GYAE6OF02FUFL2.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatggggccgaccttcgcaacgggaaagatggagtatggtcaggaatttcagggcagaattaccttgaccacagactcatccacggacacagcctactggaactgaggaacctgagaatggacgacacggccacatattattgtgcgcgaggtgggggcagtttgtagactactactattattacttcttggacgttcgtcggggtacgaaagggccacgggtccaccggtctccccgagtccccg

SEQ ID NO: 235446 - DNA, 562 bp, Homo sapiens
  misc_feature: GYAE6OF02GX5I2.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaagggcttgagtggatgggatgggccgaccgttcgacgaacggaaagagtggagtatgggtcaggtatttcgagggcaaggtaattaccgttgaccacagactcatccacggacacagcctactggaactgaggacctgagaatggacgacgacgcacatattatgtgcgcgtaggtggggctagtttgtacgtacgttacgtacttattacttacttcgttggtacgtgtgggactaagggacacggtcaccgtctcccgagtcccg

SEQ ID NO: 235447 - DNA, 547 bp, Homo sapiens
  misc_feature: GYAE6OF02GREC4.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagttttccgactatagtatcagttgggtgcgacaggcccttggacaagggcttgagtggatgggatgggccgaccttcgcaacggaaagatggagtatggtcaggaatttcaggcagaattacctgaccacagactcatccacgggcacagcctactggaactgagaacctgagaatggacgacacggccacatatattgtgcgcgaggtggggcagtttgtagtactaactactattattacttcttggtacgttcgtagggcgaaagggacacggtcaccgtctccccgagtcccg

SEQ ID NO: 235448 - DNA, 605 bp, Homo sapiens
  misc_feature: GYAE6OF02I6UT4.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgaggaacctgagaatggacgacacggccacatattattgtgcgcgagtgggggcatttgagactactactattattacttcttggacgttcgtggggcaaagggccacggtcaccgtctcccagcctccaccaacgggcccagtcgtcttcaccctggccgcctgcctccgaggacgccaccgtccgagacgcacacggccgcccgtggggcctggcccgttgggtaccgaacgggtccttaaccgtttccccgttccggttccgttccgttaaccgtcggaacggtccggggtaccgtcggggacgtaaccggg

SEQ ID NO: 235449 - DNA, 552 bp, Homo sapiens
  misc_feature: GYAE6OF02GB5PZ.21.67.G01.1.454.CMB.1.raw
  modified_base (381)..(381): a, c, t, g, unknown or other
  misc_feature (381)..(381): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccgaccttcgcaacggaagatggagtatggtcaggaattcgaggcagaattaccttgaccanagactcatccacgggcacagcctactggaactgagacctgagatggacgacacggacacatatatgtcgcgcgaggtgggggctagtttgtacgtactactactattattacttcgttggtacgttcgtagggcaaagggaccacggtaccaccgtcctacccgagtcccc

SEQ ID NO: 235450 - DNA, 533 bp, Homo sapiens
  misc_feature: GYAE6OF02IY63J.21.67.G01.1.454.CMB.1.raw
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
  modified_base (503)..(503): a, c, t, g, unknown or other
  misc_feature (503)..(503): n is a, c, g, or t
tcagtcgtcgctcgcacgaccggtgctcgatttagagtatacatattgggtttggggacccaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgagaacctgagatggacgacacggccacatattattgtgcgcgagtgggggcagtttgtagactactactattattacttcttggacgtctggggacaaagggaccacggtcaccgtctcccagcctccaccaggccatcgtctcccngcncctgctccagacgcacctcgagcgcacacgcggccctgggctcgcctggtcaggactacttcnctcgtctctactgacgcgggctcggcacgg

SEQ ID NO: 235451 - DNA, 548 bp, Homo sapiens
  misc_feature: GYAE6OF02I10MT.21.67.G01.1.454.CMB.1.raw
  modified_base (380)..(380): a, c, t, g, unknown or other
  misc_feature (380)..(380): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccgaccttcgcaacggaagatggagtatggtcaggaattcaggcagaattaccttgaccanagactcatccacgggcacagcctactggaactgaggaacctgagaatggacgacgacggccacatatattgtgcgcgaggtggggctagtttgtagactactactattattacttcgttggtacgtcgtgggacgaagggaccgacggtacaccgtctcccagtcccg

SEQ ID NO: 235452 - DNA, 561 bp, Homo sapiens
  misc_feature: GYAE6OF02IY1XB.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccgaccttcgcaacggaaagatggagtatggtcaggaatttcgaggcagaattacctgaccacagactcatccacgggcacagccctacttggaactgaggaacctgagaatggacgacgacggccacatattattgtgcggcgaggtggggctagtttgtagactactactattattacttcgttggtacgttcgtggggacaagggaccgtacggtccgaccgtcctaccccagtacccg

SEQ ID NO: 235453 - DNA, 274 bp, Homo sapiens
  misc_feature: GYAE6OF02GOMI2.21.67.G01.1.454.CMB.1.raw
  modified_base (262)..(274): a, c, t, g, unknown or other
  misc_feature (262)..(274): n is a, c, g, or t
tcagtcgtcgctcgcacgaccggtgctcgatttagagtatacatattgggtttgggggcatttgtagactactactattattacttcttggacgtctggggcaaagggaccacggtcaccgtctccccagcctccaccaagggcccatcggtcttcccctggcgccctgctccaggagcacctccgagagcacagcggccctgggctgcctggtcaaggactactccgagcgacgactgagcgggctggcaaggcgcatagnnnnnnnnnnnnn

SEQ ID NO: 235454 - DNA, 550 bp, Homo sapiens
  misc_feature: GYAE6OF02GR7E8.21.67.G01.1.454.CMB.1.raw
  modified_base (431)..(431): a, c, t, g, unknown or other
  misc_feature (431)..(431): n is a, c, g, or t
  modified_base (447)..(447): a, c, t, g, unknown or other
  misc_feature (447)..(447): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaagggcttgagtggatgggatgggccgaccttcgcaacggaaagatggagtatggtcaggaatttcgaggcagaattacctgaccacagactcatccacgggcacagcctactgaactgaggacctgagatgacganacggcacatatattgngcgcgagtggggctagtttgtagactactactattattacttcgttggtacgttcgtaggggactaagggacctacggtccgaccgtcctaccccgagtcccg

SEQ ID NO: 235455 - DNA, 547 bp, Homo sapiens
  misc_feature: GYAE6OF02FPZC6.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccgaccttcgcaacggaaagatggagtatggtcaggatttcaggcagaattaccttgaccacagactcatcacggcacagcctactggaactgagacctgagaatggacgacacggcacatatattgtgcgcgagtgggggcgagtttgtagactactactattattacttcgttggtacgttcgtgggactaagggaccgacggtcgaccggtctccccagtccccg

SEQ ID NO: 235456 - DNA, 394 bp, Homo sapiens
  misc_feature: GYAE6OF02GYAJS.21.67.G01.1.454.CMB.1.raw
  modified_base (389)..(394): a, c, t, g, unknown or other
  misc_feature (389)..(394): n is a, c, g, or t
tcagtcgtcgctcgcacgaccggtgctcgatttagagtatacatattgggtttggggagtatggtcaggaatttcagggcagaattaccttgaccacagactcatccacgggcacagcctacttggaactgaggaacctgagaatggacgacacggccacatattattgtgcgcgagtgggggcatttgtagactactactattattacttcttggacgtctggggcaaagggccacggtcaccgtctccccagcctccaccaagggcccatcggtcttccccctggcgccctgctccaggagcacctccgagagcacagcggccctgggctgcctggtcaaggactacttcccgagcgacgactgagcgggctggcaaggcgcatagnnnnnn

SEQ ID NO: 235457 - DNA, 580 bp, Homo sapiens
  misc_feature: GYAE6OF02FPCIH.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccgacttcgcaacggaagatggagtagtggtcaggatttcaggcagaattacctgaccacagactcactaccacgggacacgacgcctacgtacggaacgtgaacggaacctgaagaatggacgacgacggaccacatattattgtgccgtacgagtgggggtactagtttgtagtacgtactactactttattacttcgttggacgttcgtcgggtacgaacgggacctacgggtaccaccgtccgtaccctacgtcccg

SEQ ID NO: 235458 - DNA, 580 bp, Homo sapiens
  misc_feature: GYAE6OF02FT095.21.67.G01.1.454.CMB.1.raw
  modified_base (481)..(481): a, c, t, g, unknown or other
  misc_feature (481)..(481): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgaggaacctgagaatggacgacacggccacatattattgtgcgcgagtgggggcatttgtagactactactattattacttcttggacgttcgtggggacaaaggggacccacgggtcacccgtctccccagccctccaccacgggcccatccggtccttcccccgtggccgtccctgcctccgagggacnccacctccgagacgcacagccgcccgtgggctcgccgtgggtacaaggacctacgttccctcgtcctccttacgtcgacgtccgggctcggcgaggccg

SEQ ID NO: 235459 - DNA, 575 bp, Homo sapiens
  misc_feature: GYAE6OF02I37IZ.21.67.G01.1.454.CMB.1.raw
  modified_base (473)..(473): a, c, t, g, unknown or other
  misc_feature (473)..(473): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgatatagtatcagttgggtgcgacaggcccttggacaagggcttgagtggatgggatgggccgacttcggcgaacggaagagtgggagtagtggtcaggtaattcgagggcagtaacttaccttgaccacgagactcactccgacggcacagcctactaggaactgagactgagaagtggacgacgacgacacatatagtgtgcgcgagtggggntagtttgtacgtacgtacgtacttattattactttcgttcggtacgttcgtagggtacgtaagggtaccgtacggtaccgtaccgtccgtcccgagtacccg

SEQ ID NO: 235460 - DNA, 548 bp, Homo sapiens
  misc_feature: GYAE6OF02FWJ8J.21.67.G01.1.454.CMB.1.raw
  modified_base (444)..(444): a, c, t, g, unknown or other
  misc_feature (444)..(444): n is a, c, g, or t
  modified_base (475)..(475): a, c, t, g, unknown or other
  misc_feature (475)..(475): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgaggaacctgagaatggacgacacgggccacgatattattgtgcgcgagtgggggcagtttgtagactactactattattacttcttggacgtctggggcaaaagggaccacggtcaccgtctcccagcctcaccaagggccatcgcttccccngcgccctgctcagcgcacctcgagagcaacngcgcctgggctcgcctggtcaaggactacgttccctcggtcctcgtactcgacgtcgggctgggtcaaggccg

SEQ ID NO: 235461 - DNA, 564 bp, Homo sapiens
  misc_feature: GYAE6OF02GY06L.21.67.G01.1.454.CMB.1.raw
  modified_base (385)..(385): a, c, t, g, unknown or other
  misc_feature (385)..(385): n is a, c, g, or t
  modified_base (424)..(424): a, c, t, g, unknown or other
  misc_feature (424)..(424): n is a, c, g, or t
  modified_base (446)..(446): a, c, t, g, unknown or other
  misc_feature (446)..(446): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtgcccactcccagactcaactggtgcagtctggacctgaggtgaagaagccgtggggcctcggtgaaggtctcctgcgagggcctctggttactagttttccgactatagtatcagttgggtgcgacaggccttggacaagggcttgagtggatgggatgggccgaccttcggacaacggaagagtggagtatggtcaggaatttcgaggcagaattacttgacanagactcatccgacggcacagcctactgaactgaggaacngagaatggacgacgacggccanatattatgtgcgcgagtggggctagtttgtagactaactactattattacttacgtggtacgttcgtagggacgtaaagggaccgtacggtaccgaccggtcctccccgagtaccccg

SEQ ID NO: 235462 - DNA, 555 bp, Homo sapiens
  misc_feature: GYAE6OF02I8WFP.21.67.G01.1.454.CMB.1.raw
  modified_base (445)..(445): a, c, t, g, unknown or other
  misc_feature (445)..(445): n is a, c, g, or t
  modified_base (450)..(450): a, c, t, g, unknown or other
  misc_feature (450)..(450): n is a, c, g, or t
  modified_base (464)..(464): a, c, t, g, unknown or other
  misc_feature (464)..(464): n is a, c, g, or t
  modified_base (529)..(529): a, c, t, g, unknown or other
  misc_feature (529)..(529): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgaggaacctgagaatggacgacacggccacatattattgtgcgcgagtgggggcatttgagactactactattattacttcttggacgtctggggcaaaggggaccacggtcaccggtctccccagccctccaccaaggcccatcgtcttccccnggccncctgcctccgacgngccacctccgagagcacaggccgccctgggcctgcctggtcaaggtacctacttccctggtcctntacgtcgacgccgggctcggcaggcg

SEQ ID NO: 235463 - DNA, 562 bp, Homo sapiens
  misc_feature: GYAE6OF02IOLZW.21.67.G01.1.454.CMB.1.raw
  modified_base (458)..(458): a, c, t, g, unknown or other
  misc_feature (458)..(458): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctctgcagggcctctggttactagttttccgactatagtatcagttgggtgcgacaggccccttggacaagggcttgagtggatggggatggggccgaccttcgcaacggaagatggagtatggtcaggaattcaggcagaattaccttgaccacagactcatccacgggcacagcctactaggaactgaggaacctgagaagtacggacgacgacgccacatattattgngcgcgaggtggggctagtttgtagactactatattattacttcgttggtacgtcgtcgggacaaagggtaccgacggtaccgaccgtccgtccccgagtccccg

SEQ ID NO: 235464 - DNA, 617 bp, Homo sapiens
  misc_feature: GYAE6OF02F9QKC.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgaggaacctgagaatggacgacacggccacatattattgtgcgcgagtgggggcagtttgtagactactactattattacttcttggacgtcgtggggcaaaggggaccacgggtcaccggtctccccacgcctccaccaacgggcccactccggtccttcccccgtggcccgtcccgtcgccttcccgacggacgccacccgtccgacgacgccgacgacgcccgggcccgtcgggcctcggccgtcggtaccgaacggaccgttaccgttcccgttccgtcccttcgtacctcggacgtccggggcgtcgggcgtaacgggccgg

SEQ ID NO: 235465 - DNA, 817 bp, Homo sapiens
  misc_feature: GYAE6OF02JIEN5.21.67.G01.1.454.CMB.1.raw
tcagtcgtcgctcgcacgaccggtgctcgatttagagtatacatattgggtttggggacccaaaaccacacccctccttgggagattcccctagatcacagcccctcaccatggactggacctggagcatccttttcctggtggcagcagcaacaggtgcccactcccagactcaactggtgcagtctggacctgaggtgaagagcctgggcctcggtgaaggtctcctgcagggcctcgtggttactagttttccgactatagtatcagttggtagcgacaggcccttggacaagggcttgagtggatgggatgggccgacttcgacaacggaagagtgggagtagtggtcgaaggtaatttcgagggtcaaggtaattaccgttagaccacgtaacggacttacgacgtacccgacggggtaccaacgtacggtacccgttaacgttacgggtaaacccgttaggaaaccgggtaaacccgttacggtaaacgggtaaacgttacggggtaaaccggtaaaccgaaacccggggtacccgaaaccgtaacgttaaacgtttaaacggtttacgggttcgggtaaccggtaccgggtaacggggttacgggggggtaccgttaacgggtttttacgggtaaacggtaacgtttaaacccgttaacgtttaacgtttacgttttaaccgttttacggttaccgggttaaccggtttacggttaacgggggtaaccgttaaacgggggtaacccggttaaccgggttaccgttaaccccgggtttaccccgttacccccggtaccgttaaccccccgg

SEQ ID NO: 235466 - DNA, 544 bp, Homo sapiens
  misc_feature: GYAE6OF02F03L0.21.67.G01.1.454.CMB.1.raw
  modified_base (339)..(339): a, c, t, g, unknown or other
  misc_feature (339)..(339): n is a, c, g, or t
  modified_base (379)..(379): a, c, t, g, unknown or other
  misc_feature (379)..(379): n is a, c, g, or t
  modified_base (437)..(437): a, c, t, g, unknown or other
  misc_feature (437)..(437): n is a, c, g, or t
  modified_base (448)..(448): a, c, t, g, unknown or other
  misc_feature (448)..(448): n is a, c, g, or t
  modified_base (468)..(468): a, c, t, g, unknown or other
  misc_feature (468)..(468): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccgacttcgcaacggaaagntggagtagtggtcaggatttcaggcagattacctgaccanagactcatccaggcacagcctactggaactgacggacctgagatggacacacggccanatattatgtgngcgagtggggcagtttgtanactatactattattacttgttggacgttcgtcggggacaagggacctacggtccgtaccgtcctccccgagtcccg

SEQ ID NO: 235467 - DNA, 792 bp, Homo sapiens
  misc_feature: GYAE6OF02JPVJL.21.67.G01.1.454.CMB.1.raw
  modified_base (163)..(163): a, c, t, g, unknown or other
  misc_feature (163)..(163): n is a, c, g, or t
  modified_base (752)..(752): a, c, t, g, unknown or other
  misc_feature (752)..(752): n is a, c, g, or t
  modified_base (785)..(785): a, c, t, g, unknown or other
  misc_feature (785)..(785): n is a, c, g, or t
  modified_base (791)..(791): a, c, t, g, unknown or other
  misc_feature (791)..(791): n is a, c, g, or t
tcagtcgtcgctcgcacgaccggtgctcgatttagagtatacatattgggtttggggacccaaaaccacaccctccttgggagacttccctagatcacacgccctcaccatggactggacctggagctacttccttttcgtggtggcagcagcaacgcggtcncccactaccagacctacaacgtggtcgcgtacgtcgtacggacgtaggaggtacggaacggacggtccggtcgggtcgtacggtacggtacgtcgtcgtcggacggtacggtccttcgttacgttacgttcgtttacgacgtacgacgacggacacgtcgtactagtacgacgtacgaacgtacgtagagacgtacggacacgtacgtactaatagttacgttacggcggtacggacggtaggtacgggttacggttaacttcggttaacgtaacgttaactttaacttaacgtttacgtttacgttcggttacggttaacgggtacggttacggggaacggtaacggtaacccggtacccgttaccggtacccgtaccgtacccgtaccggaaccgtacccgtaaacccgtaacggggtccccgtaccgtttcccggtcccgttaccgttacccggccgttaccctcggtaccgacccggttaacgccggtacctaacccggcggtacgtacgggacctacgggccgtcggtacccggtctacggtaccgtcgtacgtaccggtaccttaccggtcctccgttacggntaccgacggttacgcgggtcgacggagtaccgnggaacng

SEQ ID NO: 235468 - DNA, 566 bp, Homo sapiens
  misc_feature: GYAE6OF02FF9WO.21.67.G01.1.454.CMB.1.raw
  modified_base (484)..(484): a, c, t, g, unknown or other
  misc_feature (484)..(484): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcctggggcctcggtgaaggtctcctgcagggcctctggttacagtttttccgactatagtatcagttgggtgcgacaggccctttggacaaggggcttgagtggatggggatgggccgaccttcgcaacggaaagatggagttatggtcaggaatttcgaggcagaattaccttgaccacagactcatccacgggcacagcctactggaactgaggaacctgagatggacgacacggccacatattattgtgtcgcgagtgggggtctagtttagtanacgtactacgtattattacttcgttgtacggtcgtggggtacgaaagggacgtacggtccgaccgtcctcccgagtaccccg

SEQ ID NO: 235469 - DNA, 544 bp, Homo sapiens
  misc_feature: GYAE6OF02F6Y49.21.67.G01.1.454.CMB.1.raw
  modified_base (536)..(536): a, c, t, g, unknown or other
  misc_feature (536)..(536): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgaggaacctgagaatggacgacacggccacatattattgtgcgcgagtgggggcatttgtagactactactattattacttcttggacgtctggggcaaagggaccacggtcaccgtctccccagcctccaccaaggcccatcggtcttcccctggccgccctgcctccaggacgcacctccgagacgcacagccggccctgggctgcctggtcaaggctactccctcgtctctactcgagcggcnggcaggcg

SEQ ID NO: 235470 - DNA, 607 bp, Homo sapiens
  misc_feature: GYAE6OF02HHWFL.21.67.G01.1.454.CMB.1.raw
  modified_base (462)..(462): a, c, t, g, unknown or other
  misc_feature (462)..(462): n is a, c, g, or t
  modified_base (481)..(481): a, c, t, g, unknown or other
  misc_feature (481)..(481): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctctggttactagtttttccgactataccgacgggcacagcctacttggaactgaggacctgagaatggacgacacggccacatattatgtgcgcgagtggggctagtttgtagactactactattatttacttcttggacgtgtagggcgaaagggccacggttccgaccgttcctacccagccctaccgaccgaacgggcccagtccgtccttccccgnggccgccctgcctcgacgnccaccgtccgagacgccgacacgcggcccgtgggcctcgcccgtggtaccgaaggtcccgttaaccctttcccgtacgttccgttaccgtacgtcggacgggtcccggcggtcggaccgagggccg

SEQ ID NO: 235471 - DNA, 571 bp, Homo sapiens
  misc_feature: GYAE6OF02FVALJ.21.67.G01.1.454.CMB.1.raw
  modified_base (386)..(386): a, c, t, g, unknown or other
  misc_feature (386)..(386): n is a, c, g, or t
  modified_base (392)..(392): a, c, t, g, unknown or other
  misc_feature (392)..(392): n is a, c, g, or t
  modified_base (451)..(451): a, c, t, g, unknown or other
  misc_feature (451)..(451): n is a, c, g, or t
tcagtcgtcgctcgcacgaccggtgctcgatttagagtatacatattgggtttgggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctgggggcctcggtgaaggtctcctgcagggcctctggttacagtttttccgactatagtatcagttgggtgcgacaggcccttggacaagggcttgagtggatgggatgggccgaccttcgcaacggaaagatggagtatggtcaggaatttcgagggcagaattaccttgaccanagactnatccgacgggcacagcctactcggaactgaggaacctgagaatggacgacgacggccanatattatgtgcgcgagtgggggactagtttgtagactactactattattacgttcgttggacgttcgtggggtacgtaagggaccgtacggtccgtaccggtcctaccccgagtaccccg

SEQ ID NO: 235472 - DNA, 646 bp, Homo sapiens
  misc_feature: GYAE6OF02IZPAK.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatctagttgggtgcgacaggtcccttggacgaagggcttggagtggagtgggatgggccgaccttcgacaacggaaagacgtaggagtagtggtacaaggtaatttacgagggactaaggtaattaccgttagaaccacgagtactacactaccgacgggacacgtacgccgtaacgttacggaacgtaggacggtaaccgtagaacgtaagtacgggaacgaacgaccggaccaactatagttattgtagtacgtacggtaggtggggactagtttagtacgtactacgtacgttaattacttacgttacgttcggtacgttcgtagggtacgaacgggtaccgtacggtaccgtaccggtcctacccgacgtacccg

SEQ ID NO: 235473 - DNA, 553 bp, Homo sapiens
  misc_feature: GYAE6OF02G370X.21.67.G01.1.454.CMB.1.raw
  modified_base (449)..(449): a, c, t, g, unknown or other
  misc_feature (449)..(449): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgaggaacctgagaatggacgacacggccacatattattgtgcgcgagtgggggcatttgtagactactactattattacttcttggacgtctggggcaaaggggaccacggtcaccgtctccccagcctcaccaagggcccatcggtcttcccctggcnccctgctccaggcgcacctccgagacgcacagccggccctgggcctggcctgggtcaaggacctaccttccctcgtcctctactgacgccgggctggcaggccg

SEQ ID NO: 235474 - DNA, 567 bp, Homo sapiens
  misc_feature: GYAE6OF02GSN4E.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttggagtggatgggatgggccgaccgttcggacaacgggaaagatggagtagtggtacaggaatttcgagggcagaattaccttgaccacagactcatccacgggcacagcctacttgaactgagaacctgagaagtggacgacacggccacatattattgtgcgcgagtggggctagttgtagactactacttattattacttcgttggtacgttcgtagggacgtaagggtaccgacggtaccgaccgtcgtacccagtacccg

SEQ ID NO: 235475 - DNA, 613 bp, Homo sapiens
  misc_feature: GYAE6OF02IV0BN.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagttttccgactatagtatcagttgggtgcgacaggcccttggacaagggcttgagtggatgggatgggccgaccttcgctaacggaagagtggagtagtggtcaaggtatttcgagggcaggtaaattccttaggacccacgagactcaatccacgggcacagcctattggaactgagaaccgtgaagaagtaggacgacgacggccaacatattatgtagcgacggtaggtcgggggcgacgtttaggttaacgacttaacgttacgttatttacgtttactttacgttaggtacggttcgttacggggccgtaaagggaccgtaccgggtacgacccggttccgtaccccgacgtaccccg

SEQ ID NO: 235476 - DNA, 771 bp, Homo sapiens
  misc_feature: GYAE6OF02J1UF0.21.67.G01.1.454.CMB.1.raw
tcagtcgtcgctcgcacgaccggtgctcgatttagagtatacatattgggtttgggggtacccgaaaaaccaacaacccctcccttcgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggagtgggccgaccttcggcgaaccgggaaagacgtagggacgttagtgggtcgaaggtaagtttcgaagggcaagtaagttaccttggaaccctaacgtaggactacgacttcccgacggggacaacgacgtaccctacgttacgggaacttacgggaaggtaaccgtaggacggtaaagtggaaccgacgaaccgggccaacgtaacttagttacgttaggttcggaccggtacggtacgggtggggggtaccgtaaggttttacgggtaaacgttaccggttaaaccgttaacgtttaagtttaccgttttaaaccgttttccggtttacgggttaacccggtttacggttcggggggttaacccgtaaaacgggggttaaccccgaaccggggttaccctaacccgggtttaccccgttaccccccggtaacggtttaacccccccgg

SEQ ID NO: 235477 - DNA, 645 bp, Homo sapiens
  misc_feature: GYAE6OF02H3ZT0.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagttttccgactatagtatcagttgggtgcgacaggccttggacaagggcttgagtggatgggatgggtccgtaccgttcgacgtaacggaaagtatagggagtagtggtcgaggtaatttcgaagggcagaattaccgttaggacctaacaggactcaactccgacgggcaacgacgccgtactttcggaactggaacggacctagagaagtggaacgacgaccgggaccacgaacttattagtagtcggcgcggacggttgggggactagtttggttaagaccttaacttaccgtattttacgttacgtttacgttggttaccggttacgtcggggtaaccgtaaggggaccgtaacgggttccacccggttccgtacccccgtagtacccccg

SEQ ID NO: 235478 - DNA, 562 bp, Homo sapiens
  misc_feature: GYAE6OF02HDJB3.21.67.G01.1.454.CMB.1.raw
  modified_base (378)..(378): a, c, t, g, unknown or other
  misc_feature (378)..(378): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagttttccgactatagtatcagttgggtgcgacaggcccttggacaagggcttgagtggatgggatgggccgaccttcgcaacggaagatggagtatggtcaggaatttcgaggcagattactgaccanagactcatccgagggcacacgacctacgtggaactgaaggaacctagagaagtggacgaacgacggaccacatattattgtagcgacggagtgggggctagtttgtagactactactattattacttcgttggacgttgtgggacgaagggaccgacggtctaccggtctccccgagtaccccg

SEQ ID NO: 235479 - DNA, 913 bp, Homo sapiens
  misc_feature: GYAE6OF02IXUPN.21.67.G01.1.454.CMB.1.raw
tcagtcgtcgctcgcacgaccggtgctcgatttagagtatacatattgggtttggggacccaaaaaccacacccctccttgggagattccctagatcacagcccctcaccatggactggacctggagcatccttttcctggtggcagcagcaacaggtgcccactcccagactcaactggtgcagtctggacctgaggtgaagagccgtgggccgtcggtgaaggtctcctgcgagggcctcgtggttactacgttttccgatatagtatcgagttggtgcgacacggcccttggacgaagggtcttacggaggtacggaagttcgggggaagtcggggtaccccgtaccgtttccggaacgtaaaaccgggtaaaaggtaacgtaggggaaacgttaacgttggggtaccgtaaaggggtaaacgttttccgggaacgggtacgtaaacgttaaacgtttacccgttaacggtacccgtaaaccgaacgtaacgttaccgtaacgttaccccgggaccgggaacctaacgaccggttaccccgttaacgtttaacgggtaaacgttagggaaccgggtaaaccgttagggaaacgtaacgggtaccggtaaccggaccggaacccgggaaccttaaccgaggtttaaactttcggttaaggtacggacgggttaaccgggtaagggttaccgggggtacgtttaacggttttacggtaaaccgttaaccggtaacctttaaccgtttaacgttttaccgtttttaacggtttacccgtttaacgggggttaaccgttacggggttaaccggggtaacccgggtaaaacggggttaccccggtaaaccgggttacccggttaaccccccggtttacccggttacccccccggtaaacggttaacccccccggg

SEQ ID NO: 235480 - DNA, 633 bp, Homo sapiens
  misc_feature: GYAE6OF02IJHQJ.21.67.G01.1.454.CMB.1.raw
  modified_base (387)..(387): a, c, t, g, unknown or other
  misc_feature (387)..(387): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggtcccttggacaagggcttgagtggatgggatgggccgacttcgcaaacggaagagtggagtagtggtacaggtaattcgaggcagaattaccttgaaccanagactacatccgaacgggcacgacgtccgttacgtacggaactggaacggaacgtaggaagtaagtgggaaccgaacgaccggaccaacgtattaagttatggtagccggtaggtagggtgggggacttagtttagtaacgtacttacgttaacgttattactttacgtttcgttaggtacgttcggtacgggtacgaaccgggtaccgtacggtaccgtaccggtccctaccccgacgtaccccg

SEQ ID NO: 235481 - DNA, 651 bp, Homo sapiens
  misc_feature: GYAE6OF02H2PIG.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgagacctgagaatggacgacacggcacatatattgtgcgcgagtgggggcagtttgtaggactactactattaattacttcttggtaacgttctaggggtacaaaaggggtaccacgggtcaaccggttctcccccgagccctcccgacctaacgggccccagtccggtcttacccccgtggtaccgtcccttgacccttccgacgggacgccgaaccctcccggacgtacgccgaccgacggccggccctggggcctcggccctcgggtaccaacgggtaccttaccgttccccgttacgtcccgtttacccgtacgttcggacggtaccggggtccgtagggtacccgaagggtcccgg

SEQ ID NO: 235482 - DNA, 847 bp, Homo sapiens
  misc_feature: GYAE6OF02JQEIL.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcgagggcctctggttacagtttttccgactatagtatcagttgggtgcgacgaggcccttaggacaagggcttgaggtggagtggggatgggaccgaccgttcggacgaacggaaacgtataggagtagtgggtagaagggtaagtttcgagggctaaggtaacgtttaccgttaggaaccgaactacgtacgtaccaagttacccgaaccggggtcaaccgtaacgtacccgttaaccgtttacgggtaaccgtacggtaaaccggtaaacccgttacggaaacggtaaacggttacgggaaaccggtaaccggaacccgggtaaccctaacgtaaaccgttaacgttttaaacggtttaggttacgggaccgggtacgggtaacggggttacgggggggtaaccttaacggtttttaggtaaacgggttaaaccgttaaaccgtttaaacgtttaacgtttaaccgtttttaaccgttttaccggttaacgggttaccggtttacggggttaccggggtaaccggttaaaaccggggtaacccggttaaccgggttaaccccggttaacccgggtttaccccgtttaccccccggtaccggttaacccccgg

SEQ ID NO: 235483 - DNA, 595 bp, Homo sapiens
  misc_feature: GYAE6OF02GYQ4L.21.67.G01.1.454.CMB.1.raw
  modified_base (350)..(350): a, c, t, g, unknown or other
  misc_feature (350)..(350): n is a, c, g, or t
  modified_base (421)..(421): a, c, t, g, unknown or other
  misc_feature (421)..(421): n is a, c, g, or t
tcagtcgtcgctcgcacgaccggtgctcgatttagagtatacatattgggtttggggacccgaaaaccaacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgacttatagtatctagttgggtgcgacaggcccttggacaagggcttgagtggatgggagtgggtcgaccgttcgcgtaaacggaaagntaggagtatggtacagggtaatttcgagggcaagtaattaccgttgacctacagactacacgtccacgggnaacacgacctacgttaggaacgtggacggaacgtagaagaatggacgacacggccaacatattattgtagcgacgtaggtggggctagtttgtagtactacgtactattattacttgttggacgtcgtagggacaagggtaccacggtaccgaccgtcctcccgtagtaccccg

SEQ ID NO: 235484 - DNA, 549 bp, Homo sapiens
  misc_feature: GYAE6OF02HQS51.21.67.G01.1.454.CMB.1.raw
  modified_base (340)..(340): a, c, t, g, unknown or other
  misc_feature (340)..(340): n is a, c, g, or t
  modified_base (382)..(382): a, c, t, g, unknown or other
  misc_feature (382)..(382): n is a, c, g, or t
  modified_base (442)..(442): a, c, t, g, unknown or other
  misc_feature (442)..(442): n is a, c, g, or t
  modified_base (454)..(454): a, c, t, g, unknown or other
  misc_feature (454)..(454): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttgagtggatgggatgggccgaccttcgcaacggaagntggagtatggtcaggtatttcgaggcagaattacctgaccanagactcatccgacgggcacgacgctacgtgaactgagacctgagatggacgacacgccanatatatgtgcgngaggtggggctagtttgacgtactacgtactattattacttcgttggtacgtgtagggacaagggacctacggtcaccgtcctcccgagtacccg

SEQ ID NO: 235485 - DNA, 816 bp, Homo sapiens
  misc_feature: GYAE6OF02FRPXP.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactgggaccctggggacactacttttcccttttccgtgggtcggacgacgacgacgacaaacggtaggtcccgacccctaccctacccgaacgtacctaacctaacggttgggtcgacgtacgttcggtaccggtaccgtagggtagggtaagaaaggaccgtccgggtcgggtccgttacgggtaaggtacgttccttccgtgacggacggtccttgttacggttacgttttccgtttaccatagtagtactagtaggttggcgacgacgtacgtccgtaggaacggtaggtctaggaggtagaggtggtaggtccggtaccgtacgtaccgaacggaaaggaagtgtaggtattaggtcggtagtaagttacgttacggaggtaactaagtaaccgtttaccgaccgaaccgacgtaacgtacctaacaccgtaccgggacggtacaacgtaccgtaccttacggtagtaacgtaacggaaccggtacgagtaacggaacgtcggaaccgacgaccgaacctaattaattattcggtacggtcggacggtagggtgggtacggtacttagtttacggaaccttaacttacgttaacttagttttacctacgtttacggtaacggttcggtacgggtaacggtaaccggaaacggtccggttacggacccgttaccgtccctacccggtacctaccccgg

SEQ ID NO: 235486 - DNA, 565 bp, Homo sapiens
  misc_feature: GYAE6OF02FVXEI.21.67.G01.1.454.CMB.1.raw
  modified_base (380)..(380): a, c, t, g, unknown or other
  misc_feature (380)..(380): n is a, c, g, or t
  modified_base (399)..(399): a, c, t, g, unknown or other
  misc_feature (399)..(399): n is a, c, g, or t
  modified_base (448)..(448): a, c, t, g, unknown or other
  misc_feature (448)..(448): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgagaagcctggggcctcggtgaaggtctcctgcagggcctctggttacagtttttccgactatagtatcagttgggtgcgacaggcccttggacaagggcttgagtggatgggatgggccgacgttcgcaacggaagagtggagtatggtcaggtaattcgaggcagaattactgaccanagactcatccacgggcacngcctactggaactgagacctgagagtggacgacacggacacatatatgngcgcgtaggtcggggctagtttgtacgtactacgtacttattagttacttcgttggtacgttcgtacgggactaaagggtaccgacggtaccaccggtcctaccccgtagtaccccg

SEQ ID NO: 235487 - DNA, 592 bp, Homo sapiens
  misc_feature: GYAE6OF02HVYUI.21.67.G01.1.454.CMB.1.raw
  modified_base (320)..(320): a, c, t, g, unknown or other
  misc_feature (320)..(320): n is a, c, g, or t
  modified_base (330)..(330): a, c, t, g, unknown or other
  misc_feature (330)..(330): n is a, c, g, or t
  modified_base (474)..(474): a, c, t, g, unknown or other
  misc_feature (474)..(474): n is a, c, g, or t
  modified_base (491)..(491): a, c, t, g, unknown or other
  misc_feature (491)..(491): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcgggtgaaggtctcctgcagggcctctggttactagtttttccgactataccgacgggcacagcctacttggactgagaacctgagatggacgacacggccanatattattgngcgcgaggtgggggctagtttgtagacttactacttatttacttactttcttggtacgtcgtggggacaaagggtacccacggtccaccgtctccccgagccctccaccgacggccctacgtccggtccctccccgtcggcccncccgtcgctccgaggcnccaccgccgagacgcacgcgccgggcctgggctcgccgtggtacaaggccttaccgttcctcgtcctaccgtactggacggtcggcgtcggacgtaggccg

SEQ ID NO: 235488 - DNA, 556 bp, Homo sapiens
  misc_feature: GYAE6OF02FGERZ.21.67.G01.1.454.CMB.1.raw
  modified_base (320)..(320): a, c, t, g, unknown or other
  misc_feature (320)..(320): n is a, c, g, or t
  modified_base (449)..(449): a, c, t, g, unknown or other
  misc_feature (449)..(449): n is a, c, g, or t
  modified_base (480)..(480): a, c, t, g, unknown or other
  misc_feature (480)..(480): n is a, c, g, or t
  modified_base (535)..(535): a, c, t, g, unknown or other
  misc_feature (535)..(535): n is a, c, g, or t
  modified_base (546)..(546): a, c, t, g, unknown or other
  misc_feature (546)..(546): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgaggaacctgagaatggacgacacggccanatattatgtgcgcgagtgggggcatttgtagactactactattattacttcttggacgtctggggcaaagggccacggtcaccgtctccccagccctccaccgaagggccccatccggtcttcccccgnggccgccctgccttccaggacgcacctcganagcacacgcgcccgtggctgccgtggtcaaggacctacgttccgacgcgacgacngacggcgggcncgggcaggcg

SEQ ID NO: 235489 - DNA, 735 bp, Homo sapiens
  misc_feature: GYAE6OF02G9DQH.21.67.G01.1.454.CMB.1.raw
  modified_base (363)..(363): a, c, t, g, unknown or other
  misc_feature (363)..(363): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtgcccactcccagactcaactggtgcagtctggacctggaggtgaagaagccgtggggcctcggtgaaggtctcctggcgagggcctcgtggttactagtttttccgacttagtagtatcgtaggttgggtgcgacaggcccttggacaagggcttggagtgggatggggagtcgggcccgtaccgttcgacgaaacggaaagngtaggagtagtggtacgtaaggtaatttcggaaggtcgaaggtaaacttaccgttacgaacctaacgtacgaaccgtacacgttacccggacggacctaacgacgtacccttaacgttacggaacgttaggaacggtaaccgtggaagaagtacggaacgaaccggaaccggacccgtaacgtaacgttaagtttaagttcggtacgtaccggaccggtagggtacggggtacttaggtttacgtaacgttaccgtaacgttaacgttaatttacgtttacgtttaccggttacggttacggttcggtacgggtaaccgtaaagggtacccgtacgggttccaacccggttccgtaccccgtacgtaccccg

SEQ ID NO: 235490 - DNA, 578 bp, Homo sapiens
  misc_feature: GYAE6OF02F9H53.21.67.G01.1.454.CMB.1.raw
  modified_base (465)..(465): a, c, t, g, unknown or other
  misc_feature (465)..(465): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccgtaccgttcgcgaacggaaagagtggagtatggtcaggaatttcgaggcagtaattaccttgaccacgagactcactccgacggcacgagcctacgtggaactgacggaacctgagaagtggacgacgacgccacatattatgngcgcgaggtggggctagtttgtagactactactattattacttcgttggtacgttacggtcgggtacgaagggtaccgtacggttccacccgtccgtaccccgacgtaccccg

SEQ ID NO: 235491 - DNA, 574 bp, Homo sapiens
  misc_feature: GYAE6OF02GKOIB.21.67.G01.1.454.CMB.1.raw
  modified_base (471)..(471): a, c, t, g, unknown or other
  misc_feature (471)..(471): n is a, c, g, or t
  modified_base (475)..(475): a, c, t, g, unknown or other
  misc_feature (475)..(475): n is a, c, g, or t
  modified_base (486)..(486): a, c, t, g, unknown or other
  misc_feature (486)..(486): n is a, c, g, or t
tcagtcgtcgctcgcacgaccggtgctcgatttagagtatacatattgggtttggggacccaaaaaccacacccctccttgggagattcccctagatcacagccccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttgagtggatggggatgggccgaccttcggcaacgggaaagatgggagtagtggtcaggatttcgaggcagaattaccttgaaccacagactcactccgacgggcacgacgcctacgttaggaactgaggaaccgtgagaagtggacgacgacggccacatatattgngcgnggaggtggggntagtttagtagtacctattactattattcttcgttgtacgttgtgggtacgaaggtccgtacggtcgaccgtctccccgtagtacccg

SEQ ID NO: 235492 - DNA, 570 bp, Homo sapiens
  misc_feature: GYAE6OF02IL7JM.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatcctttttcctggtggcagcagcaacaggtgcccactcccagactcaactggtgcagtctggacctgaggtgaagaagcctggggcctcgggtgaaggtctcctgcagggcctctggttacagtttttccgactatagtatcagttgggtgcgacaggccttggacaagggcttgagtggatgggatgggccgacgttcgcaacggaagatggagtatggtacaggtatttcgaggcagaattacgtagacacagtactacatccgacggcacgagcctacgttagacgtagacggaacgtagagaatggacgacacggccaacgtatattatgtagcgagaggtggggcagttttgagtactactacttattattacttcgttgtacgtcgttgggacgtaaagggtccgacggtacgtaccgtactccctagtacccg

SEQ ID NO: 235493 - DNA, 591 bp, Homo sapiens
  misc_feature: GYAE6OF02HZG6K.21.67.G01.1.454.CMB.1.raw
  modified_base (394)..(394): a, c, t, g, unknown or other
  misc_feature (394)..(394): n is a, c, g, or t
tcagtcgtcgctcgcacgaccggtgctcgatttagagtatacatattgggtttgggggacccaaaaaccaacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagttttccgactatagtatcagttgggtgcgacaggtcccttggacaaggggcttggagtgggatggggatggggccgtaccgttcgacaacggaagatggagtagtggtcagggtaattcgaggcagtaattacttgaccanagactcaatccgacggcacacgcctactaggaactggagtaacctgaagaagtggaacgacacggaccaacattaattgtagtgccgacggaggtcggggactagtttacgtaaggtactacctattagttattactttacgtggtaccgtgtagggtacgaaaggccgtacggtacctaccgtcctcccagtaccc

SEQ ID NO: 235494 - DNA, 588 bp, Homo sapiens
  misc_feature: GYAE6OF02GAPVC.21.67.G01.1.454.CMB.1.raw
  modified_base (452)..(452): a, c, t, g, unknown or other
  misc_feature (452)..(452): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatggggccgaccttcggcaaacgggaaagcgtgggagtagtggtcaggtaatttcgagggcagaattaccttagaccacgagactcatccgagggcacgacgcctactcggaactggacggaactgagagtggacganacggcacatattgtgtgcgacgaggtggggctagtttgagtactactacgtattacttacttacgttggtacgtcgtggggaccgtaagggtacctaccgggtaccgtacccggtccgttaccccgaggtaccccg

SEQ ID NO: 235495 - DNA, 581 bp, Homo sapiens
  misc_feature: GYAE6OF02GPRNB.21.67.G01.1.454.CMB.1.raw
  modified_base (467)..(467): a, c, t, g, unknown or other
  misc_feature (467)..(467): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacgaagggcttgagtggagtgggagtggggccgaccgttcgacgaacggaagagtggagtagtggtacgaggtatttcgaggcagtaattaccttagacacagactcatccgacggcacgagcctacgtgactgagtactgagagtggacgacgacgccacatattatgtgcgngtaggtggggtactagtttgtagtactaactactattacttattcgttggtacgtcgtacgggtacgtaacgggtaccgacggttaccgaccggttcctaccccgtagtacccg

SEQ ID NO: 235496 - DNA, 784 bp, Homo sapiens
  misc_feature: GYAE6OF02FYOZO.21.67.G01.1.454.CMB.1.raw
tcagtcgtcgctcgcacgaccggtgctcgatttagagtatacatattgggtttggggacccaaaaaccacaccccctccttgggagattcccctagatcacacgcccctcacccatggactggacctggagcattcccttttcctgggtggcagcagcaacgaggtcgcccactcccagactcaactggtgcagtctggacctggagggtagaagagccgtggggcctcggtagaaggtcctccgtgcgcgggcctcgtggttactacgtttttccgatatagtatcgtaggttgggtcgcgacgacggtcccgttaggacgaagggtcttaggaggtggagtgggagtcggggccgtaccgttcggacgaaacgggaaagtcgtagggagttagtggtacgtaaggtaagttcggaggacaggttaaacttccgtagaacccagaacgtactacaacgtacccggacggaccaacgacgtacccgtttaacggtacggaaaccgttaggaacggtaaaccgtagggaacggtaaacggtacgggaaccggtaaccggaacccgggaccaaacgtaagtttaacgttttaagttacggtacggaccgggtagggtacggggttacgggggtacttacggttttacggaacgtaaaccgtttaacgttaactttaactttacgtttaccgtttacggtttgggtaaccgttcgggtaacggggtaaccgtaaacgggtccgtaaccgggttaccaaccccggttccctaccccgtacgtaccccg

SEQ ID NO: 235497 - DNA, 717 bp, Homo sapiens
  misc_feature: GYAE6OF02G6UAE.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcgggtgaaggtctccgtgcgagggccttctggttactaggtttttccgactatagtatcgagttgggtgcgacaggtcccttggacaagggtcttggagtggacgtggggagtcggggccgaccgttcggacgtaaaccgggaaagagttagggagttaagtgggtacgaagggtaatttcggagggactaaggtaagtttaccgttacgaaccaacgagtacctactacgtacccggacgggacacgacgtacctaacgtttacggaaacttaggacggaaaccgtaggaacgaacgtagggaaccgaaccgaaccgggcccaaagtacttaacttaagttcggtggaccgacggtagggttcgggggactacggttttagtaacgtaccttaactagttaacttacttttacgttacggttacggtacggtttacgtacggggtactaaacgggaccgtcgggtaccgtacccggtacccttacccgacgtaccccg

SEQ ID NO: 235498 - DNA, 789 bp, Homo sapiens
  misc_feature: GYAE6OF02H9QQE.21.67.G01.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagagtatacatattgggtttggggacccaaaaaccacacccctccttgggagattcccctagatcacagccccctcaccatggactggacctggagcatccttttcctggtggcagcagcaacaggtgcccactcccagactcaactggtgcagtctggacctgaggtgaagaagccgtggggcctcggngaaggtctcctgcgagggcctcgtggttactagtttttccgactatagtatcgtagttggtgcgacaggccttggacgaagggtcttggagtggagtgggagtcgggccgtaccgttcgacgaacggaaagagtaggagtagtggtacgaggtaagtttcggaagggtactaaggtaaacgttaccgttagaaccctaacgaacgtacctacaacgttacccgaccgggacaaccgaacgtacccgttaacgtttacgggtaaaccgttaggaaacgggtaaaccgttaggaacggtaaacgttacgggaaacgaaccgaaccggacccgaacgtaatttaagttaagttacggtacggtaccggtacgggtaggtcgggggtacgttaggttttacggtaacgtaaccgttaaccgttaacgtttaacttttaacgttttaaccgttttacgttacgggttaaccggttacgggtaccggggtaaccggtaaaccggggtaacccgtaaccggggttacccgtaacccccggtttacccgttaccccccgtaccgttaccccccg

SEQ ID NO: 235499 - DNA, 582 bp, Homo sapiens
  misc_feature: GYAE6OF02IY6K1.21.67.G01.1.454.CMB.1.raw
  modified_base (474)..(474): a, c, t, g, unknown or other
  misc_feature (474)..(474): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcgagggcctctggttacagtttttccgactatagtatcagttgggtgcgacaggcccttggacaagggcttgagtggatgggatgggccgaccttcgcaacggaagatggagtatggtcaggaatttcgaggcagaattacttagacacagactacactcgacggcacgagctactggactgagactgacgaatcggactacgacggaccacgagtattagtgtgacgacgaggtcggggntagtttgtacgtactacgtacttagttactttacgttcgttggtacgttcgtaggggaccgtaaagggaccgtacgggtacctaccggtcctaccccgagttaccccg

SEQ ID NO: 235500 - DNA, 684 bp, Homo sapiens
  misc_feature: GYAE6OF02HAT1R.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctcgtggttactagtttttccgacttatagtatctaggttgggtgcgacgaggcccttggacgaggcttgagtggatgggagtgggccgaccgttcggacgaacggaaagagtggagtagtggtacgaaggtatttcgaggcaagtaattaccgtgaccacagactcataccgacggtcacgacgtcctacgtacggaacgtggaacggtaactgaagtaacgtacggaacgaccgaaccggacccgaacgtaattagttaagttggtacgcggacggtagggtcggggtactaacgtttggtaacgtaaccgtaacttaacgttaacgtttaacgtttacgtttcggttaacggttaccggttacgggttacggggtaaccgtaaccggggtaccgtaaccgggttaccgtaccccggttacccgtacccccgacgtacccccg

SEQ ID NO: 235501 - DNA, 554 bp, Homo sapiens
  misc_feature: GYAE6OF02IY0PF.21.67.G01.1.454.CMB.1.raw
  modified_base (445)..(445): a, c, t, g, unknown or other
  misc_feature (445)..(445): n is a, c, g, or t
  modified_base (502)..(502): a, c, t, g, unknown or other
  misc_feature (502)..(502): n is a, c, g, or t
tcagtcgtcgctcgcacgaccggtgctcgatttagagtatacatattgggtttgggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctagggcctcggtgaaggtctcctgcagggcctctggttacagttttccgactataccacgggcacagcctacttggaactgaggacctgagaatggacgacacggccacgatatattgtgcgcgagtgggggctagtttgtagactactactattattacttcttggacgtctggggacaaagggacacgggtcaccgtctcccagcctcacgaacggccatcggtcttccccgngcgccctgcctcaggcgccacctccgagacgccacgacgcggccctgggctcgccgnggtcaaggcctacgttccctcgtctctagtcgacgtcgggctggcaggaccg

SEQ ID NO: 235502 - DNA, 624 bp, Homo sapiens
  misc_feature: GYAE6OF02JH02W.21.67.G01.1.454.CMB.1.raw
  modified_base (526)..(526): a, c, t, g, unknown or other
  misc_feature (526)..(526): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctgggcctcggtgaaggtctctgcagggcctctggttactagtttttccgactataccacgggcacagcctacttggaactgaggacctgagaatggacgacacggccacatattattgtagccgcgagtgggggactagtttggtacgacttactacgttaattatttaacttcttgggtactcgttgggggacaaaggggaccacgggtccaccggtcctccccgagccctacccaccgtaacggggccccagttccggtaccttccccgcggccgtccctgccttcccgaggtacgaccacccgtcccggagacncgaccgacggcccgcccgtgggctcgtccgttcggacgacggtacttccgttccctcgtcctaccgtctcggacggtcggtctcggacgacgggtccg

SEQ ID NO: 235503 - DNA, 594 bp, Homo sapiens
  misc_feature: GYAE6OF02IATKD.21.67.G01.1.454.CMB.1.raw
tcagtcgtcgctcgcacgaccggtgctcgatttagagtatacatattgggtttgggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctctgcagggcctctggttacagtttttccgactatacgtatcagttggtgcgacaggcccttggacaagggcttgagtggatgggatgggccgaccgttcgcaacggaagagtagggagtagtggtcaggtaatttcgaggcagtaattaccttgaccacagactcatccgacgggcaccagcctacttaggaactggacggaactggagaacgtaggacgacgacggaccacgaattattatggtgcgacggtagtggggctagttgtagtactaattacttattattacgttcgttaggtacggttgtagggtacgaacgggtccgtacgggtccgtacccggttctaccccgtagtaccccg

SEQ ID NO: 235504 - DNA, 941 bp, Homo sapiens
  misc_feature: GYAE6OF02I62ZH.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggactgaggtgaagaagccgtgggcctcggtgaaggtctcctgcgagggcctcgtggttacagtttttccgactatagtatcgaggttgggtgcgacaggtcccttggacgaaggggtcttggagtgggagttgggagtcgggccgtaccgttcggaacgaaaccgggaaagaggtacgggaaggttaaggtgggtaccgtaagggtaacgtttcggaacgggtacgtaaacggttaactttaaccggttacgaacccgtaacgtaacggtaaccgtacccgtaacgttaccccggaacggggtacctaaccggtaaccgtacccgtttaaccgggtttacgggaaaaccgttaccgggtaaaacccggtaaccggttagggaaaccggttaaaaggtccggggtaaaacccggaacccgggaaacccggtaccccgttaaacgtaacgttttaaaaccgtttacggtttacggggagggtaaccccggttaccggggtaaggggtttaaccggggggttacctttaaagggttttacggtaaaaccggttaacccgtttaaacggtttaacccgtttaaaggttttacccgttttaacccggttttaccggtttaaacggggttaccggtttaaccggggttaacgggggaaacccggttaaaaaccggggggttaccccctaaaccggggttttaacccctaaccccggggtttacccccgttacccccggtaaccgggtaaccccccgg

SEQ ID NO: 235505 - DNA, 632 bp, Homo sapiens
  misc_feature: GYAE6OF02IBBUZ.21.67.G01.1.454.CMB.1.raw
  modified_base (341)..(341): a, c, t, g, unknown or other
  misc_feature (341)..(341): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcctggggcctcggtgaaggtctctgcagggcctcgtggttactagttttccgactatagtatcgtagttgggtgcgacacggccttggacaagggcttgagtggatgggatgggccgacttcgacaacggaaagngtggagtagtggtcagggtaatttgaggcgagtaacgttaccttgaaccacgaagtctacatccgacgggcaacgacgcctacgttaggaactggaacggtaaccgtagagaaagtgggtaacgacgaaccggaccaacgattaagttattacgtgtcggacggtagtcgggggacttagtttagtagtactacgtaacttagttacttacgtttcgttggtacgttcggtacggggtacgtaacgggtaccgtacggtaccgtacccggtacgtacccccgagtaccccg

SEQ ID NO: 235506 - DNA, 610 bp, Homo sapiens
  misc_feature: GYAE6OF02HBEEB.21.67.G01.1.454.CMB.1.raw
  modified_base (480)..(480): a, c, t, g, unknown or other
  misc_feature (480)..(480): n is a, c, g, or t
  modified_base (593)..(593): a, c, t, g, unknown or other
  misc_feature (593)..(593): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctcgtggttacagtttttccgactataccacgggcacagcctacttggaactgaggaacctgagaatggacgacacggccacatattattgtgcgcgagtgggggcatttgtagactatactattattacttcttggacgtctggggacaaagggaccaggtccaccgtctccccagcctaccaccgaacggcccatccggtccttcccccgtggcccgcccgttcgccttcccgaggacnccaccctccgaacgacgccaccgacggccgcccgtgggccttcgccgttcggtacgaacgggaccttaaccgttcccctcggtccttccgttacgtcggacgtccggggtacncgggtaccgaggtccgg

SEQ ID NO: 235507 - DNA, 567 bp, Homo sapiens
  misc_feature: GYAE6OF02GJFE6.21.67.G01.1.454.CMB.1.raw
  modified_base (389)..(389): a, c, t, g, unknown or other
  misc_feature (389)..(389): n is a, c, g, or t
  modified_base (458)..(458): a, c, t, g, unknown or other
  misc_feature (458)..(458): n is a, c, g, or t
  modified_base (462)..(462): a, c, t, g, unknown or other
  misc_feature (462)..(462): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttgagtggatgggatggggccgaccttcgcaacggaagagtggagtatggtcaggaatttcgagggcagtaattaccgttagaccanagactcatccgacgggcacacgcctactggaactgaggactgagatggacgacgacgccacatatatgngcgngaggtggggctagtttgtagacttactacttattattacttcgttagtacgttcgtagggtcgaaagggacctacggtccgtaccgtcctaccccgagtaccccg

SEQ ID NO: 235508 - DNA, 634 bp, Homo sapiens
  misc_feature: GYAE6OF02GOCQI.21.67.G01.1.454.CMB.1.raw
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactataccgacgggcacagcctacttggaactgaaggaacctgagaagtggacgacgacggccacatattattgtgcgcgaggtgggggctatttgtagactactactattattacttcttggacgtcgtgggacaaacgggccacggtcaccgtcctccccacgtccctccaaccgaacggcccacgtccggtcccttcccccgtcggcccgcccgtcgcctccgacggacgccaccgtccgagacgaccacgacgccggcccgtgggcctcggcccgttagggtaccgaacgggtacccttaacccgtttccccgtccgttaccgttaccgtacgtcggacggtccgggacgtcgggaccgacgggtccg

SEQ ID NO: 235509 - DNA, 559 bp, Homo sapiens
  misc_feature: GYAE6OF02FSOOQ.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgaggaacctgagaatggacgacacggccacatattaattgtgcgcgagtggggggcatttgtagactactactattattacttcttggacgtctggggcaaaagggaccacgggtcacccgtctccccagccctccaccaagggccccatcggtcttccccctggccgccctgcctcccaggacgcacctccgagacgcacagcggccctgggctgcctggtcaaggactactccctcgtcctctacgtcgagccgggctcggcaggcg

SEQ ID NO: 235510 - DNA, 670 bp, Homo sapiens
  misc_feature: GYAE6OF02I3NWY.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctgacctgaggtgaagaagcctggggcctcgggtgaaggtctccgtgcgagggtcctgtggttaccaggtttttccgactagtaccgacgggcacagcctacttggaactgaacgacctgagatggacgacacggacacgatatatgtgcgcgaggtgggcagtttgagactactatagttattacttctaggtacgtgtgggtactaacgggcaacggtcaccgtctcccgaagtccctaccgaccgaacgggccctaggtccgtccgttccccgtcggaccgtccgttacggcctacccgacggtaccgtcccaaccgtccggaacgttacggccgaaccgtaacgggtccggaccccgttaggggcttacccgggtcgttaaccggtaccgaaacgggttaccgtccccgttaccgtccggttacctacccggttacttacgggaccggcggttaccgggtacggtacgggaacgtccgg

SEQ ID NO: 235511 - DNA, 414 bp, Homo sapiens
  misc_feature: GYAE6OF02HBUBP.21.67.G01.1.454.CMB.1.raw
  modified_base (400)..(401): a, c, t, g, unknown or other
  misc_feature (400)..(401): n is a, c, g, or t
  modified_base (403)..(414): a, c, t, g, unknown or other
  misc_feature (403)..(414): n is a, c, g, or t
tcagtcgtcgctcgcacgaccggtgctcgatttagagtatacatattgggtttggggagtatggtcaggaatttcagggcagaattaccttgaccacagactcatccacgggcacagcctacttggaactgaggaacctgagaatggacgacacggccacatattattgtgcgcgagtgggggcatttgtagactactactattattacttcttggacgtctggggcaaagggaccacggtcaccgtctccccagcctccaccaagggcccatcgtcttcccctcggcgccctgctccaggacgcaccctccgagacgcacagccggcccgtgggctcgcctggtcaaggactacttcccggagcgacgactgaggcgggctggcaagggcgacagtagnngnnnnnnnnnnnn

SEQ ID NO: 235512 - DNA, 407 bp, Homo sapiens
  misc_feature: GYAE6OF02G53G2.21.67.G01.1.454.CMB.1.raw
  modified_base (291)..(291): a, c, t, g, unknown or other
  misc_feature (291)..(291): n is a, c, g, or t
  modified_base (305)..(305): a, c, t, g, unknown or other
  misc_feature (305)..(305): n is a, c, g, or t
  modified_base (317)..(317): a, c, t, g, unknown or other
  misc_feature (317)..(317): n is a, c, g, or t
  modified_base (369)..(369): a, c, t, g, unknown or other
  misc_feature (369)..(369): n is a, c, g, or t
  modified_base (393)..(407): a, c, t, g, unknown or other
  misc_feature (393)..(407): n is a, c, g, or t
tcagtcgtcgctcgcacgaccggtgctcgatttagagtatacatattgggtttggggagtatggtcaggaatttcagggcagaattaccttgaccacagactcatccacgggcacagcctacttggaactgaggaacctgagaatggacgacacggccacatattattgtgcgcgagtgggggcatttgtagactactactattattacttcttggacgtctggggcaaagggaccacggtcaccgtctccccagccctccaccaaggcccatccggtcttcccctggccnccctgcctccaggncaccctccgagngcacagccggccctgggctgccgtggcaaggcctacttcccgagcgacgacngacgcggctggcaaggcgcatagnnnnnnnnnnnnnnn

SEQ ID NO: 235513 - DNA, 813 bp, Homo sapiens
  misc_feature: GYAE6OF02FVQN7.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctcgtggttactagtttttccgactatagtatcagttgggtgcgacaggcccttggacaagggtcttggagtggagtaggggatgggccgtaccgttcggacgaaacgggaagagtaggaggtatgggtacgaggtaactttcggagggacagtaacttaccttagacccgtaacgacgaacgtcacgtacccgacgggacgaacgtacgtacccttaacgttacggtaacgtagggtaacggtaacccgtaggaaagtaacgtacgggaaccgaaccggaacccgggacccaaacgtaattaacgtttaagtttagggacggtacgggacgggtaacggggttcggggggtaccgttaaggtttttacggtaacgttaaaccgttaccgtttaaaccgtttaagtttttaacgttttaaccgttttccgggttttaacggggttaacccggttttaccggggttaacggggggtaaacccggttaaacccgggggaaccccggttaaccggggttaaccccgtaccccggtttaacccccggttcccccccggtaacggttaaccccccccgg

SEQ ID NO: 235514 - DNA, 568 bp, Homo sapiens
  misc_feature: GYAE6OF02FWPUN.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgaggaacctgagaatggacgacacggccacatattattgtgcgcgagtgggggcatttgtagactactactattattacttcttggacgtctggggcaaaggggaccacgggtcaccgtctcccagcctccaccaagggcccatcggtcttcccctggccgccctgctccaggcgcacctccgagacgcaccagccggccctgggcctgccctggtcaaggaccttaacttccccgtcgttccttcctaccgtgacggccgggtctcgggcagggccg

SEQ ID NO: 235515 - DNA, 751 bp, Homo sapiens
  misc_feature: GYAE6OF02JAIDI.21.67.G01.1.454.CMB.1.raw
  modified_base (352)..(352): a, c, t, g, unknown or other
  misc_feature (352)..(352): n is a, c, g, or t
tcagtcgtcgctcgcacgaccggtgctcgatttagagtatacatattgggtttgggggacccaaaaaccacacccctcccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctgtggttactagtttttccgactataccgacgggcacacgcctacgttggaacctgaggaacctgagaagtggacgaacgtacgccagatattattgtgcggcgtaggnggggtatagtttaggagtacgtactaacgtattactttacttcttggtactcgtgggacaaagggcccgtacggtcctaccgtctacccgacgtcccgtacctacccgaacgggtaccctacgttccggtacccgttcccccgttacggcccggtaccccgtccggtacccgtcccgtaaccgggtaacgcccggtaaccccgtcccggtaacggtaacccggacctaaccggaacccggtcccgggtacccccggttcgggtacccgtccgggtcccgttaccggggttaccgaacccggtaccgttaacccgtttaccccgttcggtttaacccgttcccgttaacgtccggtaaccgggtccgggtaccggtaccgggtaccgaaccgggtcccgg

SEQ ID NO: 235516 - DNA, 677 bp, Homo sapiens
  misc_feature: GYAE6OF02H87FN.21.67.G01.1.454.CMB.1.raw
  modified_base (324)..(324): a, c, t, g, unknown or other
  misc_feature (324)..(324): n is a, c, g, or t
  modified_base (377)..(377): a, c, t, g, unknown or other
  misc_feature (377)..(377): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggctcgtggttacagtttttccgactataccacgggccacacgcctacgttggaactgaggaaccgtgagaatggacgacgacgccanatatattgtgcgcgaggtggggctagttgtagactactacgtattattacttnttggacgttcgtggggctaaacgggacctacgggtctaccggtcaccccagccctaccgaccgaacggcccaacgttccgtccgttcccccgtggcccgtccccttagcccgttacgacggtacgggacctacccgtcccggaacggtacgacccgaacgtaccgggcccgtccccgtacggggtctaccgggcccgttcgggttacccgaacggttacccgttaacccgtttccccgtccgttacccgttaccgtaacgtcggaccggtccgggccttaccggaccggtacggtcccgg

SEQ ID NO: 235517 - DNA, 779 bp, Homo sapiens
  misc_feature: GYAE6OF02GWUWE.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttgagtggatgggatgggccgacttcgcaacggaagatggagtatggtcaggtaatttcgaggctaaggtaattaccgttgaaccacgagtacctcgaactcccggacgggacctaacgacgtaccgtacgttacggaaaccgtacggaacgggtaacctaggaacggtaaagtacgggaaccgaaccggtaaccgggacccgtaaccgtaacgttaacgtttacgtttagggttacggtaccgggtacgggtacgggtacgggggggtacttaacggtttttacgggttaaacggtaaacccgttaaacgtttaacccgttaagttttaaccgttttaaccgttttaccgtttacggggttaacccggtttacgggttaacgggggttaaccggtaaaccgggggtaacccgtacccggggtttaacccgtaacccggtttaccccggttacccccgtaaccgggtaaccccccgg

SEQ ID NO: 235518 - DNA, 551 bp, Homo sapiens
  misc_feature: GYAE6OF02I1HI8.21.67.G01.1.454.CMB.1.raw
  modified_base (251)..(251): a, c, t, g, unknown or other
  misc_feature (251)..(251): n is a, c, g, or t
  modified_base (453)..(453): a, c, t, g, unknown or other
  misc_feature (453)..(453): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcgggtgaaggtctcctgcagggcctctggttacngtttttccgactatagtatcagttggggtgcgacaggcccttggacaaggggcttgagtggatgggatgggccgaccttcgcaacggaagatggagtatggtcaggaatttcgaggcagaattaccttgaccacagactcatccacggacacagcctactggaactggagaactgagaatggacacacggcacatatatgtncgcgaggtggggctagttgtagactagtacttatattacttcgttaggcgttgtggggtacaaagggtccacggtaccacgtccgtcccagtaccccg

SEQ ID NO: 235519 - DNA, 724 bp, Homo sapiens
  misc_feature: GYAE6OF02IRDFB.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcgacgggcctcgtgggttactgtttttaccgacttagtagtatcaggttgggtgcgacgaggcccttggacaagggcttgagtggatgggatgggccgaccgttcgctaaacggaaagacgtaggagttaacgtggtcgaaggtaactttacggagggtactaaggaatttaccgttaggaccctaacgaggtacctcgtacgtccgacgggacctacgagtacccttaacgttacgggaaacgtggacggtaaccgtggaaaggaagtcgggaaacgacggaaccggacctaacgtaattaacgtttatcggtagacggtacggtaaggtcgggggaacgtttagtttagggtaacgtacgtaacgttacttaagtttacgtttacgtttacgtttaacgggaaccttcggttacggggaaccggtaaagggtacccgttaacggtacccggttacccgtaccgttacccccggacggttaacccccg

SEQ ID NO: 235520 - DNA, 667 bp, Homo sapiens
  misc_feature: GYAE6OF02GGCR3.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctggtgaaggtctcctgcagggcctctggttacagtttttccgactatagtatcagttgggtgcgacaggcccttggacaagggcttgagtggatgggatgggccgaccgttcggcaacggaaagactaggagtagtggtacaggaatttcgagggcagaattaccgtagacctacagactacatccgacgggcctaacacgtcccgtaacgttcggaacgtacggtaacggaacccgtaggaacgtaaagtgggaaccgaacgtaccggacccaacgtaattaattatttaggtacgtcggtacggtaggtcgggggactagtttgtaacgtaacgttacttaaccgttatttacttactttcgtttacgggtacgttacggtacggggtaccgtaaacgggtaccgtaccgggttaccgtaccccggtcctacccccgtaggtacccccg

SEQ ID NO: 235521 - DNA, 916 bp, Homo sapiens
  misc_feature: GYAE6OF02HENBB.21.67.G01.1.454.CMB.1.raw
  modified_base (909)..(909): a, c, t, g, unknown or other
  misc_feature (909)..(909): n is a, c, g, or t
tcagtcgtcgctcgcacgaccggtgctcgatttagagtatacatattgggtttggggacccaaaaaccacacccctccttgggagattcccctagatcacacgcccctcaccatggactggacctggagctacttccttttccgtgggtggacgagcaagacaaacgacgggtccgaccccaacctaccccaaggtaacctacgtaacgttgggtcgacgtacggtcgtacgggaccgtagggaagggtagaaacggacggtccgggtcggggtccgttacgggtacggtaaccggttccttccggtacgggaccggtaccgggttccctttacggttaacgggttttaaccgtttaccggttttaccgaagttaagttaacggttacgttacggttaggggtttacgggaccgtaaccgggtaaccggtaccgggttaccgttaacgggaacggtaagggttcgttagggaagggtgggtacgggtacgggtacggtaccgggtacccgtacggtaacggaacggaaaggtaagtggtaggtaggtacggttaggtaacggtaggtaacgtacggaacggtagtaacgttacgtacgtacgacaagtaccgtacaccgacgtacgggaccacgtacgtaaccgttacgtacgtaacggaacgtaacggaaacgagggtaacagggtacgacggtacgaaccacggtaattagtagtttagtacgggccgagggaccgggttagggtacggtaaggtttaccttaagaacgttacgttaacttaaccgtttagttcccggttttaagtccgggtacggggttaacgacgggttaacgggggaacccgttaaacccgggacgttaccccgtccgggtaaccccttacccgggtaccctacccgggtaaancccccgg

SEQ ID NO: 235522 - DNA, 606 bp, Homo sapiens
  misc_feature: GYAE6OF02IC0QY.21.67.G01.1.454.CMB.1.raw
  modified_base (310)..(310): a, c, t, g, unknown or other
  misc_feature (310)..(310): n is a, c, g, or t
  modified_base (466)..(466): a, c, t, g, unknown or other
  misc_feature (466)..(466): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagttttccgactataccacgggcacagctacttggaactgaggaacctgagaatggacganacggccacatatatgtgcgcgagtgggggcagtttgtagactactactattattacttctggtacgtctggggacaaagggtaccaggtccaccgtcctcccagcctccaccaagggcccatcggtctacccctggccgcccttgcctaccagganccgacctcgagacgcacgacggccggaccctggggacctcggacctgggtaccaacgggtaccttaccgtttcccgtacggttcccttaccgttaacctacggacggtccggggtacgttcgggaccgaagggtacccgg

SEQ ID NO: 235523 - DNA, 571 bp, Homo sapiens
  misc_feature: GYAE6OF02FR23W.21.67.G01.1.454.CMB.1.raw
  modified_base (438)..(438): a, c, t, g, unknown or other
  misc_feature (438)..(438): n is a, c, g, or t
  modified_base (444)..(444): a, c, t, g, unknown or other
  misc_feature (444)..(444): n is a, c, g, or t
  modified_base (471)..(471): a, c, t, g, unknown or other
  misc_feature (471)..(471): n is a, c, g, or t
  modified_base (481)..(481): a, c, t, g, unknown or other
  misc_feature (481)..(481): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctcgtggttacagtttttccgactatagtatcagttgggtgcgacaggcccttggacaagggcttgagtggagtgggatggggccgaccttcgacgaacggaaagagtggtagtagttggtcaaggtaatttcgagggtacagtaattaccgttagaccagagactcatccacggcacagcctactgactgaggaaccngaaganggacgacacgccacatattatgtgcgngaggtggggntgttagtagtacttactattattattacttcgttggacgttcgtagggtacgaagggacctacgggtaccaccgtacctcccgagtcccg

SEQ ID NO: 235524 - DNA, 607 bp, Homo sapiens
  misc_feature: GYAE6OF02H4KEN.21.67.G01.1.454.CMB.1.raw
  modified_base (248)..(248): a, c, t, g, unknown or other
  misc_feature (248)..(248): n is a, c, g, or t
  modified_base (271)..(271): a, c, t, g, unknown or other
  misc_feature (271)..(271): n is a, c, g, or t
  modified_base (448)..(448): a, c, t, g, unknown or other
  misc_feature (448)..(448): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgagaagcctggggcctcggtgaaggtctctgcagggcctctggttacncgttttcgactataccaggcacngcctacttgactgagacctgagaatggacacacggcacgatatattgtgcgcgagtgggggctagtttgtagactactactattattacttcttggacgtgtaggggcaaaagggccacggttcaccgtctcccagcctcccaaccgaacgggcccctagtccggtccttcccccgnggccgtccccgtgccctccgaggcgccacctccgagacgtcacgacgccggtccctgggctcggccgtgggtacgtaaccgggaccttaacccgtttcccgtacgtcccgttacgtaccttacgggacggtcccgggcgttacgggccgaaggtcccgg

SEQ ID NO: 235525 - DNA, 605 bp, Homo sapiens
  misc_feature: GYAE6OF02GV4UV.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggagtgggccgaccgttcgacaacggaaagagtaggagtagtgggtcaaggaatttcgagggtcaagtaattaccgttgacacgagactcatccgacggcacgacgcctacgtggaacgtagacgaacgtgagagtggacgacgacgaccacatattagttgtgcggacgaggtggggtctagttagtagtacgtaacgtacttattactttatttcgttaggtaccgttggtacgggtacgtaaagggacccgtacgggtccgtacccggttacctaccccgacgtaccccg

SEQ ID NO: 235526 - DNA, 575 bp, Homo sapiens
  misc_feature: GYAE6OF02JF8I5.21.67.G01.1.454.CMB.1.raw
  modified_base (392)..(392): a, c, t, g, unknown or other
  misc_feature (392)..(392): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccgaccttcggcaacggaaagatgggagtagtggtcaggaatttcgagggcagaattacttgaccacagactnactccacgggcacacgcctactggaactgaggaactgagatggacgacacgcacatattatgtgcgacgaggtaggggctagtttgtagtactacgtactattatttacttcgttggtacgttcgtcgggtacgtaaacgggaccgtacggttaccgtacccggtcctaccccgagtaccccg

SEQ ID NO: 235527 - DNA, 665 bp, Homo sapiens
  misc_feature: GYAE6OF02H5C96.21.67.G01.1.454.CMB.1.raw
  modified_base (250)..(250): a, c, t, g, unknown or other
  misc_feature (250)..(250): n is a, c, g, or t
  modified_base (267)..(267): a, c, t, g, unknown or other
  misc_feature (267)..(267): n is a, c, g, or t
  modified_base (510)..(510): a, c, t, g, unknown or other
  misc_feature (510)..(510): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacngtttttcgactatagtntcgagttggggtgtcgacagggtccccttggaacaagggtcttggagtggatcggggatggggccgacttcggcaacggaagattgggagtatgggtacagggtaattcgagggcaggtaattaccgttggaaccagaagaccttcaattccgaacgggtcaaccgacgaccttacgttggaactaggacgtaaccgtgaagaagtcggaacgtacgaccggaccaagattaactagttacgngaccggtacgagggtacggggcgttaagtttggtaacgtacgttaacttacgttatttaacgttacgttcgtttaggtaccgttacggtcggggtaacgtaaaggggtaccgaaccgggttccgtaaccccggtcgttacccccgaaggtccccc

SEQ ID NO: 235528 - DNA, 813 bp, Homo sapiens
  misc_feature: GYAE6OF02G1ICG.21.67.G01.1.454.CMB.1.raw
  modified_base (280)..(280): a, c, t, g, unknown or other
  misc_feature (280)..(280): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctcgtggttacagtttttccgactatagtatcagttgggtncgacaggcccttggacaagggcttgagtggatgggatgggccgaccttcgcgaacggaagatggagtatggtcaggtaatttgagggcaggaattaccgttagaccacgagactcactacccgacgggtccaacgacgtacccttacgttacggaaacgtacggaacggtaaacccgttaggaaacggtaaagtacgggaacccggtaaaccgtaacccgggaccccgaaacgtaaacgtttaaacgttttaagtttacggttaacgggtacccgggtaccgggtaacgggggttccggggggggtaaccttttaacgggtttttaacgggtttaaaccggttaaacccgtttaaaccgtttaaccgtttaaacgtttttaacgttttaaccgttttaccggttttaacggggtaaccggttttaccgggttacggggggtaacccgtaaaacgggggtaaccccgttaacccggggttacccgttaacccccgggtttacccgttaccccccggtaacggttacccccccgg

SEQ ID NO: 235529 - DNA, 707 bp, Homo sapiens
  misc_feature: GYAE6OF02GZHJ1.21.67.G01.1.454.CMB.1.raw
  modified_base (288)..(288): a, c, t, g, unknown or other
  misc_feature (288)..(288): n is a, c, g, or t
tcagtcgtcgctcgcacgaccggtgctcgatttagagtatacatattgggtttgggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgacgggcctcgtggttactaggtttttccgacttatagtatcaggttgggtncgacacggcccgttggacgaagggcttggaggtggagtgggagtcggggccgtaccgttcggaccgtaaacgggaaacgagtagggacggtagtcggggtacgaagggttaactttccggaagggctaaggttaaactttacccgttacgaaccgtacgaacggtacctacgtaacgttacccggaaccggggacctaacgacgacccgttaacggttacgggtaaacgtacggaacggaacccgttaggaacggtaacgtacggacgacgaccggaccgaacgtattattacgttcgtcgcggtacggaggtggggtagttagttgtagtactaagtacttattattacgttcgtaggtaccgtggtcgggaacgtaacggtaccgtacggtactaccgtccctaccctcggtacccg

SEQ ID NO: 235530 - DNA, 706 bp, Homo sapiens
  misc_feature: GYAE6OF02I7S1Y.21.67.G01.1.454.CMB.1.raw
  modified_base (281)..(281): a, c, t, g, unknown or other
  misc_feature (281)..(281): n is a, c, g, or t
  modified_base (358)..(358): a, c, t, g, unknown or other
  misc_feature (358)..(358): n is a, c, g, or t
tcagtcgtcgctcgcacgaccggtgctcgatttagagtatacatattggggtttggggacccgaaaaccacacccctccttgggagattcccctagatcacagcccctcaccatgggactggacctggagcagtccttttcctggtggcagcagcaacaggtgcccactcccagactcaactggtgcagtctggacctgaggtgagagcctggggcctcggtgaagggtctcctgcagggcctctggttacagtttttccgactatagtatcagttgggtncgtactaggtcccttaggaccgaaagggtccttagaggtaggagtggggatggggccgaccttcggcaacggaaagntggagtagtggtacagggtaatttcgagggcaaggtaattaccgtggaccacgagactcacgtccacgggtcacacgcctacgttggaactagtacggtaaccgtagaaggtaacgtacgggacgaacgtaaccgggacccaaccgtaattaacgtttacgttacggttacggaccggtaccggaagggttcggggggtacctacggttttcgtaacggtaaccttaacggtaaccttaagttacgtttaacgttcgtttacgggtaccggttacggttaacggggtaccgtaaaggggtacccgaccgggttacctaacccggttacctaccccgtacggtaccccg

SEQ ID NO: 235531 - DNA, 613 bp, Homo sapiens
  misc_feature: GYAE6OF02HBXHJ.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagttttccgactatagtatcagttgggtgcgacaggcccttggacaagggcttgagtggatgggatgggccgaccgttcgacgaaccggaaagagtagggagtaagtggtacaaggaatttcgagggcagaattaccttagacacagactacatccacgggcaacgacgcctacgttggaactggacggaaaccttggaagaagtagggaacgtaccgaacggacccaacaatattatgtgcgacgaggtggggactagtttcgtaaggtacttacgtaacttattagttactttcgttggtacgttcgtagggtacgtaaacgggacctacgggtaccgtaccgtaccgtcccgagtaccccg

SEQ ID NO: 235532 - DNA, 867 bp, Homo sapiens
  misc_feature: GYAE6OF02H19V5.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcgacgggcctcgttcggttactacgtttttccgacttagtacgtatcgtaggtttgggtgcgacgacggtccccgttggaccgtaaggggcttggaggttcggagtggggagtcggggccgtaccgtttacgcgtaaaccggaaaggtacgtgggtacgtagttagggtaccgtagggtaaacttttcggaaggggtccgtaaaggttaaacgtttaccgtttacggaaaccctaacgtaacggtaacctaccgtaacgtaccccgaaccgggtaacaacccgtacggtacccttaacgttacggtaaaccgttagggaaccggtaaaccgtcggaaaggtaacgtcgggaaacgaaccgtaccggtaacccaactaagttaactttaagttcggttaacggtccggtaaccggtaacggggttacggggggttacttaacggtttttacgggtaaccgtaaacgttaaaccgtttaaccttttaagttttaacgttttaaccgtttttacggttaacggggttaccgggtttacggttaacgggggtaaccgtaaacgggggtaacccgttaacccggggtttaccgtaacccccgggttttaccctaccccccggtaggttacccccccg

SEQ ID NO: 235533 - DNA, 900 bp, Homo sapiens
  misc_feature: GYAE6OF02IEZLC.21.67.G01.1.454.CMB.1.raw
tcagtcgtcgctcgcacgaccggtgctcgatttagagtatacatattgggtttgggggacccaaaaaccacacccctccttgggagattcccctagatcacagcccctcaccatggactggacctggagcatcctttcctggtggcagcagcaacaggtgcccactcccagactcaactggtgcagtctggacctgaggtgaagagccgtggggcctcggtgaaggtctctgcgagggctcgtggttacacgttttccgactatagtatcgtaggttgggtgaccgtacgtacggtcccgttagggaacgtaaggggtaccttggtaaggtcgggtaacgttagggggacgtccggggtacccggtaccgttaccggtaccgaaaacgggtaaacggtaacggttcgggtaaggttaacgttcggggtaacgtaagggtaacttttaccgggaacgggtacgtaaacggttaacgtttaacccggttacggtaaacccgtaacgtaacgtaccgtacgtaaccgttacccgggaccggggtaactaacccggtaaccggttccgttaaacggttaccggggtaacctaacggggtaaccggttaaacccggtacgtaaggtaaaccggttagggaacccggttaaccgaccgggtacccttaacgtaacgttaaacgttacgttacgggtacggtaccggtacggttaacggggtccgggggttactaacgggttttacggtaaaccggtaaccgtttaaccggttaaccctttaaggtttaacgtttaccggttttacgtaaccggttaaccggttcggtaaccggggttaaccgtaaaccggggtaccttaaccgggtcccgttaaccggtaccccttaccccggtactaacccccgg

SEQ ID NO: 235534 - DNA, 714 bp, Homo sapiens
  misc_feature: GYAE6OF02HT4YT.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttgagtggatgggatgggccgacttcggcaacggaagatggagtagtggtacaggtaatttcgaggcaagaattaccgttgaacccacgagtactcagtccacgggcacgagccttacgttacggaactggaacggaccgtagaagaacgtaggaacgaaccgaccgggaccaacgtaataagttatttaggtgccggtacggaagggtcggggggtacctaaggttttacggtaaggtaccgttaaacgttaacccgttaagttttacgttttaaccgttttacgtttcgggttaaccggtttacgggttacgggggtaaccgtaaaacgggggtaacccccggtaaccggggtttacccggtaaccccgggtttaccccgttaccccccggtaacggttaacccccccgg

SEQ ID NO: 235535 - DNA, 816 bp, Homo sapiens
  misc_feature: GYAE6OF02H00A7.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtgggcctcggtgaaggtctccgtgcagggcctcgtggttactacgtttttccgactatagtatcaggttggtgtcgacgacggtcccttggacgaacgggtcttaggaggtcggaatggggagtcgggtaccggaccgtttccggacgaaacggaaaaggacgtagggaacgttagttaggtaccgtaaggtaaacgttttcggaacgggtactaacggtaaacgtttaaccgttacgaaccctaaacgtaacggtaccctaacgtaaacgtccccggaaacgggtaccgtaacccgaacggtacccttaacggtttaacgggaaaccgttaacggaaacgggtaaacccgttaaggaaaccggtaaagttaacggggaaccgaaccgaaaccgggcccaaacgttaagttaacgtttaagttacggtcgtaccggtacggtacggggtacgggggttactaaggttttaggtaacgtacttaaaccgttaacttaagtttacttaaccgtttacgttacggtaccggttcggtaacggggtaacgtaacgggtacctacgggttaccgtaccccggtttaacccgtccccgaaccgttaaccccg

SEQ ID NO: 235536 - DNA, 600 bp, Homo sapiens
  misc_feature: GYAE6OF02I47T3.21.67.G01.1.454.CMB.1.raw
  modified_base (450)..(450): a, c, t, g, unknown or other
  misc_feature (450)..(450): n is a, c, g, or t
  modified_base (472)..(472): a, c, t, g, unknown or other
  misc_feature (472)..(472): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctggcagggcctctggttacagtttttccgactataccacgggcacagcctacttggaactgaggaacctgagaatggacgacacggccacatattatgtgcgcgagtgggggcatttgtagactacgtactattattacttcttggacgtcgtgggcaaagggaccacggtcaccgtctcccgagcctcccaccagggccctagtcgtaccttccccgnggccgcccgtgtcctccaggcnccgaccgtaccgagacgcacgcgcggcccgtgggcctcgaccgttggtaccaaggtacctaccgtttacccctcggtcccttccgttacgtccggacggtccgggtaccgtcgggtcgacggtacccg

SEQ ID NO: 235537 - DNA, 594 bp, Homo sapiens
  misc_feature: GYAE6OF02HNHTN.21.67.G01.1.454.CMB.1.raw
  modified_base (277)..(277): a, c, t, g, unknown or other
  misc_feature (277)..(277): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctcgtggttacagtttttccgactataccacgggcacncgcctactggactgagacctgagatggacacacgccacatatatgtgcgcgagtggggctagttgagactactactagttattacttctggacgtgtgggacaaagggaccctacggtcctaccggtcctacccgagccctccaccgaacggccacgtcgtcccttccccgcggtcccgcctcgcctccggacgcgccaccgtccgacggacgaccgacgacggccggcccgtgggcctcgccgtcggtacaacggtacctacccgttcccgtcgtacctcgtaccgtcggacggtccggtcgtcggacgaggtccg

SEQ ID NO: 235538 - DNA, 604 bp, Homo sapiens
  misc_feature: GYAE6OF02GM1A4.21.67.G01.1.454.CMB.1.raw
  modified_base (343)..(343): a, c, t, g, unknown or other
  misc_feature (343)..(343): n is a, c, g, or t
  modified_base (351)..(351): a, c, t, g, unknown or other
  misc_feature (351)..(351): n is a, c, g, or t
  modified_base (466)..(466): a, c, t, g, unknown or other
  misc_feature (466)..(466): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactataccacgggcacagcctacttggaactgagaacctgagaatggacgacacggccacatattattgtgcgcgaggtggggntatttganactaactactattatttacttcttggacgttcgtggggactaaaggggacccacgggtcacccggtctccccgagccctccaaccgaacgggcccagttccggtaccttccccgnggcccgtccctcgcctaccgcgacgccacctccgagcaccgaccgacgcccggccgtcgggcctacggccctagggaccaagggccttaaccgttcccctcgtctcccgtagtcgaggtccggctcggacgaggtccg

SEQ ID NO: 235539 - DNA, 592 bp, Homo sapiens
  misc_feature: GYAE6OF02JY8JE.21.67.G01.1.454.CMB.1.raw
  modified_base (481)..(481): a, c, t, g, unknown or other
  misc_feature (481)..(481): n is a, c, g, or t
  modified_base (501)..(501): a, c, t, g, unknown or other
  misc_feature (501)..(501): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctcgtggttacagtttttccgactatagtatcagttagggtgcgacaggccgttggacaagggcttcgagtgagtgggatgggccgaccgttcgcaacggaaagagtggagtatggtcaggattttcgaggtacgagaattaccgttgaccacgagactcgaactcgaccggacacgacgaccttacgtaggtaacgtgacggaacttagacgaagtacgacgacgacgcacattactatgngcgacgtaggtcgggtacgngtttagtagactacgtacttattattacttcgttagtacgttgtcgggagtaacggacgtacggtccgtaccgtctcccgacgtaaccccg

SEQ ID NO: 235540 - DNA, 627 bp, Homo sapiens
  misc_feature: GYAE6OF02I9SCR.21.67.G01.1.454.CMB.1.raw
  modified_base (250)..(250): a, c, t, g, unknown or other
  misc_feature (250)..(250): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctctgcagggcctcgtggttacngttttccgactatagtatcagttggtgcgacaggcccttggacgaagggcttggagtggaagtggggagtgggccgaccgttcggacgaacggaaggactgggagtagtggacgaaggtaattcgaggcagaattaccgttgacacagactcgactcgacggacaacgacgcctacgtcgaacgtgaacggactagagaagtaggacgacgacgaccgactagtattagttggtagcgtacggaggtagggggtacttagtttagtacgacgttaacgtacgttattagtttacgttcgtttcgggtaaccttggttacgggaacgtaacgggtaccgaacggtccgtaacccggtcccttacccgaccgtaccccg

SEQ ID NO: 235541 - DNA, 823 bp, Homo sapiens
  misc_feature: GYAE6OF02HHFM4.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctcgtggttactagtttttccgactatagtatcagttgggtgcgacaggccttggacagggcttgagtggagtgggagtcgggccgaccttcggccaacgggaagaagtagggagtaacgtgggtacgagggtaattttcggaacgggtacaacggtaaactttacccgtttacggaaccgtaaccgtaaggtaaccttaccaacgttcccgaacggggtccaacgaaccgtacccttacgtttacggtaaaccgttaggaaccgggtaaaccctagggtaacggtaaagtacgggtaaccggaaccgtaacccgggaccctaaccgtaagttaacgttttacgtttacgggttaacggtaccgacgggttaacgggtcggggggtaaccttagggtttttaacgtaacggtttaaaccgtaacctttaaccgttttaagtttaccgttttaaccgttttacggtttaaccgggtacggttacgggtttaccgggggaaccggtaaaacgggggttaccccgtaaccggggtttacccctaccccgggtttaccccttaccccccggaaccgtttaccccccgg

SEQ ID NO: 235542 - DNA, 655 bp, Homo sapiens
  misc_feature: GYAE6OF02HR9JW.21.67.G01.1.454.CMB.1.raw
tcagtcgtcgctcgcacgaccggtgctcgatttagagtatacatattgggtttgggggacccaaaaaccacacccctccttgggagattcccctagatcacagcccctcaccatggactggacctggagcatccttttcctggtggcagcagcaacaggtgcccactcccagactcaactggtgcagtctggacctggaggtgaagaagccgtggggcctcggtagaaggtctcctgcgagggcctctggttactacgtttttccgactatagtactcgagttgggtgcgacaggtcccttggacgaagggtcttggagtggagtgggagtgggccgaccttcgacgaacggaagatggagtatggtacaggagttcgaggcagaattacttgaccacagactcgactccgacggcacgacgtactacgtaggaacctgaacggactagaagatacggacgacgacggaccacgattaagttacgtagtcgacggacggtaggtacgggggactaggtttacgtaacgtaacgtaacgttaacttaagtttactttacgtttacgtttcggtaaccggtttcggtagggttaaccggaaacggggtaccgtaacgggttacccgacccggttacccgtcccccgtagtacccccg

SEQ ID NO: 235543 - DNA, 656 bp, Homo sapiens
  misc_feature: GYAE6OF02INHKA.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctcgtggttactagttttccgacttatagtatcagttgggtgcgacacggtccccttggaacaagggcttgagtggagtgggatgggccgtaccttcggacaacggaaagagtggagtagtggtcaggaatttcgaggcaagaattaccttagacacagactcatccgacggcaacgagcctacgtagaactgacgaacctagagtaagtggaaccgcgacggaccaacgaattacgtttagttcggtgacggtacggtagggtcggggtactagttttaggtagtaaccgttaacgtaaccttaatttagttaccttttacgttacgggtaccgttacgggttacggggtacggtaaaccgggtacccgtaacgggttaccgtacccggttacccgtacccccggtagtacccccg

SEQ ID NO: 235544 - DNA, 674 bp, Homo sapiens
  misc_feature: GYAE6OF02HXB96.21.67.G01.1.454.CMB.1.raw
  modified_base (190)..(190): a, c, t, g, unknown or other
  misc_feature (190)..(190): n is a, c, g, or t
  modified_base (286)..(286): a, c, t, g, unknown or other
  misc_feature (286)..(286): n is a, c, g, or t
  modified_base (304)..(304): a, c, t, g, unknown or other
  misc_feature (304)..(304): n is a, c, g, or t
tcagtcgtcgctcgcacgaccggtgctcgatttagagtatacatattgggtttggggacccgaaaaccacacccctccttgggagattcccctagatcacagcccctccaccatggactggacctggagcatccttttcctggtggcagcagcaacaggtgcccactcccagactcaactggtgcagtcnggacctgaggtgaagaagccgtggggctcggtgaaggtctcctgcgacgggcctcgtggttacagtttttccgactatagtatcagttggtgcganaggcctggacaaggctgngtgatggatggccgtactcgcgaacgaagagtggagtagtggtacgaggtaactttcgaggctaagaacttacgttagacaagacgtactacacgtaccgacggaacacgacggtacctaacgttacggaaaccttaggaacggtaaaccgttagaagtaaacggtgggaaaccgaacgaaccgggaaccactaaacgttaatttagtacgttagaccgtacggagggtacggggctaagtttgtaacgggtacttaacgtacttagttacgttacgttacgttcggtaaccgttggtaacgggttacggaaacgggtaccgtaaccgggtaccttaacccgggtaccgttaccccacggttacccccgg

SEQ ID NO: 235545 - DNA, 600 bp, Homo sapiens
  misc_feature: GYAE6OF02GTP18.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccgaccgttcgcgaacggaaagagtggagtatggtcaggtaattcgaggcagtaattacctgaccacagactcatccgacggcacgacgcctacgttaggaactgaacggtaacctagaacgaagtacggaacgacgaaccggaccaacgattattattggtcgcgcgaggtggggctagtttgtagtactactacttattattacttcgttggtacgttcggtagggtacgtaaacgggtaccgtacggtaccgtacccggtcctaccccgagtaccccg

SEQ ID NO: 235546 - DNA, 461 bp, Homo sapiens
  misc_feature: GYAE6OF02I5RTS.21.67.G01.1.454.CMB.1.raw
  modified_base (356)..(356): a, c, t, g, unknown or other
  misc_feature (356)..(356): n is a, c, g, or t
  modified_base (432)..(432): a, c, t, g, unknown or other
  misc_feature (432)..(432): n is a, c, g, or t
  modified_base (435)..(461): a, c, t, g, unknown or other
  misc_feature (435)..(461): n is a, c, g, or t
tcagtcgtcgctcgcacgaccggtgctcgatttagagtatacatattgggtttggggagtatggtcaggaatttcagggcagaattaccttgaccacagactcatccacgggcacagcctacttggaactgaggaacctgagaatggacgacacggccacatattattgtgcgcgaggtgggggctagtttgtagactactacttattattacttcttggacgtcgtgggacaaagggacctacggtcacccgtcctaccccagccctcccaaccgaacgggtcccagtccggttccttcccccgtggcccgccccgtgtcctccgaggtacgccacccgtccgagtacgccacgnggcccggccgtgggctcgccgttggcaaggctacctccgagccgacgactgacgcggactggacgaggcacatagntannnnnnnnnnnnnnnnnnnnnnnnnnn

SEQ ID NO: 235547 - DNA, 735 bp, Homo sapiens
  misc_feature: GYAE6OF02H5Y3X.21.67.G01.1.454.CMB.1.raw
  modified_base (372)..(372): a, c, t, g, unknown or other
  misc_feature (372)..(372): n is a, c, g, or t
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctcggacctggaggtgaagaagccgtggggcctcggtgaaggtctccgtgcgagggcctcgtggttacgtcgtttttccgactatacccgacgggacacgacgtcctacgttacggaactaggaacggtaaccgtagaagaagtagggaacgaccgaccggacctaacgtattaattagtttgnggccggtacggaggtgggggtactaggttttacgtagtaccttaacttacgttaactttagttttaacttcgttacgggtacgttacggtacggggacgtaaacggggtaccgtaccgggtaccacccgttcccgtaccccgacgtccctacccgtaaccgaaccgggtccccgaacgttcccggttacccgttccccgtcggtcccgtccctcgtcccgtcgacggaccgtccacccgtacgacggacaccgtacgacggccgccgtcggctcgaccgtcgtacgacgtaccgtcccgttcccgtcgttcccttacgaccgttcggaccgggtccggtaccggtacggaccgtacggtaccg

SEQ ID NO: 235548 - DNA, 811 bp, Homo sapiens
  misc_feature: GYAE6OF02H1TG2.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacgaggtgcccactcccagactcaactggtgcagtctggacctgaggtgaagaacgccgtggggcctcggtgaaggtctctgcgacgggcctgtggttactacgtttttccgaactatagtatcgaggttgggtgcgacgaggtcccttggacgaagggtcttggaggtaggtagtaggggtagtcggggacccgtaccgttccggacgaaaccggtaaagacgtaggaagtagtggtacgtaaggtaagttttcgaacggtacaaagtaacgtttacgttaggaaccctaagaacgtactacgaacgtccggtaaccggcgaaccgtaacgaccttaacgttacgggtaacgtaggaacggtaaccgtagaacggtaaacgttcgggaaacgaccggaaccggtaacccaacgtattttaacgttacgtttacggtacggtaccggtacgggtaacgggtacgggggtacgttaaggttttaacggttaaggaaaccttaaaccggtttacttaagtttaacgttttaacgttttaccggttaacggttaaccggtttacgggtacgggggttaaaccgtaaaccggggttaccccgaaccgggttacccgtaaccccgggttaacccgtttacccccggacgttaacccccccggg

SEQ ID NO: 235549 - DNA, 773 bp, Homo sapiens
  misc_feature: GYAE6OF02F2OAS.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtagaaggtctccgtgcgagggcctcgtggttactagtttttccgactatagtatcagttgggtgcgacgaggtcccttggactaagggtcttggaggtggagtggggatcggggccgtaccgttcgacgaaacgggaaagagtaggagtagtggtacaaggtaacttcgagggtctaagtaacttaccttacgaacctacgagtactacgactaccgaacggacacgacgtaccgttaacgtacggtaaccgtggaaccggtaacctgggaacgtaacgtcgggaaccgacggacccggacccaacgtaacgttaagtttaacgttgggtacgtaccgggtacgggtacgggggttacggggggtactttacggttttaacgggtaacgtaaacccgtttaccgttaaacgtttacgtttaaccgttttaccgtttccggtttaacgggtaccggttccggggttaaggggaaccgttaaaccgggggacccgttaaccggggttacccgtaccccggttacccccggttaccccgaaccggttaccccccg

SEQ ID NO: 235550 - DNA, 736 bp, Homo sapiens
  misc_feature: GYAE6OF02HLZ1O.21.67.G01.1.454.CMB.1.raw
  modified_base (295)..(295): a, c, t, g, unknown or other
  misc_feature (295)..(295): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgacgggcctctggttactacgtttttccgacttatagtactcgtaggttgggtgacgacncggtccgttggacgtaagggcttggacgtggtagtgggagtcgggaccgtaccgttcgacgaaacggaaagagtcggaagtagtggtacgaggtaagttcgagggtacaagtaacttaccgttagaacccgaacgtaacgtactacgtaacgtaccggaacgggactacgacgtaccgtacgtaggtaacgtacggtaacggtaccgaagaacggtaagtacgggaacgaacgaaccggaccgtaacgtaagttaagtttacgtaggtcgtcggacggtagggtacggggtacttaggttagtaacgtacgttaaccgttacgttaagttacgtttaacgtttacgttagggtaaccggttcggtaacggggtaaccgtaaacgggtacccgtaaccggtacccgtaacccggtacccgtaccccgtaccggtaacccccg

SEQ ID NO: 235551 - DNA, 600 bp, Homo sapiens
  misc_feature: GYAE6OF02HNNQU.21.67.G01.1.454.CMB.1.raw
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
  modified_base (467)..(467): a, c, t, g, unknown or other
  misc_feature (467)..(467): n is a, c, g, or t
tcagtcgtcgctcgcacgaccggtgctcgatttagagtatacatattgggtttggggacccaaaaccacacccctccttgggagattcccctagatcacagcccctcaccatggactggacctggagcatcctttcctggtggcagcagcaacaggtgcccactcccagactcaactggtgcagtctggacctgaggtgaagaagcctgggggcctcggtgaaggtctcctgcagggcctctggttacagtttttccgactataccacggcacagcctacttgactgaggacctgagatgacganacggccanaatatattgtgcgcgagtcgggggcaagtttgtaagactactactattattacttcgttggacgtctggggcaaagggtccaggtcaccgtctcccagccctacaccaacgggccctatccggtccttcccccgtggcccgaccctgcctcccnggtacgccacccttccgaggtacgccaacgtcggccgtcccgtcgggcctcggcccgtacgggttcaaggtccttaaccgttcccctacgtcctaccgttacgtgacgggtccggtcgtcgggagaggaccgg

SEQ ID NO: 235552 - DNA, 772 bp, Homo sapiens
  misc_feature: GYAE6OF02JDF12.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggacctcggtgaaggtctcctgcgacggcctctggttacagtttttccgacttactagtatctagttgggtgcgacgacggcccttggacgagggcttggagtggatgggatcgggccgaccttcgacgaacggaagactaggacgtagtgggtacaagggtaactttcgaagggacgtaacgaactttaaccgttaggacccgtaacgacgaacgtcgaacttccgaaccggggcctaacgaccgtacgttaaccgtcgggtaaaacttcggaaacggtaaccgttaggaagaaacggttacggaacggtaaccgaaccgggtacccgtaacgtaacttaacgtttagttaccgggtacgtaccgtacgggtaacgggtggggggtaccttaaggtttacgggtacgtaaaccttacgtttaaccgttaagtttcttttaaacggttccggtttaagggtaccgttacggggttacggggtaaccgttaaaccggggaacccgttaccgggttacccgtaaccccggtacccgttacccccggtacggtaaccccccgg

SEQ ID NO: 235553 - DNA, 780 bp, Homo sapiens
  misc_feature: GYAE6OF02JKL8B.21.67.G01.1.454.CMB.1.raw
  modified_base (286)..(286): a, c, t, g, unknown or other
  misc_feature (286)..(286): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcctggggcctcggtagaacggtctcctgcagggcctcgtggttactcgttttccgacttacgtagtatcgaggtttgggngcgacgtaggtcccttaggacgaacgggtcttaggacggtgggtagtaggggacgtacggggcccgtaacctttccggacgtaaaccggggaaagtacgtagggaacgttaagttacgggtacgtaagggtaactttccggaagggtactaaacggtaacgtttacccgttacgaacccgtacgtaacggtacctacgaacgttacccgaaccggggtacctacggacgtacccgttaacgttcgggtaaacttacgggaacgggtaacgtaggaacggtaacggtacggacgtaaccggaccggtacccgaacgtaacgttaacttacgttcgtacgtacggtacggtacgggtacggggtaccttaggttagttacgtaccgttaaacttacgttacttacgtttacgtttacggttacggtacgttcggtacgggacggtaacggtaccgtaccggtaccggtaccggtaccgtccccgtaggttaccccg

SEQ ID NO: 235554 - DNA, 902 bp, Homo sapiens
  misc_feature: GYAE6OF02GD0HK.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgccagggcctcgtggttactacgtttttccgacttatagtatcgtaggttgggtgtacggactacggtcccgtttggaccgtaaggggtcttaggaggttaggagttggggtaagttcggggcccgtaccgttccggaccgaaaaccgggaaagtagtagggtaagttaggttcgggtaacgaagggtaacgttttccggaacgggtacgtaaggtaaacgtttacccgttacggtaaaccccgaacgtaaggtaacccttacgtaaccgttaccccgtaaccgggaaccctaaccgtaaccggtacccgttaaccgttacgggtaaaccgttacgggtaaaccgggtaaaccccgttaggaaaccgggtaaacggttaccggggtaaacccggaacccggaacccgggtaccccgtaaaccgttaaacgtttaacgttttaacggtttacgggttacgggaccggtaccggggtaacggggttggggggtacccgttaaggttttacgggtaaacgttaaaccgtttaacgttaaccgtttaacgttttacgtttaaccgtttacggtttcgggttaccgtttcgggtacggggttaaccgtaaaccggggtacccggtaccgggttaccgtaccccggttacccgttcccccgtacgttaacccccgg

SEQ ID NO: 235555 - DNA, 758 bp, Homo sapiens
  misc_feature: GYAE6OF02FW2PJ.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctgggcctcggtgaaggtctccgtgcagggcctctggttactagtttttccgactatagtactcagttgggtgcgacaggccttggacgaagggcttgagtggatgggatgggccgacgttcgacgaaggaaacgagtagggagttagtggtacgaggtaatttcgagggacaagtaacttaaccgttcgaccaacgaggaacctcaacgtcccgaacggggaccaacgacgtacccgttaacgttcggtaaacgtcggtaacggtaacccgtaggaagaaacgttacggggaaaccgaaccgtaacccgggacccgaaacgtaaagttaactttacgttaggtcggtaccggacgggttaaggggtacgggggtaccgtaggttttacgtaacggtaccgtttaaccgttaactttaacgtttacgtttaaccgtttaccgttttaagggaacccgtttcgggttaccgggggtaaccgtaaaacgggggaccccgtaaccgggttacccggaaccccggtttccccgttacccccgaggttacccccg

SEQ ID NO: 235556 - DNA, 609 bp, Homo sapiens
  misc_feature: GYAE6OF02F2HW8.21.67.G01.1.454.CMB.1.raw
  modified_base (457)..(457): a, c, t, g, unknown or other
  misc_feature (457)..(457): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactataccacgggcacagcctacgttggaactgagaacctgagaatggacacacggaccacatattattgtagcgacgtaggtgggggctagtttgagtactactactattattacttctgacgtgtgggacaaagggaccaggtccaccgtctcccagccctccaccgaacgggccaagtccgtacccttccccgnggcccgccgtcgcctccgaggacgcctacccgtccgtacgacgcacgacggccgcccgtcggactcgaccgtaggtccaacggtaccgtaccgttaccgacggcccgaacgtaccgtacggaccggtcgggcgtacgggtaccgagggaccg

SEQ ID NO: 235557 - DNA, 774 bp, Homo sapiens
  misc_feature: GYAE6OF02FVO7E.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcgggtgaaggtctccctgcagggcctcgtggttactagtttttccgactatagtatctagttgggtgcgacaggcccgttggacaagggtcttaggagtggattggggagtgggccgaccgttcgacgaacggaaagcgtaggagtagtggtcgaaggtaatttcgagggcagtaacttaccgtagaacccaacgaagtacgtacaacgtacccgaccgggtacaaccgtacgtaccttaacgttacggaaacgttggaaacgggtaaaccgtaggtaacgtaaacggttacggaacccggtaaccgaccggtaacccgaacgtaactttaacgtttaacgttcggtaacgggccggtacggtacggggtacgggggtacttaaggttttacgtaaccggtaccgtttaaacgttaacgtttaacttttaacgtttaaccgtttaccggtttagggttaaccggttacggtttaccggggggaacgtaaaaccggggtaccgttacccggggttaaccctaacccgggttccctacccccggagttaacccccccg

SEQ ID NO: 235558 - DNA, 686 bp, Homo sapiens
  misc_feature: GYAE6OF02IFXG2.21.67.G01.1.454.CMB.1.raw
  modified_base (332)..(332): a, c, t, g, unknown or other
  misc_feature (332)..(332): n is a, c, g, or t
  modified_base (509)..(509): a, c, t, g, unknown or other
  misc_feature (509)..(509): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagttttccgactataccgacggcacagcctacttggaactggacggaactgagaatggacgacacgccacatattagttgngcgcgaggtgggggctagtttgtacgtaactactattaattatttacttcgttggtacgttagagggtaacgaaacgggtaccacgggtcaccgtcctccccgagtcccctaccaaccgaacgggccctacgttccggtccttcccccgtggcccgtccctcgcctccgagggaccncctaaccccgtcggaacgacgtccgaaccgacggcccgggtcccgtcgggtccgtacgggtcccgttgggtacccgaaacgggtccctttaacccggttcccccgttacggttaccttaccgttacccgtgggtaccgggtccggggtaccggttacggaccggtaacgggtacccg

SEQ ID NO: 235559 - DNA, 710 bp, Homo sapiens
  misc_feature: GYAE6OF02FQJ21.21.67.G01.1.454.CMB.1.raw
  modified_base (332)..(332): a, c, t, g, unknown or other
  misc_feature (332)..(332): n is a, c, g, or t
  modified_base (338)..(338): a, c, t, g, unknown or other
  misc_feature (338)..(338): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcgagggcctcgtgttactagtttttccgactataccgacggcacagcctacgttggaactgaggaacctgagaatggacgacacggccacatattatgngcgcgnggtggggctagtttggtagtactaactactaatttatttacttcttaggaccgtcgtggggactaaaaggggcccaacgggtccacccggttcctaccccgacgtccctcccgaacccgaaaggggcccccaagttcccgggtcctttccccccgtcggcccgtccccttcgcccttacccgaacgggtacgccctaccgtcccgaacgagcccgaaccacggtccccggacccgtcggggacccgtccgccgttacgggtacccgtaaacgggtacccgtttacccgttacccccgggaaggacccggtaaccgtaaccggttcgggaaccgggtacccgggggtcctacggggtacccgaagggtcccgg

SEQ ID NO: 235560 - DNA, 756 bp, Homo sapiens
  misc_feature: GYAE6OF02GVH4Z.21.67.G01.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctgggngaacggtctccgtgcgagggcctcgtggttactgttttccgactacgtaccgacgggcaaccgagtcccttacgttacggtaacgttggaacggaaccttggaagtaagtcggacgtaacgacggcccacgtaatattaattgtgcgacggaggtgggggctagtttggtaagacctaactaacttagttaactttaccgtttagttcgggtacgttcggttcgggggaacgtaaaacggggtacccgtaacgggtacccgtaacccggtccgttaccccacggtcccttcccgaaacccgtaaccgggacccccttaagttcccggttacccgtttccccccgtgggtaccccggtccccgtgtcccgttcccgaaccgggcgtacccacccgttccgaacggtctacgacccgaggccgtcccgtcggggactccgccgttacggtaccgaaggtacccgtttacccgtcccggttaccgtccgttacctacgtccggaacggtcccgggtcgtccggacgaccgggtaaccg

SEQ ID NO: 235561 - DNA, 608 bp, Homo sapiens
  misc_feature: GYAE6OF02HAMRW.21.67.G01.1.454.CMB.1.raw
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
  modified_base (439)..(439): a, c, t, g, unknown or other
  misc_feature (439)..(439): n is a, c, g, or t
  modified_base (450)..(450): a, c, t, g, unknown or other
  misc_feature (450)..(450): n is a, c, g, or t
  modified_base (455)..(455): a, c, t, g, unknown or other
  misc_feature (455)..(455): n is a, c, g, or t
  modified_base (468)..(468): a, c, t, g, unknown or other
  misc_feature (468)..(468): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagttttccgactataccgacgggcacagcctacttggaactgaggaacctgagaatggacgacacggccacatattattgtgcgcggaggtgggggctagtttgtagactactactattattacttcttaggacgtcgtggggacaagggaccaggtcaccgtctcccgncccnccacgacggcccancgtcttccccnggccncctgcctcgacgnccacctccgagacgcacgacggccggccgtagggcctccgggccgttcggggtaccaacgggtaccttaaccgtttccccgtcgttccttaccgtacgttacggaccgggtcgggtccgtacgggaccgtaagggcccgg

SEQ ID NO: 235562 - DNA, 725 bp, Homo sapiens
  misc_feature: GYAE6OF02FR7O0.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtgggggcctcgggtgaaggtctcctgcgacgggcctcgtggttactacgtttttccgactatagtatcgagttgggtgcgacgaggcccttgggacaagggcttgaggtggatggggagtcgggccgtaccgttcggacgaacgggaaaggtagtagggtagttagtacggtacgtaaggtaagtttcggagggtacaaggtaactttaccgttacgaaccaacgagtaacctacgtacgtccggacgggccacgtaccgtccttacgtacggaacgtggtaaggtaccgtagaaggacgtacggacgtaccgaccggacctaactaacttagttacgttaggtcggtaccggagggtaacggggttcgggggagtttacgttttacggtaacgtaaccgttaacttacgttaactttagttttaccgttacggtttcggtaaccgttcgggtacgggttacggaacgggtacccgtacggtaccgtacccgtaccgtaccccgtacgtaccccg

SEQ ID NO: 235563 - DNA, 945 bp, Homo sapiens
  misc_feature: GYAE6OF02F2UAK.21.67.G01.1.454.CMB.1.raw
tcagtcgtcgctcgcacgaccggtgctcgatttagagtatacatattgggtttggggacccaaaaaaccacacccctccttgggagattcccctagatcacagcccctcaccatggaccgtcgtcgtaggcactccttttccctttcggtgggtcgacgacgacgacgaaccaaggtggtcccaccctacccaccgaactacctaaacgtacggtggtcgacgtacgtcggtaccgtacgtagggtaggaagaaacggaccgtcggggtccggtccggttaggtaaggtacgttcccttcggcgacgggaccgttccgttacggtttaccgttaacgtttttacccggttacctaagttaagttaagttaccgtaacggtttggggttacggccgaaccgtaaccgggtccccgtttaccgggtaaacggaaacggggtccgtttaggtaacggtagggtaaggtacggggtaagggtccgggggaccccggttaaccccgtttaccggaccggaaaaaccgggaaaagggttaaagtcggggtaaagggttaacgttcgggttaccgtaaagggtaacgttttacggtacggggacgtaaagtaactttaccgttacgacgaaccagtactacacgtacccgacggacactaacgccttaacgtacgtaacgacgaacggtaacgtagagtaaacgtacggaccgaccgaaccggacaacctagttaacttagttacggtcggacggtacgggtacgggtgggggtacctaagttttaggtacgtaaaccttaacgtttaacgttaaccgtttaagttttcctttaacgtttcgggtaacggttaccggttacggggtaaacggtaaaccgggtaacccggttcccggttaaccgttaccccggttaccccgtaccccggttaccgtaccccggtaacccccgg

SEQ ID NO: 235564 - DNA, 744 bp, Homo sapiens
  misc_feature: GYAE6OF02G7FDZ.21.67.G01.1.454.CMB.1.raw
  modified_base (287)..(287): a, c, t, g, unknown or other
  misc_feature (287)..(287): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggtcctctggttactagttttccgactatagtatcagttgggtgcgacnggcccttggacaagggtcttggagtggagtgggagtcggggccgtaccgttcggcgaaacggaaagagtagggagttagtggtacgaagggtaactttcgaagggtcaagtaactttaccgttagaaccaactagactacgactacccgacgggacaccgtacgtaccgttaacgttaggtaacgtacggaacggtaacccgtaggaacgtaacgtacgggaaccgaacggtaaccggacctaacgtaagttaactttaacgttggtacgcggtacggtacgggtacgggggtacttaggttttaggtaacgtaaccgttaacttaacgttaattttactttaccgtttacggtttacggttaaccggttacgggttacgggggaacgtaaaccggggtacccgttaaccgggttacccgtaccccggtttcccgttaccccgtaccgtacccccgg

SEQ ID NO: 235565 - DNA, 633 bp, Homo sapiens
  misc_feature: GYAE6OF02GVQBR.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagttttccgactatagtatcgagttgggtgcgacacggtcccttggacaagggtcttgagtggagtgggagtcggggccgtaccgttcgacgaaacggaaagagtggagtagtggtacaggtaattcgaggactagtaaacttaccgtagaaccacgagtactacacgtccgacgggcacgacgccgtacgttaggaacgtggaaggaacctgaagtaagtaggaccgacgacggaccaactattaattatggtgacgtaggtagggtaggggctagtttgagtacttaactagttacttagttacttgttacggtacgttggtacgggacgtaagggtaccgtacggttaccgtacccggtcctaccccgagtaccccg

SEQ ID NO: 235566 - DNA, 708 bp, Homo sapiens
  misc_feature: GYAE6OF02I5EUG.21.67.G01.1.454.CMB.1.raw
  modified_base (512)..(512): a, c, t, g, unknown or other
  misc_feature (512)..(512): n is a, c, g, or t
  modified_base (565)..(565): a, c, t, g, unknown or other
  misc_feature (565)..(565): n is a, c, g, or t
  modified_base (604)..(604): a, c, t, g, unknown or other
  misc_feature (604)..(604): n is a, c, g, or t
  modified_base (700)..(700): a, c, t, g, unknown or other
  misc_feature (700)..(700): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgaccagtctagacctgaggtgaagaagcctggggctcggtgaaggtctcctagcgagggcctctaggttactacggttttccgacttatacggtattcgtaggttgggtgccgtaacacgggtccccttagggacgtaagggtccgttaggtaaggtggagttcgggattcgggaccgtaccgttacgacgtaaacggaagtacgttaggacgttaggtggtacgtaaggtaacgtttgaacgggtataacggtaattacccgttaaggacccaagtaacgtacgtaccgtacaccggtacggactacgacgtacttaacgtacggaacnggtaccgaacgtgaaaggtaccagggacacgaccgtaactgaaattacgtttntacggtcgacggtcgaggggttcggaccttaatttgganaaccgttataacgtttattacttactttcggtaacggtacgtggttaccgggaagtaaacgggtcctacggtaacctccccggtacttaaccccgngttacccg

SEQ ID NO: 235567 - DNA, 837 bp, Homo sapiens
  misc_feature: GYAE6OF02G861W.21.67.G01.1.454.CMB.1.raw
  modified_base (342)..(342): a, c, t, g, unknown or other
  misc_feature (342)..(342): n is a, c, g, or t
tcagtcgtcgctcgcacgaccggtgctcgatttagagtatacatattgggtttgggggtaccaaaaaccacacccctccttcgggagattccctagatcacagcccctcaccatggactggacctggagcatccttttcctggtggcagcagcaacaggtgcccactcccagactcaactggtgcagtctggacctggaggtgaagaagccgtggggcctcggtgaagggtctcctgcgagggcctgtcggttacagtttttccgactactaccacgggtacacaggcctacgttggaactgacggaacctgagaatggacgacacggctacattatatgtncgtcgaggtggggctatttgagtactacgtactagttacttacttcgttggacgttctagggggtacaaaaggggtccctaagggtcctaaccgggtaccttaccccgacggtaccccttaccgaaccccgtaaggggtacccccaaacgttcccggggtaccctttcccccgggtacgggtaccccggtcccttaccggtcccgtttacccgaaccgggacggtaccccgtaacccgtttaccgggaaaccccgggttacggaacccgttaaacccaaacccgggggtacccccggggtcccgttaacccgggggggtcttaacccggggtacccgtttcccggggttaaccgtaacccggggttaaacccggtttaaccccggtttacccccgtttccggggttaccccttttaacccctaacccgggttttaggttaacccgggggaacccggggttgtacccggggttaccgggaaacccgggttcccggg

SEQ ID NO: 235568 - DNA, 821 bp, Homo sapiens
  misc_feature: GYAE6OF02HC7KJ.21.67.G01.1.454.CMB.1.raw
  modified_base (356)..(356): a, c, t, g, unknown or other
  misc_feature (356)..(356): n is a, c, g, or t
tcagtcgtcgctcgcacgaccggtgctcgatttagagtatacatattgggtttgggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctgtggttactacgttttccgacttatagtatcaggttgggtgcgacgacggcccttggactaagggcttggaggtggacgtggggatcgggccgaccttcggacgaaacggaagngttacgggagtaagtgggtaccgaagggtaactttcggaacgggtcaaggtaaacttccgttacgaaccaacgacgtacctactaacgtcccggaacgggtacaaccgtagtacccttacgttaccgggaaacgttacggaacggtaacccttgggaaacgtaacggtacggaaccggtaaccgacccgggaacctaacgtaatttaacgtttacgttacggtacgtaccgggtcgggttaacggggtacgggggtaccgtttaagttttaccgggttaaacggtacccttaaacgtttaaccgtttaacgtttaacgttttacccggttttaccggttaacgggttacccggtttaacggggttaaccggggtaacccggttaaaaaccgggggtaccccggttaaacgggttacccggttaacccccggtcccggtttacccccgaccgggttaaccccccgg

SEQ ID NO: 235569 - DNA, 870 bp, Homo sapiens
  misc_feature: GYAE6OF02IC61E.21.67.G01.1.454.CMB.1.raw
  modified_base (225)..(225): a, c, t, g, unknown or other
  misc_feature (225)..(225): n is a, c, g, or t
  modified_base (857)..(857): a, c, t, g, unknown or other
  misc_feature (857)..(857): n is a, c, g, or t
tcagtcgtcgctcgcacgaccggtgctcgatttagagtatacatattgggtttggggacccaaaaaccacacccctccttgggagattcccctagatcacagccccctcaccatggactgggacctggagcattccttttcctggtggcagcagcaacaggtgcccactcccagactcaactggtgcagtctggacctgaggtgaagaagccgtggggcctcggngaggtctccgtgcgacgggcctcgtggttactacggttttccgactacgtaccgacgggtcacacggtcctacgttacggaaccgttggaacggaaccgtgaaggtaaagtcggggaaaccgaccgacccgggaccctaacgaatttacgttaaagtttggtcggaccggacgggtagggttcggggggaccttaagtttaggtaacggtaactacgttaacttaattttacgtttacttaccggttggtacggttcgtacggggggacaaaggggtacccctacgggtacctacccgggtttcctaccccgtacgtacccgtacccgtaaacccgacgggtaccctacggttccggttacccggttccccccgtagggtaccccgtcccggttcgtacccgtcccgaacgggtaccggtaccccgaaacccggttccccgggaaaggtacccggaccgtaaccggacccgggcccgggaccccggtttccggggacccgttcccgggtaccccgttaggggtacccggtaaaccgggttaaccccgtttaaccccggttcccctttcccgggtcctttaccggtaaccgttcgggtaacggggtcccgggccgggtttacgggaccccggngggtaaaccccgg

SEQ ID NO: 235570 - DNA, 594 bp, Homo sapiens
  misc_feature: GYAE6OF02G4JUQ.21.67.G01.1.454.CMB.1.raw
  modified_base (278)..(278): a, c, t, g, unknown or other
  misc_feature (278)..(278): n is a, c, g, or t
  modified_base (464)..(464): a, c, t, g, unknown or other
  misc_feature (464)..(464): n is a, c, g, or t
  modified_base (501)..(501): a, c, t, g, unknown or other
  misc_feature (501)..(501): n is a, c, g, or t
  modified_base (571)..(571): a, c, t, g, unknown or other
  misc_feature (571)..(571): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgaggcctcgtggttactgtttttccgactataccgacggcacngcctacttgaactgacgactgagagtgacgacacggcacatattatgtcgcgcgaggtggggctagttgagactactacttattatttacttcgttggacgtcgtggggactaaagggacctacggtccaccgtcctacccagaccctccgaaccgaacgggccctacgtccggtccttcccccgnggcccgtccctgccctcgacggctcctaccgcgacgngaccacgcggccggccgtcgggcctcgcctggacgaacggtaccgttccttcccgagttccctacgttcnggacgcggtcgtgtacgaggccg

SEQ ID NO: 235571 - DNA, 697 bp, Homo sapiens
  misc_feature: GYAE6OF02FZOEI.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaacggtctccgtgcgagggcctcgttggttactacgtttttccgactataccgacgggcacagcctacttggaactgaggaacctgagaatggacacgacggccacatattagttgtcgcgcggtaggtgggggctagttttgtagactactacttattactttacttcttaggtacgttcgtggggactaaaggggacccaacgggtctacccggtctaccccgagccctcccgtaaccgaacgggtccccacgttccggttcccgttcccccgtcgggcccgtccccgtcgccgtaccgacgggccgtaccacccgttaccggacgacgaccgacgtaacgggcccgggtacccgtcggggtccttcggtccccgttaggtaccgtaacggaccttaacccgttccccgtttcgcccgttaccttaccgttgggaccgggtaccgggtccgtacgggtaccgtaaggtcccgg

SEQ ID NO: 235572 - DNA, 727 bp, Homo sapiens
  misc_feature: GYAE6OF02IEDGW.21.67.G01.1.454.CMB.1.raw
  modified_base (549)..(549): a, c, t, g, unknown or other
  misc_feature (549)..(549): n is a, c, g, or t
  modified_base (620)..(620): a, c, t, g, unknown or other
  misc_feature (620)..(620): n is a, c, g, or t
tcagtcgtcgctcgcacgaccggtgctcgatttagagtatacatattgggtttggggacccaaaaaccacaccccctccttgggagattcccctagatcacagcccctcaccatggactggacctggagcattccttttcctggtggcagcagcaacaggtcgcccactcccagacctacaacgtggtgcagtctggacctggaggtgaagacgccgtggggcctgggtagaacggtctccgtagcgacgggtcctcgttcgggttacttacgtttttaccgacttagtagttacgtcgtaggttcgggtagtcgacgtaccgggtccgttacgggaacgtaaggggtccttgggtaacggtgggtacggtgggtacggtcgggtacccgtaccgttacgaccggaaaggtaacggtaggtaggtagtaggtcgggtaacgtaggtacgttcggacggactaagtaacgttaccgtgaaccgtacacgtactcgtacgtaccggacggacaccgtacgtacgtacgtcggaacgttggaacgtaaccgngtaacggaacgtacggacgaaccgtaccgactaagttagttaagttggcgtacgaccgggtagtacggggnggaccttagtttggacctactacgtacttagtttaccgttgttacgtgggtaccgtggtaacgggaactaacggtcctacggtacctacccgtcgacccctgtaccc

SEQ ID NO: 235573 - DNA, 653 bp, Homo sapiens
  misc_feature: GYAE6OF02INQL1.21.67.G01.1.454.CMB.1.raw
  modified_base (300)..(300): a, c, t, g, unknown or other
  misc_feature (300)..(300): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagttttccgactatagtatcagttggtgcgacaggcccttggacagggnttgagtggatggggatggggccgaccttcggcgaacggaaagagtggagtagtggtcgaaggtaattcgagggcaagtaattaccgttgaccacaagactcactccgacggcacacgacctacgttaggaactaggacggaacctagagaagtacggacgacacggaccaacattaattagttgtaggcgacggtaggtgggggcttagtttggtaagtaaccttaacgttaattactttagtttaaccgtttcgtttacgggtaaccgttaccgggttaggggtaaccgaaaacggggtacccgtaaccgggttacccgtaacccggtcccgttacccccgacgtacccccg

SEQ ID NO: 235574 - DNA, 465 bp, Homo sapiens
  misc_feature: GYAE6OF02IB02O.21.67.G01.1.454.CMB.1.raw
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
  modified_base (410)..(411): a, c, t, g, unknown or other
  misc_feature (410)..(411): n is a, c, g, or t
  modified_base (416)..(417): a, c, t, g, unknown or other
  misc_feature (416)..(417): n is a, c, g, or t
  modified_base (419)..(465): a, c, t, g, unknown or other
  misc_feature (419)..(465): n is a, c, g, or t
tcagtcgtcgctcgcacgaccggtgctcgatttagagtatacatattgggtttgggggagtatggtcaggaatttcagggcagaattaccttgaccacagactcatccacgggcacagcctacttggaactgaggaacctgagaatggacgacacggccacatattatgtgcgcgaggtgggggcatttgtagactactactatttattacttcttggacgtctggggcaaaggggaccacgggtcaccgtctccccagccctccaccaagggcccatcggtccttccccnggccgccctgctccaggancacctccgagacgcacacggccggccctgggctgccctggtcaaggctacgtcccgagccgacgactgacggcgggctaggacaagggcgtacaataggnntacgnngnnnnnnnnnnnnnnnnnnnnnnnnnnnnnnnnnnnnnnnnnnnnnnn

SEQ ID NO: 235575 - DNA, 665 bp, Homo sapiens
  misc_feature: GYAE6OF02HSBQL.21.67.G01.1.454.CMB.1.raw
  modified_base (240)..(240): a, c, t, g, unknown or other
  misc_feature (240)..(240): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcaggctntggttacagttttccgactatagtatcagttggtgcgacaggcccttggacaaaggggcttaggagtggagtgggtatggggccgaccgttcgactaacggaaaggatgggaagtagtggtgaaggtagtttcgagggctaagtaaattacgttgaacccacaaggactacacgtccgaaccgggtcgaccgacgaccttaacgtcgggtaaactcggaaacggtaaccgtgaaggtaagtacgggaacgtaaccgacggtaccaacgtataattatcgttaggcggtcggtacggtacgggggactagtttacgtaggtaacttaaccttaacgttagttaactttaccgtttagttacgggtacgttacgtgggtacgaaagggtaccacgggtacctaccggtaccctccccgagtaccccg

SEQ ID NO: 235576 - DNA, 849 bp, Homo sapiens
  misc_feature: GYAE6OF02IZ0OZ.21.67.G01.1.454.CMB.1.raw
  modified_base (108)..(108): a, c, t, g, unknown or other
  misc_feature (108)..(108): n is a, c, g, or t
tcagtcgtcgctcgcacgaccggtgctcgatttagagtatacatattgggtttggggacccaaaaaccacacccctccttgggagattcccctagatcacagcccctnaccatggactggacctggagcatccttttcctggtggcagcagcaacaggtgcccactcccagactcaactggtgcagtctggacctgaggtgaagagccgtggggccttcggcggaaggtctccgtcgcgtacgggtcctcgtcgggttacctaggtttttcccgaacgttaagttacggtacttacgtaaggtttcgggtcgaccggacgtacggtccccgtttagggaaccgtaaagggccgtttggagggttacggacggttgggggacgttacggggcccgtaccgtttaccggaccaaacgggaaggaagttgggaacgttagtacgggttacgaaggttaaacgtttacggacgggtacgtaacgtaacgttaacccgtacgtaccgtaacgacgtaacttaccgtaacgtcccgaaccggggtacctaaccggacgtaacccgttaccgttaacgggtaaccgttaggtaaccggtaaccgtacggaaacgggtaaaggtacgggtaaacccgggtaacgaccggtacccgtaaacgttactaaacgtttagtttcggttacgtacggtacggtaacgggttcgggggtacttaggtttacgacgttaacgtttaactaaccgtttattaaccgtttaccgttaacggttcgggtaccgttacgggtcgggtaaaccggtaagggtaccgttaaccggtcccgttaacccgtccgttacccgtgtaacccccg

SEQ ID NO: 235577 - DNA, 860 bp, Homo sapiens
  misc_feature: GYAE6OF02FQ3XE.21.67.G01.1.454.CMB.1.raw
tcagtcgtcgctcgcacgaccggtgctcgatttagagtatacatattgggtttggggacccaaaaaccacaccccctccttgggagattcccctagatcacagccccctcaccatggactggacctggagcatccttttcctggtggcagcagcaacaggtgcccactcccagactcaactggtgccagtctggacctgaggtgaagaacgccgtggggcctcggtgaacggtctcctgcagggcctcgtggttactacgtttttccgactatagtatcgtagttggggtgcgactaggccccttggacgagggcttggagtggagtgggatggccgacttcgcgaacggaagatggagtagtcggtacgaagggtaaatttcgacgggacgaacgtaacttaacccgttaggaacccacgaacgacttcccgaacttacccggaacggggccaaccacgtacccgttaacggtttagggaaacccgttacgggaaacgggtaaacccgtggaaacggtaaaccggtaacggggaaacccggtaacccggtaacccgggaaccccgtaaactaaccggttaaacttttaaggtttaccggttacggtacccgggcggtaacgggggttacgggggtaccgttaagtttttacgggtacgttaaacccgtttaaccgtaacgtttaacgttttacgtttaacccgttttaccgggttttaccggtaaccgggtttccccgggtttaagggggggtaaaccccgttaaaaccggggggtacccccggttaacccggggttaaccccggtacccccgggtttacccccggttaccccccggtaaccccggttaacccccccgg

SEQ ID NO: 235578 - DNA, 872 bp, Homo sapiens
  misc_feature: GYAE6OF02IDXPV.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtcgcccactcccagacctcaactggtcgcagtctcggacctgaggtagaagacgccgtgggggcctcgggtagaacggttcctccgtggacgacggggccttcgttacgggtttaccttacggtttttaccggacttagttagtaacttcgtaggtttggggtcgacgtacgacgggttccccgttaggaacgtaacgggtcttaggaggtaggagtgggacgttcggggacccgtacgttaccggacgaaacggtaaggacgtggaagttagttcgggaacgtaagggtaacgtttcggaacgggtacgtaacggtaaacttaaccgttacggaacctaacggtacgtaacctaccgtaccgtacccggacgggtacctaacgaccggttaaccgttacgtttaaccggggaacgttacgggaaacccgggttaaccggttaagggaaacgggttaacgaaccgggaccgaaaccggtaacccgggaacctacgttaaagtttaacgtttagtaccgggttacggaccgggaccggggtaagggtacggggctttaagggtttacggaacggtaaccgtttaacgttcgtttaacttttacgttacccgtttacggtcgggtaaaccggtttggaaccggggttaacgaacccgggtacccgtacccgggttaccttaacccggtcccttaccccgggtaaccgttacccccg

SEQ ID NO: 235579 - DNA, 850 bp, Homo sapiens
  misc_feature: GYAE6OF02IQ9IA.21.67.G01.1.454.CMB.1.raw
tcagtcgtcgctcgcacgaccggtgctcgatttagagtatacatattgggtttggggacccgaaaaaccacacccctccttggagattcccctagatcacagcccctcaccatggaactggacctggagcatcctttctggtgcagcagcaacaggtgcccactcccagactcaactggtgcagtactggacctgacggtgaagaacgccgtcgggcctaccgggtggtaacgggtcctacccgtcggacgtacggggtccctaccgttagggtttaaaccgtggttttttaaccccgacgttaaccgtacccggaaccggggttaccaaccgtacgtcccttacgttacgggtaaaccttcggaaaccggaaccctcggtaagaaacgttcggggacctaacggtaccggccgtaaactaggttaacttaacgttcggtacgaccgggaccgtagggttcgggtacgtaatttacggtacgtacttacgtaaccttagttactttaacttaccgttggtaacggttcggtacggggaccgtaaacggggtacccctaacgggtaccctacccgggtaccttaccccggtacgttaccccgtaacccggtaaacccccgaaggggacccccgttaacgttaccggttccccgttaaccccgtcgggtaccccttccccggtgtccccgtaacgtacgggccgaaccgtacccgtacgtacgaacggtacccacgggtacgccgtacccggtaggcccgttaccgcgttaacggtcgaaccggtacttccttaccgtcgtaccctaaccgttcgtacggaccggtcggtaccctcggtaccggaagtccgg

SEQ ID NO: 235580 - DNA, 810 bp, Homo sapiens
  misc_feature: GYAE6OF02H2FIH.21.67.G01.1.454.CMB.1.raw
  modified_base (138)..(138): a, c, t, g, unknown or other
  misc_feature (138)..(138): n is a, c, g, or t
  modified_base (298)..(298): a, c, t, g, unknown or other
  misc_feature (298)..(298): n is a, c, g, or t
tcagtcgtcgctcgcacgaccggtgctcgatttagagtatacatattgggtttggggacccaaaaccacacccctccttgggagattcccctagatcacagcccctcacatggactggacctggagcatccttttccnggtggcagcagcaacaggtgcccactcccagactcaacgtggtgcagtctggacctgaggtgaaagaagccgtggggcctacgggtgtaaggtcctcctggacgacgggtcctacgtggttactacggtttttccgactatacgtatcgtagttggggtncgacgtacggtccctagaacgtaagggtcttagggagtagggtagtgggtaagtcgggtccgtaaccgttcgaccggtaaaagggaaaaccgtgttagggaacggttggtacgtacgtagggtaaacttttcggaccgggtagaacgttaacgttaccttacggaaccctaacggtactaccggtaacttacccggtaccggaaccgggtaccaaaccgcgggtacctttaaacccgggttgggaaaccgttaacgggaaacgggtaacccgttaagggaaggtaacggttaacgacgggacctaaacggggccctaaagtacgttaattaggtcgttaggaccgacgggtaacgggttcggggaccttagtttttaacgacggttaaacttaaccggttaacttagtttaccgtattaaccgggttggtaccgtttacgggaacgggttaacctaacgggggtacctaccgggaacccgttccccgttaactaccccggtacgttaccccg

SEQ ID NO: 235581 - DNA, 913 bp, Homo sapiens
  misc_feature: GYAE6OF02JSLX7.21.67.G01.1.454.CMB.1.raw
  modified_base (238)..(238): a, c, t, g, unknown or other
  misc_feature (238)..(238): n is a, c, g, or t
tcagtcgtcgctcgcacgaccggtgctcgatttagagtatacatattgggtttggggacccaaaaaccacacccctccttgggagattccctagactcacagcccctcaccatggactggacctggagcatcctttttcctggtcggcacgcagcaacgaggtcgcccactccagtacctcaactggtcgcgtagtcgtcggacctggaggttaggaacgtaagcccggtggggtccncggttacggtaacggtcctccgtgacgacgggtccttcgttacgggttaccttacggtttttaccgattacgttaacgtacttacgtacggttcgggtcacgtaacgaccggtcgttacggacggtacggtctaggtagtcgggaacgtggggtacgtacgggtaccgtaccgttacggacgtaaaccgggtaagtacggtaacggtaacgtacggttacgggtaccgtaaagggttaccggtttttacgggacgggttactaaacggtttaacgtttaccgtttacgggaacccgtaaccgaacgggttaaacctcgttaacccggtaccggtacggttaaacccgaacccgtaaccggttccgtttaaccggttaacccggtaaacgggttcgtaaccgggttaaacaaacggggttaaccggaaaggtcccgggaaaccgaccggtaacggacccgttaaaccgttacgttaacgttacggttaacggtcggttaaccggtacggggtacgggtcggggttaccgttaggttacggttaaccgttaacgtaacttaacggtttaactttaacgtttccgttttacggtgttaagggtacccggtaagggtaacccgttaagggcccgttaaccgtccgttaccccggttacggtacccgttaccgaacccgg

SEQ ID NO: 235582 - DNA, 1200 bp, Homo sapiens
  misc_feature: GYAE6OF02JMVOK.21.67.G01.1.454.CMB.1.raw
tcagtcgtcgctcgcacgaccggtgctcgatttagagtatacatattgggtttgggggacccaaaaaccacacccctccttgggagattcccctagatcacagcccctcaccatggactggacctggagcattccttttcctggtcggacgagtcagcaacgaggtcgacccgacgtacccgacgtactaccaacgtggtacgcgtagtcgtacggacctaggacggtagaagaacgccgtacgggaccgtacggtacgaacggtcctaccgtagtaccgacggtctaacggtacggttaccgtacggttttaccgaacgttacgtaacgtaacgttacgtaggttacggacgtacggtacgtacggtacccgtacgggaaccggttaacggggttacgttaacggggtaacggttaacggggtaacggttaacgggggtaaccggttaaccggggtaacccgttaaccgggttaaccggaaaccgggtaaacgggtaaacggtaacgggttaacgggtaacggttaacggtaaccgggtaacggtaaacgggttaaccggttaacgggaacggtaaccgttaaacggtttaaccgttaacccggtaaacgtaacccgtaacggtaaccggttaaccgtaaccggtaaacccggttaacccggaaacggtaacccgtaaaccggtaaccggttaaacccgttaaaccgggttaaaccgggtaaaccgggttaaaccggggtaaaaccggttaaaccgggtaaacgggtaaaacccgggtaaaaccgggtaaacccggggtaaaacccggtaaaccgggtaaaccccggtaaaccggttaaaaccggtttaaacggtttaaaccgggtttaaacgggttaaaccgggttaaaccggggtaacccgggttaaaccggggggttaaccggggtttaaaaccgggggttttaaaccggtttaaacggggttttaaaacccgggtaaaaccgggttttaaaacccggtttaaccggtttaaaccggtttttaaacccggtttttaacccggtttaacccgggttttaaccgggtttaaacccgggtttaacccggggttaaaacccgggggtttaaaaccccggggttaaaacccgggtaaacccgggggtttaaacccccggttaaaacccggggttaaaccccccggtttaaaccccgggttt

SEQ ID NO: 235583 - DNA, 859 bp, Homo sapiens
  misc_feature: GYAE6OF02JHGK2.21.67.G01.1.454.CMB.1.raw
  modified_base (138)..(138): a, c, t, g, unknown or other
  misc_feature (138)..(138): n is a, c, g, or t
  modified_base (186)..(186): a, c, t, g, unknown or other
  misc_feature (186)..(186): n is a, c, g, or t
tcagtcgtcgctcgcacgaccggtgctcgatttagagtatacatattgggtttggggacccaaaaaccacacccctccttgggagattccctagatcacagcccctcaccagtggactggacctggagcatcctttcnggtggcagcagcaacaggtgaccactccagactcaactggtgcagtcnggacctgaggtcgaagacgccgtgggctcggtgaacggtctcgtacgcacgggtcctacgtcgggttactacggtttttaccgaactacgttaccgacggggaccaacgtacggtccgttaacggttcggaactcggaacggtaaccgttacggaacgtaacgtacgggtacggaaacccgaccgggaccgaaccgtaagttactttaagtcggttacggcggtaccgtaagggtggggtaccgttacgttttaggtaacgaaccgttactacgtttacttaacgtttacttacgtttacgtacggtacgttacgggtacgtaaacgggtaaccgtaccgggtaacgtccctttaccgtaccccgaccgtacccgttacccgaaccgtaacccgggacccgttaccggttaccgtcccggtttacccggtaccggtcggtacccgaccggttcgaacccggtacgttaccggaccgtacccggtacccggaaggtacccgttacccggaccgtaccgggaccgggttcccgtaccgggtcgtacccggccggtttaccgacccgggtacggttaaccctttcccgggttacccttacccggttccgtcccggtttaaaccgcgggttcccggggaaccgtttcccggggacgggttacccgacggggtaaccc

SEQ ID NO: 235584 - DNA, 861 bp, Homo sapiens
  misc_feature: GYAE6OF02I4Q37.21.67.G01.1.454.CMB.1.raw
  modified_base (183)..(183): a, c, t, g, unknown or other
  misc_feature (183)..(183): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtncagtctggacctgaggtgaagaagccgtggggcctcggtagaacggtctccgtgcgacggcctcgtggttacctacgtttttccgacttagtagttatctaggttgggcgtacgacgacggtcccgttaggaaccgtaacggggtcttacggtaggttgggtagttagggggtaattcgggggacccggttaacccgttaccggaaccgtaaaaccgggtaaaaggtagttacgggtaacgttagttacgggtactaagggttaactttcgggaacgggtactaaacggttaactttaccgttacgaacccctaacggaacgtaaccgtacgtaaccgtacccgaacggggtaccaaccgaacggtacccttaacggttaccggtaaaccgtttacggaaaccgggtaaccgttacggaacgtaaacggttaacggaaccggtaaccgaaccggaccccgaagttaacgttaacgtttacgttacggtaacggtcggaacgggtaaggggtccggggttaactaacggttttagtaaacgtaccgtttaacgtaacgttttaacgttacttttaacgttaacccggtttgggtaacccgttcggggttaacgggtaacgtaaaaccggggtccgtaaccggggtccctaaccgggtcccctacccggacgtaaccccg

SEQ ID NO: 235585 - DNA, 827 bp, Homo sapiens
  misc_feature: GYAE6OF02G4D6M.21.67.G01.1.454.CMB.1.raw
  modified_base (159)..(159): a, c, t, g, unknown or other
  misc_feature (159)..(159): n is a, c, g, or t
  modified_base (175)..(175): a, c, t, g, unknown or other
  misc_feature (175)..(175): n is a, c, g, or t
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
  modified_base (816)..(816): a, c, t, g, unknown or other
  misc_feature (816)..(816): n is a, c, g, or t
tcagtcgtcgctcgcacgaccggtgctcgattttagagtatacataagttagggggtttggggaccctaaaaaaaccacgtaccccttccttgggaggatttcccctagatcacagcccctaacaccatggactgggacctggagctattccttttccnggtgcagcagtcaacnggtcgcccactcccagtactcaacctggtgcagtcnggacctgaggtnaacgacgccgtcgggtcctcggtgtaaggtctccgtagacgagggtaccttcgtacggttaactacgttttccgacgtacgtacgtactcgaaggttcgggtacgtacggtaaccgtacgggtacctttacgggaacgtaacggggtccttaggaacggtagggaacgtaggggacgttcgggaccgtaccttaccggaacgtaaacggaaacgtgtaggtaacgttagtcggtacgtaacggttacgttcgaacggtactaacggttaaccgtttaccgtacgtaacccgtagtaaccggtactacggtaacgtaaccgggacgggtactaaccgtcggtaacccgttaacgtttacgggaaaccttcggtaaaccgtaaacctaaggttaaacgaaacgtaccgggtaacgtaaaacggaccggtaaccgaaattaacggttaaatttacgtacggtcgaacgttaccgggtagggttcgggtacttacgttagtaacttaaccgtttaacgttacgtttacttacgtttaccttcggtaacgggtactacggtagggaaccgtacggaactaccggactaccggttaccncgtactacccg

SEQ ID NO: 235586 - DNA, 949 bp, Homo sapiens
  misc_feature: GYAE6OF02FSOPK.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcctggggcctcggtgaaggtctcctgcagggcctctgggttactagtttttccgacttatagtatcgtaaggttggggtcgcgaaccgtagggtcccccgttttaggggaacccaaaagggggttccgtttacgggtacgggttacggggtaagtttgggggggtaaacttcggggggaccccggtaacccggttttccggaccggtaaaaccggggaaaaggtacgtaggggtaaggttaagttcggggtaccgtaaggggttaaactttttaccggaaggggtaccgtaaacggtaaagtttaaccccgtttacggaacccaaacggtaacgtaaaccttccgaaacgttcccggtaaccggggacctaaccgtaacggtaccccgtttaaccgtttacggggaaaccttacgggaacgggtaaccccgttagggaaacggtaaacggttacgggaaccggaaccggaacccgggtcccgaaacgtaacgttaaacgttttaacgtttcgggttaacggtaccgggtaacgggttacggggtaacggggggttaccgttaggtttttaaccggttaacggtaaaccctttaaacgtttaaaccgtttaacgtttttaacgtttacgttttaccggttacgggttaccggtttacgggtaccgggggttaacgtaaaaccggggtaccgtaacccggggttaacctaacccggttacccctaccccggtacggtaacccccg

SEQ ID NO: 235587 - DNA, 730 bp, Homo sapiens
  misc_feature: GYAE6OF02IQXYU.21.67.G01.1.454.CMB.1.raw
  modified_base (512)..(512): a, c, t, g, unknown or other
  misc_feature (512)..(512): n is a, c, g, or t
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtcgtggacctgaggtagaagaacgccgtggggcctcggtagaaggtcctcctgcgacggcctcgtaggttacttagttttccgactataccgacggcacacgtcctactggaactgacggaacctgacgaatggacgacgaccggacacacgttattattgtgcgagaggtggggctagttgtagactactacttattacttcttacgttcggtacgtcgtacggggactaaacggggaccgtacggtaccgacccgtttcctacccgtacgtccctacccgtaaccggaaccgggtcccaagttcccgttcccgttcccccggnggtcccgtcccgttacgcccttaccggacggacgtccgacccgttccgaacggtaccgacccaacggacccgggttcccggaccccgggttcgggacccttccggggtacccgttcggggtaaccgaacggttacccgttaccgtttccccgtacggttcccttacgtacccgtgggtaacccgggtccgggttcggtacgggaccgaacggggtccg

SEQ ID NO: 235588 - DNA, 1007 bp, Homo sapiens
  misc_feature: GYAE6OF02IW7YY.21.67.G01.1.454.CMB.1.raw
  modified_base (158)..(158): a, c, t, g, unknown or other
  misc_feature (158)..(158): n is a, c, g, or t
tcagtcgtcgctcgcacgaccggtgctcgatttagagtatacatattgggtttggggacccaaaaaccacaccccctccttgggagattcccctagatcacagcccctcaccatggactggacctggagcattccttttcctggtggcagcagcaacnggtgcccactcccagactcaactggtgcagtctggacctgaggtgaagaagccgtggggcctggtgaaggtcttccgtggcgacgggccttcgtaggttacttagttttaccgattatagtatcgaggttcgggtgacgacgtacggtcccttagggaccgtaagggtctttaggaaggttcggggtaagttcgggggtaggtaccggggtaccccgggtaccggttttccgggaaccggtaaaacggggtaaaacggtagtacggggtaaggttaacgtttgggtaccgtaaacgggtttaaacgttttaccggaacggggtactaaacgggtttaaacctttacccgtttacggtaacccctaacgtaacggtaacccttaccggaacttaccccgggaaaccggggaccctaaaccgtacggttaaccccgtttaaccggttttaaccgggaaacggttaccgggttaaacggtaaaccccggttaagggtaaaccgggtaaaacgggttcccgggggaaaaccgaacccgggaacccggggaaaccccctaaacttaacgggttttaaaactttaacgggttttaggggaccggttaacccgggtaaccggggttttagggggggttaccgggggtaacttttaacggggtttttacgggttaaaccgtaaacccgttttaaacgttaacccgttttaaacttttaccggtttttaaccgtttttacgtttaaccggggtaaccgggtttccgggttaagggggtaaaccgtaaacggggaccccgtttaggggaccccctttaaaccgggtacccccttaccccgggtaaacccttcccccggg

SEQ ID NO: 235589 - DNA, 849 bp, Homo sapiens
  misc_feature: GYAE6OF02IBX2D.21.67.G01.1.454.CMB.1.raw
  modified_base (110)..(110): a, c, t, g, unknown or other
  misc_feature (110)..(110): n is a, c, g, or t
  modified_base (233)..(233): a, c, t, g, unknown or other
  misc_feature (233)..(233): n is a, c, g, or t
tcagtcgtcgctcgcacgaccggtgctcgatttagagtatacatattgggtttgggggacccaaaaaccacacccctccttgggagattcccctagatcacagccccctnaccatggactggacctggagcatccttttcctggtggcagcagcaacaggtcgcccactcccagactcaacgtggtcgctagtcgtaggaccgtggaggtgaagagtccgtggggcctcgggngaagtctcgtgcgacgggtcctcgtcgttactacggttttccgactagtattatcgtagttagggtgacgacgacggtcccgttaggaccgtaagggacttggacggttgggagtcggggtaggtcggggtaccccggtaccgttacggaaccggaaccggggtaaaaggtagttacgggtaagtagtcgggtacgtaggtaaacgtttcgggaaacggacgtaagttaaacgtttaccgttagaacccgtaacgtaacggtcctaccgtaaacgtacccggtacgggacacccgttaacgtacccgtttaacggttaccgtaaacggtcgtaaaccggtaacgtttacggaaggtaaaccggtagggaaccggtaaccgtaccggtaccaacgtaagtttaacgttacgtacggttaccggtcgggtaccgggtagggttacgggggtaccttacggtttacgggtaacgttaacgttaccgttaacgttagttttaacgtttacggttttacggttcgggtaaccggttacgggtaacggggttaaccggaacccggttacggtaccggtacccggttaaccccggttcccgtacccccggtcgtaacccccgg

SEQ ID NO: 235590 - DNA, 828 bp, Homo sapiens
  misc_feature: GYAE6OF02HU65Z.21.67.G01.1.454.CMB.1.raw
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagaacgccgtcggggaccgtcggtagaaggttcctccgtgcgacgggcctcgtggttacgttacgttttaccgacttatagtactacgtaggtttagggtcgacggtaaccacgggtccccgttaggaacgaagggtcttaggacggttagggaacgttggggaggtcgggtacccggtaccgtttacggacgtaaaccggtaaagacgttagggaaggttagtacgggtacgtaaggtaacgtttacggaaggacgtaagttaaacgttaccttaacggaaccctaagaacgacgttacgtaacgtccgtaaccggaccaccgtacgtaccgtacgttaacggtaacgttacggaacggtaaccctaaggaacgtaagtacggaacgaaccggtaaccggtaccgaacttaaacgttattacgtttaggtacgtcggtaacgggtagggtcggggtaacttaggttaacgttacggtaacctttaacgttaccgttaagttttacgttttaacgtttccgttaaagggttaccgttacgggtaaggggtaacccgtaaaaccgggcccggttaaccgggtacccgttaaccccggtttaccctaccccggtaccgtacccccgg

SEQ ID NO: 235591 - DNA, 730 bp, Homo sapiens
  misc_feature: GYAE6OF02FE6MR.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcctggggcctcggtgaaggtctccgtgcagggcctctcggttactgtttttccgactatagtatcagttgggtgcgacgaggcccttggaacaagggccttggagtggatgggatgggccgaaccgtttcgacgaacggaaagcgtaggtagtagtggttccaaggtaactttcgagggctagaacttaccgtttgaaccctacgacggaactcgtaatcccgtaacggggcctaaccgacgtacccgttaacgttcgggtaaactacggggaacgtaaacccgtagaacgtaaacgttacgggaaccgtaaccgaacggttacccgaacgtaacttagttactcgggttagaccggacgtagggtacgggggtcttacgtttagtaccgtaagtaccctttaacgtaactttttattaacccgttcgtttaacgggtacccttaccggtcgggggtaacctaaaacggggccctaaccgggttaccctaacccggtccccggttaccccgacgtaacccccgg

SEQ ID NO: 235592 - DNA, 722 bp, Homo sapiens
  misc_feature: GYAE6OF02HS7YZ.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcgggtgaaggtctcgtgcgaggctcgtggtactagttttccgactagtagtatcgtaggttgggtgcgactacggtccgttggacgtaaggcgttggaggtcggagtgggagtcgggaccgtaccgttcgacgtaacggaacgagtaggtagtacgtggtactaaggtaacgtttcggaaggtacaaggtaactttaccgtagaccagtacgacgtacgtactaccggacggcaacgtacgtaccgttagttacggaacgttacggaacggtaaccgtaggaacgtaagttcggaaccgaccgtaaccggacctaacgtaagttacgtttacgtacggtaggtacccgacggtaggggttacggggtacgttacgtttagggtaacgtaacgttaacttaacgttacttacgtttacttacggttcggtacggttcggtacgggtaaccgaacggtacccggacggttaccgtacccggttacccgtcccgtagtaacccccgg

SEQ ID NO: 235593 - DNA, 737 bp, Homo sapiens
  misc_feature: GYAE6OF02HPHQ7.21.67.G01.1.454.CMB.1.raw
  modified_base (294)..(294): a, c, t, g, unknown or other
  misc_feature (294)..(294): n is a, c, g, or t
  modified_base (372)..(372): a, c, t, g, unknown or other
  misc_feature (372)..(372): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctccgtgcagggtcctcgttggttactagtttttccgactagtagtatcgtaggttgggtgcgacgnggtcccttgggacctaagggcttaggaggttcggaagtggggagtcgggccgtaccgttcggacgaaaccgggaaagngtgggaagtagtgggtacaaggtaagtttcggagggtccaaggtaactttaccgtacggaacccaagacggtactcgaacgttacccggaacgggtccaacgaccggtacctttaccgtttaacggaaacgttcggaaacggtaaccttaggaacggtaagtacgggtaacggaccgtacggaccaacgtaagttacgttatttcggacggacgtacggagggtgggggtactagttttacggagtaccttaacgttacgttatttactttaccgtttacggttacgggtcgttacggtaggggtaaccggtaaacgggtcccgtaccgggacctacccggttccctacccggaccgtaccccgg

SEQ ID NO: 235594 - DNA, 877 bp, Homo sapiens
  misc_feature: GYAE6OF02IGM7H.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctgggagcatccttttcctggtggcagcagcaacaggtgcccactcccagactcaactggtgcagtcgtggacctgaggtagaagaagtccgtgggtcctcgggtagaacggtctccgtgcgacgggtccttcgttggttaccttagttttaccgacgtactagtatcgtaggttggtcgacgtacgtacgggtcccgttaggaaccgaaggggtcttggaggtggtagtcggggtaggtccgggtaccggtaccgttacggaccgaaacgggtaaacgaggttagggtaacgttacggttacggtacgtaacggttaacgttacggtaggtaacctaaggtttaaccttaccggttacgtaaccgacgtacgtaacctactaccgtaccggtaacggtacaccgtacgttacccttaacggttacggtaaacgtcgggtaaaccggtaaccggttaggaaactaaccggggtacggtaaacccgaacggtaaccggtacccctaagtttaaacgttcgtttttaaccgttaacggcgggtaaccgggttcggtaacggggttaccggggaatttaaccgggtttagttaaacccggtacgtttaaaccgttagtttaacccgttttacgtttaacgggtttccttaacgggggttaccggttaaccgggttacgggtaacccgggaaacggttaccccggttaacggtaccccggttaaccccggttccctaacccccgggtattacccccggg

SEQ ID NO: 235595 - DNA, 910 bp, Homo sapiens
  misc_feature: GYAE6OF02IM1MU.21.67.G01.1.454.CMB.1.raw
tcagtcgtcgctcgcacgaccggtgctcgatttagagtatacatattgggtttgggggacccaaaaaccacacccctccttgggagcttcccctagatcacagcccctcaccatggactggacctggagcattccttttcctggtggcagcagcaacaggtgcccactcccagactcaactggtgcagtctggacctggaggtagaagaacgccgtaggggcctcggtaggaaggtcctacccgtgacgacgggtcccttcgtaggtttacctacgtttttaccgactacgtaccgaccgggtacaaccgacgtccgttacgttaggaaaccgtaggtaacggaacccgtaggaagtaacgtagggaacccgaaccgaccgggtaccacgtaatttaacgttagttaggtcgaccggcggtaagggtcgggggacttagtttaggtaagtaaccttaacgttaacttaagtttaacttttaaccgtttcgttaacgggtacgttacggtacgggggaactaaaacggggtacccgacgggttacccaacccggtttaccctacccccggaagtacccccgttaacccgaacccggtaaaccggggacccctaaggttacccggtttaccccgttaccccccggtacgggtccccgtccccgttaacgggccccttaacccggtaacgggtacccgttaccccggtaaccggaacgtaccgaccgtaacccggtaccgggcccggtaccccggttagggggcccttaccgggtcccgttacgggtaaccgtaccgggttaaccctttacccgttccccggttaaccgtttcccgttaacccgttaccggttacgggaccggggttacccgggacggtttaccggggaacccgttacggggacccctaacgg

SEQ ID NO: 235596 - DNA, 955 bp, Homo sapiens
  misc_feature: GYAE6OF02G89KS.21.67.G01.1.454.CMB.1.raw
tcagtcgtcgctcgcacgaccggtgctcgatttagagtatacatagttggggttggggacccaaaaaccaacacccctccttgggagagttcccctagatacacagccctcaccatcggactggaccctggtagctatccttttcctggtggcagtcagcgaaccagggtcgcccactcccagactcaacctggtgcagtcctggacctggaggtagaacgaggccgtggggccgtcggtacggaaggtcctacgtggccagggtcctacgtcggttacctaggttttccgtacgttagtacgtactactacggttacgggtacgtacgacgtacgggtcccctttgggaaccgtaacgggtaccgttagggacggtacgggtacggttacggggtaacggtccggggtacccggtaacccgtttccggaaccggtaaaccggggtaaacggtaccgggtacggtaacggttaacgggttaccgggttaaccggtaaagggttaacgtttaccggtaacggggtaccgtaaacggttaacggtttaacccttacgggaaaccccgtaacgtaaccggtaaccgtacctaaccggttacccgaaccgggtaccaaccgtaccgtaacccgttacgttaccgggaaaccgttcgggaaaccggtaaaccgttaggaaacggttaaacggaccggggttaaaccgaaccggttaacccggaacccgttaacgtaaccgttaagtttacggtaacggtacgtaccgggtacggttaacggggttcgggggtaaccttaacggttttaacggtaaccggtaacgttaaaccggttacttaacgttaccgttttaacgttccggttaaccgggtacggtttacgggtaaccgggaacggtaacccggggttaccctacgggtaacccgtacccgtttacccgtaccccggatacccccggg

SEQ ID NO: 235597 - DNA, 637 bp, Homo sapiens
  misc_feature: GYAE6OF02I7OJU.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatcctttcctggtggcagcagcaacaggtgcccactcccagactcaactggtgcagtctggacctgaggtgaagaagcctggggcctcggtgaaggtctcctgcgagggcctctggttactgttttccgactactaccacggcacagcctactggaactgacggacctgagaatggacacgacggccacatattagtgtcgcgcgaggtcggggctagtttgtacgtactacctacttattactttacttcgttggacgttcggtagggacgaaacggggacctaacgggtcctaccggtcctccccgaggccctaccaaccgaacgggcccagtaccggtcccttccccgtggccgtccctcgtccgtccgacggcgtccaccgtccgagtacgccaacgacggtcccggcctgggacctcgccgtgtaccgaacggtcctaaccgttcccctcgttcctaccgttaccgtacggacggtccggtaccgtacggaccgaacggtccg

SEQ ID NO: 235598 - DNA, 689 bp, Homo sapiens
  misc_feature: GYAE6OF02GRSNY.21.67.G01.1.454.CMB.1.raw
  modified_base (548)..(548): a, c, t, g, unknown or other
  misc_feature (548)..(548): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaacgccgtggggcctcgggtgaacggtctcctgcagggcctcgtggttactcgtttttccgactatagtatctaggttgggtgcgacacgggtcccttggacgaacgggtcgttaggaggttgggagtagggggcgtcgggggccccgtaccgttccggacgaaacgggaaacgaggtcggaggtacgtgggttacgaagggttactttcggagggtaccaaggttaactttaccgttagacccacgacacctcactaccgaccgacacgcgtaccctagttacggaactcggaacggaacctaggaagaacgtacggacgacggaccgaccacgtatacgttntgcgcgtcggagggtgggtatgtttacgacgtacttaacgtacttactttagtttcctttcggtaggtcgttacgggtacgggaccggtaacgggtacccgtacggtacccgtacccgtccctacccggtaccgtcccccg

SEQ ID NO: 235599 - DNA, 869 bp, Homo sapiens
  misc_feature: GYAE6OF02JYEIE.21.67.G01.1.454.CMB.1.raw
  modified_base (156)..(156): a, c, t, g, unknown or other
  misc_feature (156)..(156): n is a, c, g, or t
  modified_base (238)..(238): a, c, t, g, unknown or other
  misc_feature (238)..(238): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacnggtgcccactcccagactacaactggtgcagtctggacctgaggtgaagagccgtggggaccgtcggtagaacggtcttccnggacgacgggtccctgttacggttaccttacggtttttacccgaacttataggttatacgtaggttgggtacgcggtacgacgggtccgttaggaaccgtaagggtcgttaggtaggttacgggtacggttaggggtaacgggttccgggaccccgggtaacgttcccggtaaaccggtaaaaccgggtaaggtaaggtaacgggtaaggtcgttagggtaacggtaagttaacggtttgacgggttaacgaacgttaaccggttaccttaacggaacccaacgtagaaccttaaccgacctaccgggccggtacaccgtaacgtacccgttacgtttaaccggaacgtaacgggtaacctaaaccggtagtacgttaacgacgggtaccgacgtaccgaacctacgttaacgttattacggttacgtacgggacgtcggggtacggggtaggggttacgttacgtttagggtaaaccgtaaccgtttaagtaaccgttttaaacgtttacctttacgttttacgggttacggtaacggttttccggggtaacggggtaacccgttaaaggggtccccgtttaggaccccggttaacccggtttaccccgacccggttacccgtaacccgg

SEQ ID NO: 235600 - DNA, 690 bp, Homo sapiens
  misc_feature: GYAE6OF02GRPWA.21.67.G01.1.454.CMB.1.raw
  modified_base (339)..(339): a, c, t, g, unknown or other
  misc_feature (339)..(339): n is a, c, g, or t
  modified_base (352)..(352): a, c, t, g, unknown or other
  misc_feature (352)..(352): n is a, c, g, or t
tcagtcgtcgctcgcacgaccggtgctcgatttagagtatacatattggggtttgggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcgggtgaaggtcctcctgcgagggtcctcgtggttactaggtttttccgactacgtaccacggggcacgacgacctacgttggaacctgaaggaacctgagatggacgacgacgccanatattatgtgcgngaggtgggggctagtttgtagtactactacttattattacttcgttgggtacgtcgtgggacgaaacgggtaccgacggtcgaccgttcctaccccgacgtccctacccgaacccgaaacggggcccctagtccgggttccttcccccgtaggcccgtcccgtcgctcccgaggtacgccaaccctccgaacggacgaccgacgacggtcccgggtcccgtcggggaccgttcgcccggtgggtaccgtaacggtacccggttaaccctttcccgttacccgttccttcccgttacgtcgggacgggtccgggtacgtcgggacccgtaagggcccgg

SEQ ID NO: 235601 - DNA, 995 bp, Homo sapiens
  misc_feature: GYAE6OF02GZEGK.21.67.G01.1.454.CMB.1.raw
  modified_base (197)..(197): a, c, t, g, unknown or other
  misc_feature (197)..(197): n is a, c, g, or t
tcagtcgtcgctcgcacgaccggtgctcgatttagagtatacatattgggtttggggacccaaaaaccacacccctccttgggagattcccctagatcacagcccctcacccagtggacctggacctggacgcattccttttcctggtcggcagcagcaacaggtcgcccactcccagactcaacgtggtgcagtcnggtacctggaggtagaagaacggtccgtcggggccgtacgggtacggtaacgggttcctccgtggccgtacgggtcccgttcgttacgggtttaccttacggtttttaccgaacttaacgtaacgttacgttaccgtaggggtttaggggtaccgacggtaaccggtaccgggttccccgttagggtaaccggtaacggggtctttaacgggtaggtacggggtaggtagggggtacggtaccggggtacccggtacccggtttaccggaacgaaaccgggtaacgggacgtacgggtaacggtttacggtcgggttaacgttaacggggttaacgtttacgggaacgggtaccgtaaaggtttaaaccgttaccggttacgaacccgtaacggtaccgtacctaccgtacgtacccgaacgggtacccaacgttaccggtaacccgtttcggttaaacgggtaaaccggtacggtaaccgttaaaccggtaggtaaaccggtaacggttaacccgggtaaacccgaaacccgggaaccgtacccctaaacggttaatttacgttttacggtacggtccggtaccggtaacggggtaagggttccgggtaacgtttacggtttaaccgggtaacgtttaaccttaaacgtttaccgttttaagttttaccgtttaccccgtttaggggttacgtaacccggggtttacgggttaccggggttaaacgaaccccgggtaacccgttaccgggtcccctttaacccggaacccccgttaccccgggccttaaccccccgg

SEQ ID NO: 235602 - DNA, 895 bp, Homo sapiens
  misc_feature: GYAE6OF02HNRBW.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtcgcccactcccagactcaactggtgcagtctggacctggaggtagaaggaacgccgtggggccctcgggtgaacggtcctacgtggcgacggggtcccttacgtaggtttaaccgtacgtttttacccggaacttacgtaaccccgtaaccgggggtacctaaccgtaacggtaccccgttaaccgtttacggaaacgttacggaaccgggtaaacctaggtaacggaaagttacgggaaccgaccgaacccggacctaaccgtaatttaacgttaacgttggtacggtaccggacgtacgggtacggggggtactaagtttttacggtaaggtaaccttaacgttacgttaatttaacgttttaacctttccgtagggtaccgttgtaacggggtacgaaaacggggtaccacggtaccctaacccgggttccgtaccccgtacgtacccccgtaaccgtaaccccggtaaaccggggtacccctaacggttaccccggtttcccggtttaccccccgttacgggacccccggcccgttccggtaccctacccgaacgggacgtacccgtaacccggtaccgaccggacgaccgaaccgtaacggcccgggtacccgtcgggactccggtaccgtacgggtacaacgggtaccttaacccgttcccgttccggttacccttacgttaaccgtacggtaccggtaccgggacggttaccggacctaacgggtacgg

SEQ ID NO: 235603 - DNA, 783 bp, Homo sapiens
  misc_feature: GYAE6OF02HGQEC.21.67.G01.1.454.CMB.1.raw
  modified_base (141)..(141): a, c, t, g, unknown or other
  misc_feature (141)..(141): n is a, c, g, or t
  modified_base (161)..(161): a, c, t, g, unknown or other
  misc_feature (161)..(161): n is a, c, g, or t
tcagtcgtcgctcgcacgaccggtgctcgatttagagtatacatattggggtttgggggacccaaaaaccacacccctccttgggagattcccctagatcacagcccctcaccatggactggacctggagcatcctttccnggtggcagcagcaacaggtncccactcccagactcgaactggtgcagtctggacctgaggtgaagagccgtggggcctcggtgaaggtctaccgtgcgacgggtccttcgtaggttacctacgttttaccgagtagtagtactacggtaggttaggtgaccgtacgacggtacccgtaggacgtagggtcttggagtggtagtcgggagtcgggacccgtacgtcgaacgaaacgggaagagtacggtatacgtaggtacgaacgggttaacgttcggaacggtactaaacggtaactttaaccgttacgaaccgtaacgtaacggtacctacgtaacgacccggtaacgggtactaacgtaacgggtacccgttaaacggttacggaaaccggtacgggtaaaccgtaccggtaaggtaacggttaacggacggtaaccggaaccgtaaaccggtacctaacggtaattaacggttacgttaggtaaccggcgggtacggaagggtcgggtacttaacggttaggtaacgaccttagttaaccttagttaacctttcggttactcgggttaacggtaggtacgggaacgtaaggggtacccgtacggtacccgtaccgtacccggttaccacccggtaccg

SEQ ID NO: 235604 - DNA, 856 bp, Homo sapiens
  misc_feature: GYAE6OF02G77OM.21.67.G01.1.454.CMB.1.raw
tcagtcgtcgctcgcacgaccggtgctcgatttagagtatacatattgggtttggggacccaaaaaccacacccctccttgggagattcccctagatcacagcccctcaccgatggactggacctggagcatccttttcctggtggcagcagacaacgaggtcgcccacctcccgagactacaaccgtggtcgcacgtctcggtacctggaggtagaagaagtccggtgggcctcgggtagaacggtctcctagcgacggtcctcgtgttacgttcgttttaccatatagtctcgtaggttggtcgcgaccgtacggtcccttagggaacgtaacgggtcttaggtaggtaggtacggtaggggagttccggggacccgttcccgttaacggacgtaaacggtaaagcggtagggagtttacgcgggtaagtacggttaacttacgggaggacgtaagttaacgttccgttagaacccacgtaacgactaccgtactaacccggtacggaccgtaacaccggtaaccttacggttacggaaaccggtaggtaaaaccggtaaccggtaaggaaacggtaacggtacgggaaacccgtaaccggtaacccgaaccccgttaaagtaacgtttagttacggttaggccgtacgggaccgggtaggggtttcggggtaacttaggttaacgttaccggaaactttaacgtacgttttaacgtttacgttttaacgtttccggttaaccggttcggtttaaccggggtaacgggttaacccggttaaacccggtaacccgggttacccggttacccggtaaacccggtttcccccggtaccccgtaaccgttccccccgg

SEQ ID NO: 235605 - DNA, 757 bp, Homo sapiens
  misc_feature: GYAE6OF02GZO44.21.67.G01.1.454.CMB.1.raw
  modified_base (507)..(507): a, c, t, g, unknown or other
  misc_feature (507)..(507): n is a, c, g, or t
  modified_base (530)..(530): a, c, t, g, unknown or other
  misc_feature (530)..(530): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgacagtctggacctgaggtgaagaagccgtggggcctggtagaacggtcctccgtgcgacgggtcctcgtcggttacctacgtttttcccgacttagttagtacttcgtaggtttgggtcgccggtacgtacggtacccctttaggggaaaccgtaagggtcctttaggaggttcgggtagtggggtacgtcggggtcccgtaccgttccggacggaaacggtaagtcgtagggtagtacgtagggtacgtaagggttatttcggaagggtcaagttaacttaccgtacgaacgtacgacggtactacgactccgacgactaccngtcctagtcgaacgtgacgacgngaacgagtacggacgacgtacgaccaacgtagtattgtacgtggacgtcgggtaggtaggggtactacggtttacgtaccgttaacggttaaccttacgttaacgtttacgtttaccgttaccggttaaggtacccggtttaagggaccggggttaaccgtaacggggtaccccgtacgggttacccctaccccgggttacccctacccggtaccgtaaccccccgg

SEQ ID NO: 235606 - DNA, 775 bp, Homo sapiens
  misc_feature: GYAE6OF02HZEV3.21.67.G01.1.454.CMB.1.raw
  modified_base (139)..(139): a, c, t, g, unknown or other
  misc_feature (139)..(139): n is a, c, g, or t
  modified_base (142)..(142): a, c, t, g, unknown or other
  misc_feature (142)..(142): n is a, c, g, or t
tcagtcgtcgctcgcacgaccggtgctcgatttagagtatacatattgggtttggggacccaaaaaccacacccctccttgggagattcccctagatcacagcccctcaccatggactggactgagcatctttctgtgnagnagcaacaggtgccactccagactcaactggtgcagtctggacctgaggtgaagaagcctagggtcctggtacgaaggttcctcgtgaccgagggcctcgtggttacacgttttcgactataccgacggcacgtacgcctaacgttcggaacgttacggtaaggaacctacggaacgtaaacgtcggtaaacgaacgtaaccggtaccaacgtaattaacgttaagttcgtaggtaccggtcgaaggttacggggtaactaaggtttacgtaaccggtaaccgttaaacgttaacgttaagtttaaacgttacctttacgttacgggtaacgttcggaggggtaactaaagggtaccgaaccggttacctaaccggtacgtaccccgaacgttcccgtaccgtaacccgtaacgggtaccctaagttcccggttaaccttccccgttacggtacccgtaccgtcggaccttaccgaccgttaagccctaaccggttacgaccggttaacgacgtaccgacggtccgacgtacggaccgtacgtacgtacgacgtacggtaacctacccggttaccgtacgtccgttaccgtagtacggtacggaccgggtacctacgggtaccgtaaggtaccg

SEQ ID NO: 235607 - DNA, 901 bp, Homo sapiens
  misc_feature: GYAE6OF02JY2M9.21.67.G01.1.454.CMB.1.raw
  modified_base (180)..(180): a, c, t, g, unknown or other
  misc_feature (180)..(180): n is a, c, g, or t
  modified_base (851)..(851): a, c, t, g, unknown or other
  misc_feature (851)..(851): n is a, c, g, or t
tcagtcgtcgctcgcacgaccggtgctcgatttagagtatacatattgggtttggggacccaaaaaccacacccctccttgggagattcccctagatcacacgcccctcaccatggactggacctggagcacttccttttcgtggtggcagcagcaacgaggtcgcccactcccagactnaacgtggtgactgtcgtcggactgaggtaagaagccgttaggggccctgggtcgtaacgggtcgtccgtcgttagggcccttcgtggttaccagtttttcccgacttagttagtacttctagtttggggtgtacggactaggtccccttaggggaccaagggggctttcgggacgttggggatggggtaagtcggggccggacccgttacggacgtaaaccggaaggggacttaggacggttatagggggttaaccttgggaaagggttttccaagggggttaacttaaccggttaagttaacccggtacgtaaaccggtacctacgggtaaaacccgtcgaaccggggttaaccgtaaccggggtacctaccgtaaacggtcccggtaaacgttacgggaacgttaaacccgggtaaccgtagggaaacggtataaccggggtacccgaaaccggtacgggacccgtaacacgttaaacgttacggtacggtaggcggtaacgggtacgggttcggggacttagttttacgggtaagtaaccgttaaccgttaaccttaaaggtttaccgtttaccgtttacgggttaccggtaaccgtttacgggaaccggggttccgtaaaacgggttaccccggttacccggtaacccttaccccggggttaacccnccccggtaaacggttccccccggtaaccgggaaccccggttaacccgggg

SEQ ID NO: 235608 - DNA, 421 bp, Homo sapiens
  misc_feature: GYAE6OF02HNK6R.21.67.G01.1.454.CMB.1.raw
  modified_base (353)..(421): a, c, t, g, unknown or other
  misc_feature (353)..(421): n is a, c, g, or t
tcagtcgtcgctcgcacgaccggtgctcgatttagagtatacatattgggtttgggggacccaaaaaaccacacccctccttgggagattcccctagatcacagcccctcaccatggactggacctggagcatccttttcctagtggcagcagcaacaggtgcccactcccagactcaactggtgcagtctggacctggaggtgaagaagccgtggggcctcgggtgaacggtctccctgcgaggggccctcgtacgggtttacctaggttttttcccgattagtagttatcctaggttgggtggcgtacgacggtcccgttggaccaaaggggtcttcggaggttaggggcnnnnnnnnnnnnnnnnnnnnnnnnnnnnnnnnnnnnnnnnnnnnnnnnnnnnnnnnnnnnnnnnnnnnn

SEQ ID NO: 235609 - DNA, 680 bp, Homo sapiens
  misc_feature: GYAE6OF02GWTN1.21.67.G01.1.454.CMB.1.raw
  modified_base (275)..(275): a, c, t, g, unknown or other
  misc_feature (275)..(275): n is a, c, g, or t
  modified_base (280)..(280): a, c, t, g, unknown or other
  misc_feature (280)..(280): n is a, c, g, or t
  modified_base (502)..(502): a, c, t, g, unknown or other
  misc_feature (502)..(502): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctctgcagggcctctggttactgttttccatatagtatcagttggtncgacnggccttggacgagggcttggagtggagtcgggagtcgggccgtaccgttcggacgaacggaaagagtcgggagtatggtagaaggtaatttcgagggtactaagtaacttacgttagaccgtaagacggactcgactaccgacgggtcaacgtacgtcctacgtacgaacgtgacggtaaccgtagaaggtaacgtaggacggtaacgaccggtaccgtaanaagttattagttggtacgcggtacggtagggtcgggggtactacgtttaggtaacgtacgttaaccgtaacgtttagttacgtttaacgttcggttcggtaacggttccggtacggggaaccgtaaacgggtaccgtaccgggttaccgtaccggttcccgtaccgtacccgtacccg

SEQ ID NO: 235610 - DNA, 669 bp, Homo sapiens
  misc_feature: GYAE6OF02HM5DX.21.67.G01.1.454.CMB.1.raw
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
  modified_base (484)..(484): a, c, t, g, unknown or other
  misc_feature (484)..(484): n is a, c, g, or t
  modified_base (493)..(493): a, c, t, g, unknown or other
  misc_feature (493)..(493): n is a, c, g, or t
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagacctcaactggtgcagtctcggacctgaggtgaagaagccgtggggcctcggtgaaggtctcctgcacgggccttcgtggttactacggtttttccgacttagtagtatctaggttgggtgtccgaacgtggccccgttaggaaccgaagggtcttaggaggtcggagttggggaagtcgggcccgtaccgttcggacaacgggaaagacgtaggtagtagtagggtacaggtaattcgaggtcaagtacttacctgaccanagactnactccgacggcacacgtacctacgtagaacgtcggacgtaaccgngaacgtagngaacgacgaccggactacgtatagttatggacgcggtacgaggtcgggtatagttagaagtaactacttagttaattagttacgtttcgtaacggtacgttacggtaacggggtaaccgaaacgggtacccgtaacgggtacccgttaccggttacccgtacccaccggtaccccg

SEQ ID NO: 235611 - DNA, 353 bp, Homo sapiens
  misc_feature: GYAE6OF01C2N93.23.17.B06.1.454.CMB.1.raw
  modified_base (350)..(353): a, c, t, g, unknown or other
  misc_feature (350)..(353): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggagggggagagcttgactgctggggccagggaaccctggtcaccgtctcctcagcctccaccaagggcccatcggtcttccccctggcgccctgctccaggagcacctccgagagcacagcggccctgggctgcctggtcaaggactacttccatactcgcgtctgagcgggctggcaaggcgcatagnnnn

SEQ ID NO: 235612 - DNA, 371 bp, Homo sapiens
  misc_feature: GYAE6OF01A9OP0.23.17.B06.1.454.CMB.1.raw
  modified_base (364)..(371): a, c, t, g, unknown or other
  misc_feature (364)..(371): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggagggggagagctttgactgctggggccagggaaccctggtcaccgtctcctcacgcctccaccaacgggcccatccggtccttccccctggccgccctgcctccaggacgcacctccgagacgcacagccggccctgggctcgcctggtcaaggacctacttccatactcgcgtctggagcgggctggacaaggcgcatagnnnnnnnn

SEQ ID NO: 235613 - DNA, 356 bp, Homo sapiens
  misc_feature: GYAE6OF01E23SF.23.17.B06.1.454.CMB.1.raw
  modified_base (352)..(356): a, c, t, g, unknown or other
  misc_feature (352)..(356): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggagggggagagctttgactgctggggccagggaaccctggtcaccgtctcctcagcctccaccaagggcccatcggtcttccccctggcgcccctgctccaggagcacctccgagagcacagcggccctgggctgcctggtcaaggactacttccatactcgcgtctgagcgggctggcaaggcgcatagnnnnn

SEQ ID NO: 235614 - DNA, 356 bp, Homo sapiens
  misc_feature: GYAE6OF01EEZLR.23.17.B06.1.454.CMB.1.raw
  modified_base (346)..(346): a, c, t, g, unknown or other
  misc_feature (346)..(346): n is a, c, g, or t
  modified_base (351)..(356): a, c, t, g, unknown or other
  misc_feature (351)..(356): n is a, c, g, or t
tcagacgcgagtatcacgaccggtgctcgatttagtcgatagtgaagggccggattcaccatctccagagacaacgacaagaactcactgtatctgcaaatgaacagcctgagagccgaggacacggctgtgtattattgtgcgagagacaggtccagaaaggagggggagagctttgactgctggggccagggaaccctggtcaccgtctcctcagcctccaccaacgggcccatcggtcttccccctggcgccctgctccaggagcacctccgagagcacagcggccctgggctgcctggtcaaggctacttccatactcgcgtctgagcgggctggcaaggcncatgnnnnnn

SEQ ID NO: 235615 - DNA, 357 bp, Homo sapiens
  misc_feature: GYAE6OF01BQ2KO.23.17.B06.1.454.CMB.1.raw
  modified_base (352)..(357): a, c, t, g, unknown or other
  misc_feature (352)..(357): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggagggggagagctttgactgctggggccagggaaccctggtcaccgtctcctcagcctccaccaagggcccatcggtcttccccctggccgccctgctccaggagcacctccgagagcacagcggccctgggctgcctggtcaaggactacttccatactcgcgtctgagcgggctggcaaggcgcatagnnnnnn

SEQ ID NO: 235616 - DNA, 354 bp, Homo sapiens
  misc_feature: GYAE6OF01BSRM1.23.17.B06.1.454.CMB.1.raw
  modified_base (351)..(354): a, c, t, g, unknown or other
  misc_feature (351)..(354): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggagggggagagctttgactgctggggccagggaaccctggtcaccgtctcctcagcctccaccaagggcccatcggtcttccccctggcgccctgctccaggagcacctccgagagcacagcggccctgggctgcctggtcaaggactacttccatactcgcgtctgagcgggctggcaaggcgcatagnnnn

SEQ ID NO: 235617 - DNA, 357 bp, Homo sapiens
  misc_feature: GYAE6OF01A66JV.23.17.B06.1.454.CMB.1.raw
  modified_base (351)..(357): a, c, t, g, unknown or other
  misc_feature (351)..(357): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggagggggagagctttgactgctggggccagggaaccctggtcaccgtctcctcagcctccaccaagggcccatcggtcttccccctggcgccctgctccaggagcacctccgagagcacagcggccctgggctgcctggtcaaggactacttccatactcgcgtctgagcgggctggcaaggcgcatagnnnnnnn

SEQ ID NO: 235618 - DNA, 363 bp, Homo sapiens
  misc_feature: GYAE6OF01AQ2OY.23.17.B06.1.454.CMB.1.raw
  modified_base (252)..(252): a, c, t, g, unknown or other
  misc_feature (252)..(252): n is a, c, g, or t
  modified_base (350)..(350): a, c, t, g, unknown or other
  misc_feature (350)..(350): n is a, c, g, or t
  modified_base (356)..(363): a, c, t, g, unknown or other
  misc_feature (356)..(363): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggagggggagagcttgactgctggggccagggaaccctggtcaccgtctcctcagcctccaccaagggcccatcggtccttccccctggccnccctgctccaggacgcacctccgagacgcacagccggcccctgggcctgcctggtcaaggctacttccatactcgcgtctgagcgggctggcaaggcncatagnnnnnnnn

SEQ ID NO: 235619 - DNA, 714 bp, Homo sapiens
  misc_feature: GYAE6OF01DOXAW.23.17.B06.1.454.CMB.1.raw
  modified_base (690)..(690): a, c, t, g, unknown or other
  misc_feature (690)..(690): n is a, c, g, or t
tcagacgcgagtatcacgaccggtgctcgatttagtcgatagtgaaggggtcgtcagagaggaggtccttagccctggacttccaaggcctttccacttggtgatcagcactgagcacaggaggactcaccatggaagttggggctgagctgggtttccttgttgctatttagaaggtgtccagtgtgaggtgcagctggtggagtcgtgggggagcgttggtccaggccgtgggggtccctggagactctacctgtgcagcctcgtggattccaacctttagtacctagttggatcgaaccgtaggggtcccgtaccgaggcctccgaaggggaacggggctaggacggtggggtagaccctaacgtaagtaacggacaagacgtgggaaggttacgaagtaaagtactagtaggtacgggactcgtgtaggaacggggtaccttaagtttccgaacctagttcccgtacccgaaaggtacgaaaccgaaacgaacgaaaagtacctccctaagttacggtactcgtagtaactaaagtcggaaacgacggtacctagggaacggtacgacccgggtaagacccgtacggccttaggtaacgttactttaacggttcgtacggtaccggtaagggtaccggaccggtaacgggttacccggaaaggggtaaacgggggacgggggtaanaacggttcgtttacggaacccggg

SEQ ID NO: 235620 - DNA, 356 bp, Homo sapiens
  misc_feature: GYAE6OF01CP7F5.23.17.B06.1.454.CMB.1.raw
  modified_base (353)..(356): a, c, t, g, unknown or other
  misc_feature (353)..(356): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggagggggagagctttgactgctggggccagggaaccctggtcaccgtctcctcagcctccaccaagggcccatcggtccttccccctggccgccctgctccaggagcacctccgagagcacagcggccctgggctgcctggtcaaggactacttccatactcgcgtctgagcgggctggcaaggcgcatagnnnn

SEQ ID NO: 235621 - DNA, 606 bp, Homo sapiens
  misc_feature: GYAE6OF01BBG6C.23.17.B06.1.454.CMB.1.raw
  modified_base (533)..(533): a, c, t, g, unknown or other
  misc_feature (533)..(533): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagcgtggtttctgttagctatttagaaggtgtccagtgtgaggtgcagctggtggagtctgggggagcttggtccagccgtggggggtccctgagactctcctgtgcagcctctggattcgacctttagtacctattggatgacctgggtccgccaggctccgaggggaagggcgtgggaggtgggtcggaccaagagtaaggacaagagtggaggtagaagtaaatactatgtggactctggtaggaaggccgattaccacctatcctaccgaagacgaaccaaacgaacaaagaacctacaccttagtacttcgtagaactaaagtacgaacgacgtcctaggaacggaccgccggaacggacgtacggcttaggtagttatttgttaggnggtccggaaggagaacggtaggtacccgaaaaggggtaaagggggagggggaataacggtttcgtttggacgg

SEQ ID NO: 235622 - DNA, 357 bp, Homo sapiens; identical to SEQ ID NO: 235617
  misc_feature: GYAE6OF01BYBUE.23.17.B06.1.454.CMB.1.raw
  modified_base (351)..(357): a, c, t, g, unknown or other
  misc_feature (351)..(357): n is a, c, g, or t

SEQ ID NO: 235623 - DNA, 364 bp, Homo sapiens
  misc_feature: GYAE6OF01BYN9B.23.17.B06.1.454.CMB.1.raw
  modified_base (358)..(364): a, c, t, g, unknown or other
  misc_feature (358)..(364): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggagggggagagctttgactgctggggccagggaaccctggtcaccgtctcctcagcctccaccaagggcccatccggtcttccccctggccgtccctgctccaggagcacctccgagagcacagcggccctgggctgcctggtcaaggctacttccatactccgcgtctgacggcgggctggcgaaggcgcaatagnnnnnnn

SEQ ID NO: 235624 - DNA, 588 bp, Homo sapiens
  misc_feature: GYAE6OF01AO1BM.23.17.B06.1.454.CMB.1.raw
  modified_base (334)..(334): a, c, t, g, unknown or other
  misc_feature (334)..(334): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagctctcctgtgcagcctctggattcacctttagtacctattggatgacctggggtccgccaggctccaggggaagggcgtggaggtgggtggccaanataaggcaagagtggaggtgaagaaatactatgtggactacgtgtagaaggggccagttccaccattcctaccgaggaacgtaacgaacgaacaaagaacctacgaccttaggtactcgtaggacctaaatgaaacacggtcctaagaagcgccgaacgggacacgggcttaggtcgttattattaggtcggtacgaggtagaccgaggttacccaagggaaaacggggtgggggaatacgtcggtttgaccgg

SEQ ID NO: 235625 - DNA, 403 bp, Homo sapiens
  misc_feature: GYAE6OF01DADFW.23.17.B06.1.454.CMB.1.raw
  modified_base (394)..(403): a, c, t, g, unknown or other
  misc_feature (394)..(403): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtcagaaagggagggggagagctttgactgcgtggggccgacgggaaccctggtcaccgtctcctcacgccctccaccgaacgggcccagtccggtccttcccccgtggccgccctcgcctcccgaggacgccaccgtccgagacgccaccaggccggccccgtggggcctggccctggtacaaggacctacgttccatacctccgcgtcgtgaggcgggctcgggacaagggcgacagtagnnnnnnnnnn

SEQ ID NO: 235626 - DNA, 354 bp, Homo sapiens
  misc_feature: GYAE6OF01BM5JX.23.17.B06.1.454.CMB.1.raw
  modified_base (342)..(342): a, c, t, g, unknown or other
  misc_feature (342)..(342): n is a, c, g, or t
  modified_base (348)..(354): a, c, t, g, unknown or other
  misc_feature (348)..(354): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggagggggagagctttgactgctggggccagggaaccctggtcaccgtctcctcagcctccaccagggcccatcggtcttcccctggcgccctgctccaggagcacctccgagagcacagcggccctgggctgcctggtcaaggactactccatactcgcgtctgagcgggctggcaaggcncatagnnnnnnn

SEQ ID NO: 235627 - DNA, 364 bp, Homo sapiens
  misc_feature: GYAE6OF01ETU3N.23.17.B06.1.454.CMB.1.raw
  modified_base (274)..(274): a, c, t, g, unknown or other
  misc_feature (274)..(274): n is a, c, g, or t
  modified_base (358)..(364): a, c, t, g, unknown or other
  misc_feature (358)..(364): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggagggggagagctttgactgcgtggggccagggaaccctggtcaccgtctcctcagcctccaccgaacgggcccagtcggtccttcccccgtggccgcccctgcctccagganccacctccgagagcacagcggccctgggctgcctggcaaggctactccatactcgcgtctgagcggctggcaaggcacatacgnnnnnnn

SEQ ID NO: 235628 - DNA, 364 bp, Homo sapiens
  misc_feature: GYAE6OF01DC4FP.23.17.B06.1.454.CMB.1.raw
  modified_base (344)..(344): a, c, t, g, unknown or other
  misc_feature (344)..(344): n is a, c, g, or t
  modified_base (360)..(364): a, c, t, g, unknown or other
  misc_feature (360)..(364): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggagggggagagctttgactgcgtggggccagggaaccctggtcaccgtctcctcagcctccaccgaacgggcccatccggtccttcccccgtggccgccctgctccgaggacgccacctccgagagcacaggccggccctgggctgcctggtcaaggctactccatactcgcgtctgagcggntggcaaggcgcatagnnnnn

SEQ ID NO: 235629 - DNA, 538 bp, Homo sapiens
  misc_feature: GYAE6OF01CEAF6.23.17.B06.1.454.CMB.1.raw
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggagcttggtccagccgtggggggtccctgagactctcctgtgcagcctctggattcacctttagtacctattggatgacctgggtcccgccaggcctccgagggaaggggctgggaggtgggtcggccaagataaggcgaagatagggagtgagaaatactagtggtagactcgtgtgaagggccgtattcaccatctccagagacaacgacaagaactcactgtatctagacaaatagaacagaccgtagaacgacgccggaagacgacggtctagtgtattagtgtagcgagagacgaggtaccaaggaagggagggagagtgttgacg

SEQ ID NO: 235630 - DNA, 359 bp, Homo sapiens
  misc_feature: GYAE6OF01CTN8S.23.17.B06.1.454.CMB.1.raw
  modified_base (347)..(347): a, c, t, g, unknown or other
  misc_feature (347)..(347): n is a, c, g, or t
  modified_base (353)..(359): a, c, t, g, unknown or other
  misc_feature (353)..(359): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggagggggagagctttgactgctggggccagggaaccctggtcaccgtctcctcagcctccaccaagggcccatccggtcttccccctggcgccctgctccaggagccacctccgagagcacacgcggccctgggctgcctggtcaaggactactccatactcgcgtctgagcgggctggcaaggcncatagnnnnnnn

SEQ ID NO: 235631 - DNA, 722 bp, Homo sapiens
  misc_feature: GYAE6OF01BUUU6.23.17.B06.1.454.CMB.1.raw
  modified_base (342)..(342): a, c, t, g, unknown or other
  misc_feature (342)..(342): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccaggccgtggggggtccctgagactctcctgtgcagcctcgtggattctacctttagtaccttattggatgaccgtgggtccgccaggcctccgaggggagggcgtggaggtgggtcgccgaanagtaaggacaagtagtgggaggtagaagtaaatacgtagtggtggtaactcgtaggtaggaacggggtcctaacgttcgaaccctagttcccgtaccgaaggacgaaaccgaaacgtaaaccgaacggaaacctactaccgttagtaactacgtacgaactaaacgttacgaaacctacggacccgtaaggaaccgggaacggtaacccggaacgggtaacccggaaccgggtcgttaacgggttacgtttaacgttttaaggtttacggtaggaaccgggtaagtaacggggtaaccgaaccggggttaacccggaaaagggggtaaaaccgggggtaaggggggaaccgtaagggttaccggtttacggtaaaccggg

SEQ ID NO: 235632 - DNA, 559 bp, Homo sapiens
  misc_feature: GYAE6OF01C83RK.23.17.B06.1.454.CMB.1.raw
  modified_base (330)..(330): a, c, t, g, unknown or other
  misc_feature (330)..(330): n is a, c, g, or t
  modified_base (342)..(342): a, c, t, g, unknown or other
  misc_feature (342)..(342): n is a, c, g, or t
  modified_base (423)..(423): a, c, t, g, unknown or other
  misc_feature (423)..(423): n is a, c, g, or t
  modified_base (543)..(543): a, c, t, g, unknown or other
  misc_feature (543)..(543): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagcttggggttttccttgttgcttattttagaaggtgtccagtgtgaggtgcagctggtggagtcgtgggggaggcttggtccaggccgtggggggtccctggagactctcctgtgcacgcctctggattcaccttttagtaccttattggatgaccgtgggtccgccaggcctccgagggagggctggngtgggtgccaanataaggcaagagtggaggtagaagaaatactagtggtgactctggtagaagggccattcaccatctccagagaacaacganaacgaactcactgtactcagacaaatacgaacacgacctagacgagccgaggacacggctagtcgttattagttgtcgacgaggacgacgacggtacgaaagggaaacggggaggggganacggtgtttggaacgg

SEQ ID NO: 235633 - DNA, 700 bp, Homo sapiens
  misc_feature: GYAE6OF01BZ7QW.23.17.B06.1.454.CMB.1.raw
  modified_base (171)..(171): a, c, t, g, unknown or other
  misc_feature (171)..(171): n is a, c, g, or t
  modified_base (180)..(180): a, c, t, g, unknown or other
  misc_feature (180)..(180): n is a, c, g, or t
  modified_base (305)..(305): a, c, t, g, unknown or other
  misc_feature (305)..(305): n is a, c, g, or t
  modified_base (332)..(332): a, c, t, g, unknown or other
  misc_feature (332)..(332): n is a, c, g, or t
  modified_base (365)..(365): a, c, t, g, unknown or other
  misc_feature (365)..(365): n is a, c, g, or t
  modified_base (441)..(441): a, c, t, g, unknown or other
  misc_feature (441)..(441): n is a, c, g, or t
  modified_base (493)..(493): a, c, t, g, unknown or other
  misc_feature (493)..(493): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagcggtggtttcgtgtaggctattagaggtntcagtgtgnggtgcagcgtggtggagtcgtgggggagctttggccaggccgtggggggtccctgacgcttctccgtgcgcagcctgtggtacttctacctttagtaccttagttggatggaccgttcgggtccnccgaggtcctaccggaaggggacgggngtgggtaggtggggacgaccaaagagtaagganaaagggtgtaggtaggtagaaagtaactagtagtaggtacgtactcgtaggtacggaacggtccgtatccaccgtntccgacgagaaccgaaacaaacgacgaaactacctcgtacgttagttaaccngttaacgaacgtaaacgtaacgaaaccgtaacgtaccggtaacggtaacggaacgggaaccgggaacggtaaccggtaccggtacgttacggtttaggtttaacgtttagttaggttacggtacggtaaggaacggacggtaacgggtaaacgggaaacggggtaaagggggaagggggtaacgggtacggttcggttagggtacgg

SEQ ID NO: 235634 - DNA, 564 bp, Homo sapiens
  misc_feature: GYAE6OF01BA2HL.23.17.B06.1.454.CMB.1.raw
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattccaccttttagtacctatttggatgacctgggtcccgccaggctccgagggaaggggctgggagtgggtggcccaacgataaggcaaaggatggaggtgaagaaatactatggtggactctgtggaagggccgattccacctatctccagacgacaacgacaagaactacactgtatctagacaagtacgaacagcctaggagagaccggaaggaccgaacgggcgtaggttgtaattattgtggcggagagacgacgggtaccgaagggaaaggggagggggaagaggtcgtttggtaccg

SEQ ID NO: 235635 - DNA, 364 bp, Homo sapiens
  misc_feature: GYAE6OF01E0RC8.23.17.B06.1.454.CMB.1.raw
  modified_base (355)..(364): a, c, t, g, unknown or other
  misc_feature (355)..(364): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggagggggagagctttgactgctggggccagggaaccctggtcaccgtctcctcagcctccaccgaagggcccatccggtcttccccctggcgcccctgcctccaggacgcacctccgagagcacagcggccctgggctgcctggtcaaggctacttccatactcgcgtctgagcgggctggcaaggcgcatagnnnnnnnnnn

SEQ ID NO: 235636 - DNA, 555 bp, Homo sapiens
  misc_feature: GYAE6OF01CP6ZT.23.17.B06.1.454.CMB.1.raw
  modified_base (530)..(530): a, c, t, g, unknown or other
  misc_feature (530)..(530): n is a, c, g, or t
  modified_base (532)..(555): a, c, t, g, unknown or other
  misc_feature (532)..(555): n is a, c, g, or t
tcagacgcgagtatcacgaccggtgctcgatttagtcgatagtgaaggggctggagtgggtggccaacataaggcaagatggaggtgagaaatactatgtggactctgtgaagggccgattcaccatctccagagacaacgacaagaactcactgtatctgcaaatgaacagcctgagagccgaggacacggctgtgtattattgtgcgagagacaggtccaagaaagggagggggagaggctttgactgcgtggggccgagggaaccctggtccaccgtctcctcacgccctccaaccgaacgggccccagtccggttcccttcccccgtcgggccgtccccgtcgccgttccgaaggacgccacccgtccgagacgccaacgacggcccgggcccgtggggcctcggtcccgttacgggtaccggaaaacgggtaccttacccgttaccctaacgttaacccgtccggtcggttccgttagggacgggccggggtaccgtgggaacggaacgggccgtacgagtaagngnnnnnnnnnnnnnnnnnnnnnnnn

SEQ ID NO: 235637 - DNA, 771 bp, Homo sapiens
  misc_feature: GYAE6OF01DK7XV.23.17.B06.1.454.CMB.1.raw
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcacgcctcgtggattccacctttagtacctattggatcgaccgtgggtccgcaggcctcgaggggaaggggctgggaggtggggtcggaccaaacgaagtaagggcaaagagtagggaggtagaagtaaaatacgtaagtggtaggaccttcgtggttaggaaggggcccgtaatttccaacccgtaattaccctacccaaggaacgaaaccaaaccggaacaaaacggtaaacctcctaacgttaggttaacttaccgtaggtaacctaaaaagtacggaaacctaaggaccccgttagggaaacggtaccgggaccccgggaaacggggaaccgtaacccgggggttccttaagggtttacggtttaaagttttaacggttttgggtaccgggtaaccggaaaggggtaaccggtaaaccgggtaaacggggttacccggaaaaggggggtaaaaaacgggggggaacggggggggtaaggtaaaccgggttcggtttttaacgggtaaacccggggg

SEQ ID NO: 235638 - DNA, 725 bp, Homo sapiens
  misc_feature: GYAE6OF01DM7J2.23.17.B06.1.454.CMB.1.raw
tcagacgcgagtatcacgaccggtgctcgatttagtcgatagtgaaggggctcagagaggagccttagccctggactccaaggcctttccacttggtgatcagcactgagcacagaggactcaccatggaattggggctgagcgtggtttctgtgctatttagagtgtcagtgtgaggtgcagcgtggtaggagtcggtgggggagtcgttggtccaggccggttcggggggtccctggacgaccttcctccgtgtgccacgccttcgtggtactttcctaccttttacgtaccttagttggatcgtaccgttcggggtcccgccgacggtcctacggagggggaaggggcgtgggaggttggggtacgaccaaagagtaacggacaagagtaggggaggtagaaagtaaacttacgtagtaggtcggtacttagtaggtacgggaacggtcccgttattacccgaacctacttaccgaccgaaggaacgaacccgaaaacgtaacaaacgtaacctacccgtagttacgttaatacccgtagaaacctaaaggttaacgaacgacgaccgtaggaacggacggtacggaacggaccgtacgggtgttaggttacgttaagttcgttacggtacgacggtaaaggaacggtaacggtaccgggtaaacggaaaaggggggtaaagggggtacgggggatttacggttcggtttacggtaccgggg

SEQ ID NO: 235639 - DNA, 450 bp, Homo sapiens
  misc_feature: GYAE6OF01E31SQ.23.17.B06.1.454.CMB.1.raw
  modified_base (272)..(272): a, c, t, g, unknown or other
  misc_feature (272)..(272): n is a, c, g, or t
  modified_base (297)..(297): a, c, t, g, unknown or other
  misc_feature (297)..(297): n is a, c, g, or t
  modified_base (430)..(432): a, c, t, g, unknown or other
  misc_feature (430)..(432): n is a, c, g, or t
  modified_base (434)..(450): a, c, t, g, unknown or other
  misc_feature (434)..(450): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacgaggtccaaggaaagggagggggagagtcgtttgacgtggcgtggggccgacgggaccctggtccaccgtctcctcacgccctacccaaccgaacgggccctagtccggttcccttcccccgngggcccgcccctgcctccgaggacncctaccgtaccgagacgaccacgacgccggcccgtgggcctcgccgtggacgaacggtaccttacctacctacttaccgtcgtccgtcgtcggacggtcgggtcgtcggggaccgaacgggccgacgagtagnnnannnnnnnnnnnnnnnnn

SEQ ID NO: 235640 - DNA, 648 bp, Homo sapiens
  misc_feature: GYAE6OF01EL9GJ.23.17.B06.1.454.CMB.1.raw
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggagcttggtccagccgtggggggtccctgagactctcctgtgcagcctctggattctacctttagtaccttattggatgaccgtgggtccgccgaggcctccggaagggggacggggctgggaggtggggtcggaccaaacagtaaggcaagagtgggaggtagaagaaatactagtggtaggactcgtaggtggaacgggcctattacacctatcctccgaagaacgaacaaacgaacaaacgtaactcaacgttgtactctagaacaaattcgaacagcctaggaaggacgacccggaaggaccacgggtacttaggttacgttaagtttaggttggtacggacggtaagggtaaccggtaaccgtaacggggtaacccgaaaaggggggtaaaacggggggaaggggggaaagtagggtttaccgtttgggaaccgg

SEQ ID NO: 235641 - DNA, 529 bp, Homo sapiens
  misc_feature: GYAE6OF01D2O6Z.23.17.B06.1.454.CMB.1.raw
  modified_base (298)..(298): a, c, t, g, unknown or other
  misc_feature (298)..(298): n is a, c, g, or t
  modified_base (331)..(331): a, c, t, g, unknown or other
  misc_feature (331)..(331): n is a, c, g, or t
  modified_base (445)..(445): a, c, t, g, unknown or other
  misc_feature (445)..(445): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
  modified_base (481)..(481): a, c, t, g, unknown or other
  misc_feature (481)..(481): n is a, c, g, or t
  modified_base (517)..(517): a, c, t, g, unknown or other
  misc_feature (517)..(517): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactctcctgtgcagcctctggattcacctttagtaccttattggatgacctgggtccncaggctcgagggagggctggagtgggtgccaanataaggcaagatgggagtgaagaaatactatgtggactctggtgaagggccattcacctatctaccaagacgaacaacgacaaagaactcactgtactctagacaaatcgaacngcctgagacgccgaaggacaggctgtntattnttgngcgaagagacgaggtaccaagggaaagggagggganacgtgttgacgg

SEQ ID NO: 235642 - DNA, 751 bp, Homo sapiens
  misc_feature: GYAE6OF01AJ81T.23.17.B06.1.454.CMB.1.raw
tcagacgcgagtatcacgaccggtgctcgatttagtcgatagtgaaggggctcagagaggagccttagccctggactccaaggcctttccacttggtgatcagcactgagcacagaggactcaccatggaagttggggctgagtcgttgggtttttccttgttgcttattttagaaggtgtccagtgtgaggtgcagcgtggtggaggtcggtgggggagtcgttggtccgaggtccggttcgggggggtcccctggacgtaccttccgttccgtggtcgccacgtccttcgtggtactttcctaacctttttacgtaccttagttggattcggacccgttggggtccccgccgaggcctaccggaaggggaacggggtcgtgggacggttgggtcggaccaaagagtaaggcgaagagtggaggtagaaagtaaactagttagtaggtggtacttcgtaggtacgggaacgggtcccgtattacccacctactccgtaccgtaaggaaccgaaaccgaaaccgaacgtaaacgtaaacctaccgtaacgttcgtaacgttacgtacgaactaaaacgtacgaaaccgtacgtaccgtaggaacggtacgggaccggaacggaccgacggtcgtaggttagttagtttagtggtacggtacggaaggtacggaccggtaacgggttaaaccggaaagggggtaaaagggggtaaggggggtaagtacgggttacggtttaacggtaccggg

SEQ ID NO: 235643 - DNA, 361 bp, Homo sapiens
  misc_feature: GYAE6OF01ATUS0.23.17.B06.1.454.CMB.1.raw
  modified_base (349)..(349): a, c, t, g, unknown or other
  misc_feature (349)..(349): n is a, c, g, or t
  modified_base (354)..(361): a, c, t, g, unknown or other
  misc_feature (354)..(361): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggagggggagagctttgactgctggggccagggaaccctggtcaccgtctcctcagcctccaccaagggcccatccggtcttccccctggcgccctgctccaggagccaccctccgagagcacagcggccctggctgcctgtcaaggactacttccatactcgcgtctgagcgggctcggcaaggcganatagnnnnnnnn

SEQ ID NO: 235644 - DNA, 416 bp, Homo sapiens
  misc_feature: GYAE6OF01A928M.23.17.B06.1.454.CMB.1.raw
  modified_base (370)..(372): a, c, t, g, unknown or other
  misc_feature (370)..(372): n is a, c, g, or t
  modified_base (374)..(416): a, c, t, g, unknown or other
  misc_feature (374)..(416): n is a, c, g, or t
tcagacgcgagtatcacgaccggtgctcgatttagtcgatagtgaagggccgagttcaccatctccagagacaacgacaagaactcactgtatctgcaaatgaacagcctgagagccgaggacacggctgtgtattattgtgcgagagacaggtccagaaaggagggggagagctttgactgctggggccagggaaccctggtcaccgtctcctcacgcctccaccaagggccccagtccggtcttcccccgtggccgcccctgcctccaggacgcacctccgagagccacagccggccctgggctgcctggtcaaggctactccatacctcgcgtctggacgcggggctgggcaagggtccgcagtagnnngnnnnnnnnnnnnnnnnnnnnnnnnnnnnnnnnnnnnnnnnnnn

SEQ ID NO: 235645 - DNA, 680 bp, Homo sapiens
  misc_feature: GYAE6OF01AXKW4.23.17.B06.1.454.CMB.1.raw
  modified_base (177)..(177): a, c, t, g, unknown or other
  misc_feature (177)..(177): n is a, c, g, or t
  modified_base (182)..(182): a, c, t, g, unknown or other
  misc_feature (182)..(182): n is a, c, g, or t
  modified_base (320)..(320): a, c, t, g, unknown or other
  misc_feature (320)..(320): n is a, c, g, or t
  modified_base (553)..(553): a, c, t, g, unknown or other
  misc_feature (553)..(553): n is a, c, g, or t
  modified_base (663)..(663): a, c, t, g, unknown or other
  misc_feature (663)..(663): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaagttggggctgagcgtggtttcgtgtgctattagagtgtcagtgtgngtgcngcgtggtggagtcgtagggggagtcgttggtccaggtccggtggggggtccctggacgtccttcctccgtggtcgcgtacgtcctcgtggtacttcctacctttagtaccttagttggattcggccgttcgggtcccnccgacggtccgtaccggaaggggacgggtcgtagggacgggttcgggtacgaccgaaacgtaagtaacggacgtaaggtagtaggggaggtaaggaaagtaaacttacgtagtcggtacgtacgttcgtaggacggacggtactacgtacctacctagtccgtaacgagaaccgtaacgaaacggtaacaacgtacctgtacgtagtacgtctaagaactaaagtcgtaaacncgccgtaaggacgaaccgggtaccggaaggacctcgggtacttagggttactttagttcgtaggcggaacggtaagaccgaggtaacggagaaaggggacgggaagggtntacgttgtcggtaacgg

SEQ ID NO: 235646 - DNA, 735 bp, Homo sapiens
  misc_feature: GYAE6OF01CS8MW.23.17.B06.1.454.CMB.1.raw
  modified_base (344)..(344): a, c, t, g, unknown or other
  misc_feature (344)..(344): n is a, c, g, or t
tcagacgcgagtatcacgaccggtgctcgatttagtcgatagtgaagggctcagagaggagccttacgccctggactccaaggcctttccacttggtgatcagcactgagcacagaggactcaccatggaattggggctgagcttgggttttccttgttgcttattttagaaggtgtccagtgtgaggtgcagcgtgggtggagtcgtgggggagtcgttggtccaggccggtggggggtccctgagcctctcctgtcgcacgcctcgtggtacttcctaccttttagtaccttagttggattcgaccgttgggcccaccgaggcctaccggaggggaacgggntagggaggtggggacgacccaaagagtaaaggcaaaggtagtagggaaggtagaaagaaatactaagtggtacgggtaacttcgtaggtacgggaaacggggcctaactttaccaacctactttacccgacccgaaggaacgtaaaccgaaaaccggaaacaaaaccggtaaacctactaaccgttaggttaacttccgtaacggaacctaaaagtacgaaaccgtacgacccgttaagggaccggaacgacccgggaaaggttaccgaccgggacttggttaattacgtttaagttggtaaggacggaaaggacgtaaccggtaaggggtaacccgaaaagggggaaaacgggggaggggggtaaatacggttaccggtttggaaccggg

SEQ ID NO: 235647 - DNA, 364 bp, Homo sapiens
  misc_feature: GYAE6OF01EIXB8.23.17.B06.1.454.CMB.1.raw
  modified_base (354)..(354): a, c, t, g, unknown or other
  misc_feature (354)..(354): n is a, c, g, or t
  modified_base (358)..(364): a, c, t, g, unknown or other
  misc_feature (358)..(364): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggagggggagagctttgactgctggggccagggaaccctggtcaccgtctcctcagcctccaccaacgggcccatccggtccttccccctggccgccctgcctccgaggagccaccgtccgagacgcacgagccggcccctgggctgcctggtcaaggctacttccatactcgcgtctgagcggctggcaggcnatgnnnnnnn

SEQ ID NO: 235648 - DNA, 710 bp, Homo sapiens
  misc_feature: GYAE6OF01BIXEZ.23.17.B06.1.454.CMB.1.raw
  modified_base (302)..(302): a, c, t, g, unknown or other
  misc_feature (302)..(302): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagcgtggtttcgtgttgctatttagaaggtgtcagtgtgaggtgcagctggtggagtcgtgggggagcttggtccagccgtggggggtccctgagactctcctgtgcagtcctctaggacttactaccctttagtaccttatggatcgaccgtgggtccccncgacggctaccgaggggagggcgtgggaggtggggtcggaccaaacgtagtaaaggacgaaggtagtaggggaggttagaacgtaaatacgtatgggtagacttcggtagtagggaaacgggccgtaacttacccgaaccaacgttccgtacccgaagaacgaacccgaaacgaaacgaaacgttaacccttaccgaacgtttcgttaacgttaccgtagtaacctaaagttacgaaaccgtacgtacctacgggaagaaccggaccgggaagaccgtaacggcgttaaggtcgtttaagtttacgttaggtggtaccgaaagggtaccgtaacggtacgggttaacccggaaaggggtaaacgggggggaaagggtagggaacgtttccgggttaaggtacccgggg

SEQ ID NO: 235649 - DNA, 746 bp, Homo sapiens
  misc_feature: GYAE6OF01C2WGY.23.17.B06.1.454.CMB.1.raw
tcagacgcgagtatcacgaccggtgctcgatttagtcgatagtgaaggggctcagagaggagccttagccctggactccaaggcctttccacttggtgatcagcactgagcacagaggactcaccatggaagttggggctgagcgttggtttcctgttgctatttagaggtgtcagtgtgaggtgcagcgtgggtggagtcggtggggggagtcgttggtccaggtccggtggggggtccctggacgtctctcctggtcgcacgtcctcgtggtactttccaccgttttagtaccttagttggactggacccgtgggtcccgaccgaggcctaccggaaggggaggggcttgggaggtgggtcggaccaaacgtagtaaggacaaggagttagggaggtagaaagtaaatacgtagtaggtacggtacttacgtggtacgggaacggtccgtaacttaccgaaccctacgttaccgtaaccgaaggaacgtaaaccgaaacgtaaaccgaaacggtaaccttacgtaacgttacggttaacttacccgtaagtaacgtaaacggttacgaaacgacgtacccgttaaggaccgggaaccggtaccgggaacgggaaccgtaaccgggtcgtttaacggttagtttacgtttagttaggtacggtaccggaaagtacggaacggtaacgggtaaccggaaaggggtaaacgggaagggggtaagtacggttaccggttggaaccggg

SEQ ID NO: 235650 - DNA, 761 bp, Homo sapiens
  misc_feature: GYAE6OF01A9IKS.23.17.B06.1.454.CMB.1.raw
tcagacgcgagtatcacgaccggtgctcgatttagtcgatagtgaaggggctcagagaggagccttagccctggactccaaggcctttccacttggtgatcagcactgagcacagagactcaccatggaattggggctgagctgggttttcctgttgcttattttagaaggtgtccagtgtgaggtgcagctggtggagtcgtggggggagtcgttggtccaggccggttcggggggtccctggacgaccttctccgtgtgcagcctcgtggactttcctaccttttagtaccttagttggatggtaccgttcgggtcccgccgtaggccttaccggaagggggaacgggggccgggtagggtcggggtcggaacccgaacgtaagtaaacgggcaaaggagtagggaggtagaaagtaaaatacttacgtggtacgtacttcgtaggtaggaaacgggtcctagtttccgaacctacgtacctaccgacggtaacgaaccgaaaccgaacgaaaacggtaacctacgtaacgttacgttaactcgtagtaacccgtaaagtacgaaaccgacggtacccgtaaggaacggtacgggacccggaacggggtaaccgaccgggttccgttagggttaaacgtttagtttacggtttacgtagggtaggaacggtaaggaaaccggtacggttaaccgggaaaaggggtaaaacgggggaggggggtaacgaacggtttacggtttaggtacggtaccggggg

SEQ ID NO: 235651 - DNA, 608 bp, Homo sapiens
  misc_feature: GYAE6OF01DABSS.23.17.B06.1.454.CMB.1.raw
  modified_base (483)..(483): a, c, t, g, unknown or other
  misc_feature (483)..(483): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattgggggctgagcttgggttttccttgttgcttattttagaaggtgtccagtgtgaggtgcagcgtggtggagtcgtgggggaggcttggtccaggccgtggggggtccctgacgactcctcctgtgcacgcctctggacttcctaaccttttacgtaccttagttggatcgtaccgtgggtccgccaggcctaccggaggggaggggcgtgggaggtgggtcggaccaaacgtaagtaaggcaagagtagggaggtgaagtaaaatactagtgtaggactcgtggtaggaacgggccgtattaccacctatcctcccaagacgaacaacgacaaagaactcactgtatcgnacaaatgaactgctaggagacgcggaggacacgtctgttagtattagttgtagacggaagacggtaaacgacgggtaccgaaaggggaaaggggtaagggggaaggacggtcggtttaggacggg

SEQ ID NO: 235652 - DNA, 731 bp, Homo sapiens
  misc_feature: GYAE6OF01EFZXX.23.17.B06.1.454.CMB.1.raw
tcagacgcgagtatcacgaccggtgctcgatttagtcgatagtgaaggggctcagagaggagccttagccctggactccaaggcctttccacttggtgatcagcactgagcacagaggactcaccatggaattggggctgagcttgggttttccttgttgcttattttagaaggtgtccagtgtgaggtgcagctggtggagtcgtgggggagcttggtccagccgtggggggtccctgacgactctcctgtgcacgcctcgtggtacttcctaccttttagtaccttagttggatcgaccgttcgggtcccgccgaggccgtccggaagggggaacggggtcgtgggaggtcggggtcggaccaaacgtaaggtaaaggacgaaggtagtaggggaacggtagaaagtaaattaacgttagtggtacggtactcgtagggtacgggaacgggtaccgtacgttaccaccgtattcccgtaccgaaggtaacgaaacccgaaaccggaacgaaacgtaaaccttaccaacgttagttacttaccgtacgaactaaagtaccgaaaccgtcggtcccgtaaggaacggaccggaccggaagggaccgtacggtacgttggttaagttagtttaggttggtacgggtacggaaggtacggaaccggtaacgggtaaccgaaaagggggtaaacggggaggggggtagtaacggtttcggttaggtaacccggg

SEQ ID NO: 235653 - DNA, 820 bp, Homo sapiens
  misc_feature: GYAE6OF01A0K89.23.17.B06.1.454.CMB.1.raw
tcagacgcgagtatcacgaccggtgctcgatttagtcgatagtgaaggggctcagagaggagccttagccctggactccaaggccctttccacttggtgatcagcactgagcacagaggactcaccatggaagttggggctgagcttgggtttttccttgttgcttattttagaaggtgtccagtgtgaggtgcagcgtggtggagtcggtgggggaggtcgttggtcccgaggtcccggtcgggggggtcccctggacgtacctcctccgtgtggccacgtcctcgtggtacttcctaacctttagtaccttagttgtatcgtaccgtcgggtccccgccgaggccgtaccggagggggaacggggtcgtgggtaggtcggggtacggaccgaacgtagtaaaggacgaaggtaggtaggggacggtagaaacggtaaaagttacgttaaggtcggttacggtaactttcggtagggtaacggggtaacggggtacccgtaacgtttacccgaaccgttaaccgttcccgtaaacccggaaggaaaccgaaaccccggtaaaacccgaaaccgtaaaaccgtaacttaccgaaccgtttaggtaaccttacggtacaaactaaagtaccgaaacctacggtacccgtaaggaacggtaccgggaccggaaggaaccgtaccgggtctttagggttcttaaagttttcggtaggttacggaccggtaagtaacgggacccgttaaacggggtaacccgggaaaaagggggtaaacgggggggagggggaaagttaccggttaggtttccgggtaaccggg

SEQ ID NO: 235654 - DNA, 404 bp, Homo sapiens
  misc_feature: GYAE6OF01AJ5ET.23.17.B06.1.454.CMB.1.raw
  modified_base (386)..(386): a, c, t, g, unknown or other
  misc_feature (386)..(386): n is a, c, g, or t
  modified_base (388)..(404): a, c, t, g, unknown or other
  misc_feature (388)..(404): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaagggagggggagagctttgactgatggggccagggaaccctggtcaccgtctcctcacgcctaccaccgaacggacccgactcgtccgttcccctcggccgccctcgctccgacggagcaccctccgagacgccacgacggcggccccgtcggcgtcgccgtcggtcgaacggtactaccttcctactacgtcgtcgtcgtgcggcggcgtggacgaggcgcatagngnnnnnnnnnnnnnnnnn

SEQ ID NO: 235655 - DNA, 367 bp, Homo sapiens
  misc_feature: GYAE6OF01A0I4J.23.17.B06.1.454.CMB.1.raw
  modified_base (356)..(367): a, c, t, g, unknown or other
  misc_feature (356)..(367): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggagggggagagctttgactgctggggccagggaaccctggtcaccgtctcctcagcctccaccaagggcccatcggtcttccccctggcgccctgcctccaggagcacctccgagacgcacagccggcccgtgggctgcctggtcaaggactacttccatactcgcgtctgagcgggctcggcaaggcgcatagnnnnnnnnnnnn

SEQ ID NO: 235656 - DNA, 661 bp, Homo sapiens
  misc_feature: GYAE6OF01BQKZG.23.17.B06.1.454.CMB.1.raw
  modified_base (515)..(515): a, c, t, g, unknown or other
  misc_feature (515)..(515): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagacctctcctgtgcagcctcgtggattcctaacctttagtaccttagttggattcgaccgtgggtcccgcaggcctccgaggggaacggggctgggagtggggtcggaccaaacgagtaaaggcaaaggacgttaggggaaggttagaaaggtaaaattacgtaagtggtggacttcgtggtaggaaacggggcctaagtttcaacctagtcctaccgaagtaacgaacaaacgaacaaagaactccaactgtaatcgtagactaaagtcgaaacngccgtagaacgacggccggaaggaccgacgggtcttagttagttaatttacgttaggcggacggtaaggacggaaccggtaacgggtaacccgaaagggtaaaacggggggagggggttaagacggttccggtttaggaacccggg

SEQ ID NO: 235657 - DNA, 950 bp, Homo sapiens
  misc_feature: GYAE6OF01BOI5I.23.17.B06.1.454.CMB.1.raw
tcagacgcgagtatcacgaccggtgctcgatttagtcgatagtgaaggggctcagagaggagccttagccctggactccaaggcctttccacttggtgatcagcactgagcacagaggactcaccagtggtaagttggggctgagtcgttgggtttttccttgttgtcttagttttagaaggtcgtccgtagtggtggaggtgcgtagcgtgggtgggtaggtcgggtggggggacggtcgttcggtcccgacggtccgggttcgggggggtccctaggtacgtaccgttccgttccgtggtacgacgtacgtcccgttcgttaggttaacctttacccgtttaaacccgtttttaaccggttaaccctttaaggtttacgggtaacgttaccgggttaacccgggtttccgggggttcccccggacccggtaacggggtaccccggttacccggggaagggggggtaaccgggggtcggttagggggtaacggggttcgggggtaaccggaacccgtaaaaaccggtaaaggttaaaacgggaaccgtaaaagggtagggttaacgggggtaaggtaaggtaaaacgtaaaaagtttaacgttaaggttggttaaccggtacgttcggttacgggtaacgggtaaacgggtcccgttaactttacccgaacccgttacgttacccgtaacccggaaaggtaaacccgtaaaacccggaaaaccggaaaaccgtaacgtaaaccctaccgttaaccgtttaagttaaccgtacccgttaagaaaccctaaagtaccgaacgaacgtccgtaaggaaccggacggtaaccggaagggaccgtacgtggttacgtttagttagtttgtgggaacgacggtaaagacggaacgggttacggaacggaaagggggtaaaggggacgggtataacgggtttgtaacggtaccggg

SEQ ID NO: 235658 - DNA, 862 bp, Homo sapiens
  misc_feature: GYAE6OF01DS7R5.23.17.B06.1.454.CMB.1.raw
tcagacgcgagtatcacgaccggtgctcgatttagtcgatagtgaaggggctcagagaggagccttagccctggactccaaggcctttccacttggtgatcagcactgagcacagaggactcaccatggaattggggctgagcttgggttttccttgttgcttatttagaaggtgtccagtgtgaggtgcagcgtggtggagtcggtagggggagtcttggtccgaggtcccggttcggggggttccctaggtacgtaccttcctccgttggtacgcctacgccttacgtcggtacttacccgttaaccttttacgttaaccttagttggactacggtccgttcggggtcccgaccgacgggtcccgtaccgggaagggggtacggggcggtagggtacgggttcggggtcgaacccgaaacgtaaggtaacggacgaaaggtagtgggggaagttagaaagtaaactacgttaagtcggtacggtacttccggtaggtacgggtaacgggacccgttaagttacccgtaaccgtaaccgttaccctaacccggaaggtaaccggaaaccaaacggtaaccaaaacggtacctacgttaaccgttagttaacccgtagtaacgaacttaaaagtacgtaaccgaacgttccggtaaggaaaccggtacccgggtaaacccgggaccggtaacccggtaccggggttaccgtttagggttaaacgttttacgtttacggtttaccgggtaacggtaaaccggaagggtaacccggaaaggggttaaccggggaaacgtaaaacggggggaaagggggggttaacgggtacggggttaacttacgggtttaacggggacccggg

SEQ ID NO: 235659 - DNA, 900 bp, Homo sapiens
  misc_feature: GYAE6OF01B65AY.23.17.B06.1.454.CMB.1.raw
tcagacgcgagtatcacgaccggtgctcgatttagtcgatagtgaaggggctcagagaggagccttagccctggactccaaggccttttccacttggtgatcagcactgagcacagaggactcaccatggaagttggggctgagtcgttgggtttttccttggttgcttattttagaaggtgtccagtgtgaggtgcagcgttgggtggtaggttcggtggggggacgtcgttcgggtacccgacggcccgggttcggggggtcccctaggaacgtccttcgtccgtggtcgcaccggtccttgtggttacttaccgtaaccttttagtaacccttagtttaggattcggtacccggtcggggtcccgaccgaagggtcccgtaccgggaaggggggtaaacggggtccgttagggggacgggtttacgggggtacccggaacccgtaaaacgtaaacggttaaacggaaccggtaaaaggtaaggtttacggggggaaagggttaaggaaaaaggttaaaaacgtttaccgttaaagtttggggttaaccgggttaactttacgggtacgggttacgggggtaaaaacccggggtcccttaaaccggtttaacccaaacctttaccggttaacccgttaacccggaaacgggtaaaccggtaaaaccgggaaaacccggttaaaccaaaacgggtaaacctacttaacccgttagttaacctacgtagaaacgtaaatacggaaccacggtacaaggtaccggacggtaccgaacggaaccacggttcgttagtacggtttagttagtacggtcggaggttaacggacgaacgggtaaccggtaacggaaaagggtaacgggggtaacggggattaccgggttaggttaacggtacggg

SEQ ID NO: 235660 - DNA, 733 bp, Homo sapiens
  misc_feature: GYAE6OF01D53TL.23.17.B06.1.454.CMB.1.raw
tcagacgcgagtatcacgaccggtgctcgatttagtcgatagtgaaggggctcagagaggagccttagccctggactccaaggcctttccacttggtgatcagcactgagcacagaggactcaccatggaattgggggctgagcttgggttttccttgttgcttattttagaaggtgtccagtgtgaggtgcagctggtggagtcgtgggggaggtcttggtccaggcccggtggggggtccctgagctctcctgtgcagcctcgtggtacttcctacctttagtaccttagtggactcgaccgttcgggtcccgccgaggcctccggaagggggaaggggcgtgggaggtggggtacggaccaaacagtaacggacaaggagtagggaggtagaaagtaaaattcgtagtacggtaggtaaccttcgtaggtacggaacgggtcctattaccaccgtacttcctaccgaagaacgaaccgaaacgaacaaacgtaactccgtacttaggtactctagaactaaatcgaaacgacgtccgtaaggaacggaacggtcccgggaacgggtaacccgacgggttaccgttagggtttaacgtttaagttttacggttacgggtcggtaaccgggtaaggtaaacggacgggtaaacggtaacccgggaaaaaaggggggtaaacgggggggaacggggggtaagtaccgggtttaacgtttccgggtaaaccggg

SEQ ID NO: 235661 - DNA, 810 bp, Homo sapiens
  misc_feature: GYAE6OF01BMR4N.23.17.B06.1.454.CMB.1.raw
tcagacgcgagtatcacgaccggtgctcgatttagtcgatagtgaaggggctcagagaggagccttagccctggactccaaggcctttccacttggtgatcagcactgagcacagaggactcaccagtggaattggggctggagtcgttgggttttccttgttgcttattttagaaggtgtccagtgtgaggtgcagtcgtgggtggaggttcggtggggggaggtcgtttgggtccgacggtcccgggttcgggggggttcccctggtacgtaccgttccttccgttggttcggacctacggtcccgttcgttaggttactttaccgttaacccttttacggttaccttagttggtacttaccggtaccgtcgggttccccggccgtacgggtccggtaccggaaggggggtaacggggtcggttaggggtacgggtggggtccgaaccgtaaagtaaggtaaacggacaaaggtggtaaggggaaggtaagaaacgtaaattaacgtagtaggtacggtacttagtagggtacggaacgggtcccattacccgacttactccgtaccgaagtaacgaaaccgaaacgtaaacgaacgtaactacgtacttagttaacgtcgttaacgactaaacgttacgaaaccgacggtacccgtaaggaaccggtaaggaccccgggaaaggtccgtaacgggttacttacgggttagttttaacttggttaccggagtacggaagtacggaaaccgttagggaacgggtaaaagggtaagggggaacgggtatcgggtttacgttaggtacggg

SEQ ID NO: 235662 - DNA, 390 bp, Homo sapiens
  misc_feature: GYAE6OF01EWMY0.23.17.B06.1.454.CMB.1.raw
  modified_base (365)..(390): a, c, t, g, unknown or other
  misc_feature (365)..(390): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggagggggagagctttgactgctggggccagggaccctggtcaccgtctcctcagcctccaccaagggcccatccggtccttccccctggccgcccctgcctccaggacgccacctccgagagcacagccggccctgggctgccgtggtacaaggacttactccatactcgcgtctgacgcgggctggacaaggcgacaagtagnnnnnnnnnnnnnnnnnnnnnnnnnn

SEQ ID NO: 235663 - DNA, 789 bp, Homo sapiens
  misc_feature: GYAE6OF01CN2T0.23.17.B06.1.454.CMB.1.raw
  modified_base (405)..(405): a, c, t, g, unknown or other
  misc_feature (405)..(405): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattgggctgagctgggttttccttgttgctatttagaaggtgtccagtgtgaggtgcagcgtggtggagtcggtgggggagtcgttggtccaggccgtggggggtccctggacgtaccttcctccgtgtcgcacgccttcgtggtactttcctaccttttaacgtacccttagttacggtatcgaccgtcgggtcccgccgtaggccgtaccggaggggaacgggccgtagggtaggtgggtcggacctaaacgtaagtaaacgggactaaaggngttagggaaggtagaaacggtaaaacgttagtaagttacggtaggtacccttagttacgggtaagggaaaccggggtacctaactttaccccgaaccgttaacgttccccgttaaccggaaaggaccgaaacccgaaaaccggaaacgaaaacgtaaccgtacaacgtttacgtaacgttacgtacgaaacgtaaacgtacgaaacctcggtaaccctagggaacgaccggaccgggaacggacctacgggtactttggtttaagttaactttggtttaggacggtaaccgggtaaggaacccggttaacggaacccggggttaacgaaaacgggggaaaggggggtaacggggtagaacggtttccggttacggtaaccgggg

SEQ ID NO: 235664 - DNA, 595 bp, Homo sapiens
  misc_feature: GYAE6OF01CH0V5.23.17.B06.1.454.CMB.1.raw
  modified_base (181)..(181): a, c, t, g, unknown or other
  misc_feature (181)..(181): n is a, c, g, or t
  modified_base (237)..(237): a, c, t, g, unknown or other
  misc_feature (237)..(237): n is a, c, g, or t
  modified_base (547)..(595): a, c, t, g, unknown or other
  misc_feature (547)..(595): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgttattattggtgcgaagagacgaggtaccgaaggaaaaggggaggggganacgtctttgacgtggcggtagggggaccaacgggtaaccctggccaccgtcctccncgacgccctaccgaaccgaacggccctacgttcccggttcccttcccccgaggcccgtccccgtcggtacctacccggacgggaccacccgtacccgaccggaaacgcgacccgaaccggtaccgggccccggggtccccgttgggggtcccgtcgggttaccccggttaaggggaaccccgtaaaaccgggttaacccctttaccccgtacctaaccgttaccccggtacggttcccgtacggtcggggaaccggggtccgggtaccggtacgggaccgaaacgggggccttaacgaaagtcgctgacnnnnnnnnnnnnnnnnnnnnnnnnnnnnnnnnnnnnnnnnnnnnnnnnn

SEQ ID NO: 235665 - DNA, 769 bp, Homo sapiens
  misc_feature: GYAE6OF01DQNHG.23.17.B06.1.454.CMB.1.raw
  modified_base (211)..(211): a, c, t, g, unknown or other
  misc_feature (211)..(211): n is a, c, g, or t
  modified_base (664)..(664): a, c, t, g, unknown or other
  misc_feature (664)..(664): n is a, c, g, or t
tcagacgcgagtatcacgaccggtgctcgatttagtcgatagtgaaggggctcagagaggagccttagccctggactccaaggccctttccacttggtgatcagcactgagcacagaggactcaccatggaagttggggctgagtcgttgggtttttccttgttgcttagttttagagtgtccagtgtgaggtgcagcgtggtggagtcgngggggagtcgttggtccgagtccggtggggggtccctggacgtaccttctccgtgtcgcacgtcctgtcggtattccttaaccttttagtaccttagttggtaattcggaccgtcgggtccgcgacggtccgtaccggaggggagggtcgtagggagggtgggtacggaaccaaacgtaagtaacggacaaggagtagggaggtacgaaagtaaacttaacgttagtggtacggtacttacggttggtaacgggtacgggtaccttacgttaccaaccctttacgttcccaaccgtaaacggaacggaaaccgaaaaccggtaaacgtaaaacgtaaaccttccgttaaacggttagttaaaccgtttcccgtaaaggtaaaccctaaagtaacggaaaaccgccgttaaccggaacggaacgaccgggtaccggaaggtacccgtacgggtntttaggttattttaaacgttggtttacgggacgagggtaaacgcgggaaaccgttacgggacgaaaggggtaagggggaagggacctttaggtcgttaggaccgg

SEQ ID NO: 235666 - DNA, 793 bp, Homo sapiens
  misc_feature: GYAE6OF01AHYMH.23.17.B06.1.454.CMB.1.raw
  modified_base (198)..(198): a, c, t, g, unknown or other
  misc_feature (198)..(198): n is a, c, g, or t
  modified_base (369)..(369): a, c, t, g, unknown or other
  misc_feature (369)..(369): n is a, c, g, or t
  modified_base (471)..(471): a, c, t, g, unknown or other
  misc_feature (471)..(471): n is a, c, g, or t
  modified_base (628)..(628): a, c, t, g, unknown or other
  misc_feature (628)..(628): n is a, c, g, or t
  modified_base (689)..(689): a, c, t, g, unknown or other
  misc_feature (689)..(689): n is a, c, g, or t
  modified_base (731)..(731): a, c, t, g, unknown or other
  misc_feature (731)..(731): n is a, c, g, or t
tcagacgcgagtatcacgaccggtgctcgatttagtcgatagtgaagggctcagagaggagccttagccctggactccaaggtccctttccacttggtgatccagcactgagcacaggagactcaccatggaagttgggctgagtcgttcggttttcctgttgctttagttttaagaggttgtaccgtgtgtgaggtncagcgtggtcgggtagttcgggtagggggtacgttccgttcggtcccgtagggtccccgggttgggggtcccctagtaacggtccttccgtcgtcgggtctccgtaccgttccgttcggtagttaccctttaccgtttacccgtttaacgtttaccgttacgttaaccggnttacggaacccggtttcggggccccccacggtcggtcccggttacggggagggtacgggtcgttacgggtgggtcgggtaccaacgaaggtaaggtaaccgngtaaaagtcgggttgggaacggtaataaacggtaaacttcgggtagttacggtacgccgtttagttacgggtaacgggaaccgggtcttaccggtaacccctacgtacgtaccgtaccgaacgacgtaaccaaacggtaaactacgtaaccgttacncttaacggttcctacgtacgaacgtaacgacgtaacgtcgtaccgaggtacgaacccgggngaaccgggactaccggtgttacgtatttcggtagttaccggngtacgaggtcgaacggacgtaacgggaggtaccggggaattagggtcgttcgttaggtcggg

SEQ ID NO: 235667 - DNA, 449 bp, Homo sapiens
  misc_feature: GYAE6OF01BRMMG.23.17.B06.1.454.CMB.1.raw
  modified_base (414)..(449): a, c, t, g, unknown or other
  misc_feature (414)..(449): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccaggaaagggagggggagagtctttgactgcgtggggccagggaccctggtccaccgtctcctcacgtccctccgaaccgaacgggcccctagtcccgggttccctttcccccctgggcccgtcccctgccctaccgaggacgccaccctccgagacgccacgaggcccggccctggggctcgccgtggtccgaaggccttactccacttaccgtcgccgtcgtgtacggccgggtcgtggacgaacgggcacgtatagnnnnnnnnnnnnnnnnnnnnnnnnnnnnnnnnnnnn

SEQ ID NO: 235668 - DNA, 842 bp, Homo sapiens
  misc_feature: GYAE6OF01CLNHI.23.17.B06.1.454.CMB.1.raw
  modified_base (441)..(441): a, c, t, g, unknown or other
  misc_feature (441)..(441): n is a, c, g, or t
tcagacgcgagtatcacgaccggtgctcgatttagtcgatagtgaaggggctcagagaggagccttagccctggactccaaggccctttccacttggtgatcagcactgagcacagagactcacatggaagttgggctgagtcttgggttttccttgttgcttattttagaaggtgtccagtgtgaggtgcgagcgtggtggagtcgtgggggacggtcgttcggtccgacggccggttagggggggttcccctggtaacgtaccttccgttcccgttggtcgcgacgtccttacgtggtactttaccgtaaccgttttaacgtaccttaagtttggtattcggtaccggttcggtccccggaccgacgggtccgtaccggaagggggaacgggtcgtaggaggggtgggtacggacctaaagaacgtaaggacaaagggngtaaggggtaggttaacgaaaggtaaaataccgtagtacgggtagtaccgttagtaggtacgggaacggtacccgtaacgtttacccaactaacttacccgtaccgacggtaacgaaaccgtaaaccgaaacaaacggtaacctacctaacgtacgtaactcggtaactaacgtaaacgtagaaaccgtacggaccgtaaggaccgggaaccggacccgggaaaccgtaaccgggtacgggtaccgttacgggttaagtttaagtttaccgttagggtacggtacccgggtaaggaacccgggtaaacggaacccgggtaaacccggggtaaaaacggggaaagggggttaaacggggggtaagttaacccggggtttccggtttaacgggtaacccgggg

SEQ ID NO: 235669 - DNA, 735 bp, Homo sapiens
  misc_feature: GYAE6OF01AOCDF.23.17.B06.1.454.CMB.1.raw
  modified_base (224)..(224): a, c, t, g, unknown or other
  misc_feature (224)..(224): n is a, c, g, or t
  modified_base (446)..(446): a, c, t, g, unknown or other
  misc_feature (446)..(446): n is a, c, g, or t
  modified_base (640)..(640): a, c, t, g, unknown or other
  misc_feature (640)..(640): n is a, c, g, or t
tcagacgcgagtatcacgaccggtgctcgatttagtcgatagtgaagggcgttcgagagaggagccttagtccctggactccaaggtcctttccacttggtgatcagcactgagcacaggaggactcgaccatggaagttgggctgagtcttgggttttccttgttgcttagttttagaaggtgttacctagtgtgaggtgcgagcgtgggtcggaggttcggngggggagtcgttcgggtaccgtggtcccgggttgggggtaccctggaacgtaccgttccgtccgtaggttcgacgtacgtccgttgtcggtacttcgttaactttacgtacgttagtacggtcgtcggccgtttacgggccgtccgacgtacgtacggacggggaacgggtcgtcgggtaggcgggttacgacctaacgaaggttacggaacgaacggtagnggggtaacgtaggtaaaacaacgttacgttagtcggagttaacgtaccgttgggaacggtaacggtacgtagtccctaacgtacgtactaccgaaggacgtaaccgaaccgtaagaaggtactaccgtagtactacgtacctagaaccgtaagtaaccgaactcgacgaccggtacgaacggccgtaacggacnccgggtactggtaacttgtttaaacgtcggaacgtcggagcggtaacgaccgtaacgaaaggtacgggggagaacgttacgaagtcggtaacggg

SEQ ID NO: 235670 - DNA, 1011 bp, Homo sapiens
  misc_feature: GYAE6OF01AHSU9.23.17.B06.1.454.CMB.1.raw
  modified_base (255)..(255): a, c, t, g, unknown or other
  misc_feature (255)..(255): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggagttgggctgagcgttgggttttccttgttgcttattttagaaggtgtccgagtggtgaggtgcgagcgtgggtggaggtcggtggggaggtcgttcggtccacggtccgggttcgggggttcccnggtacgtcctccgtccgtaggtcgtcgtaccggtcccttacgtaggtaccttttacccgttaacccgttttaaccggttaaccgtttaacggtttgggtaaccgttccgggtaccccggttaccgggggttacccccgtaccccgggtacgggtcccccggttaaccgggggaaaggggggtaaccgggggtacggttaggggggacggggtttcgggggtacccggaaaccccgtaaaaccgaagggtaaaacggtaccgaaaagggttaggtaggggggtaaggtaaagaaacgttaaaacgttaagaggttaacgggttacggtaaccgttccggggtaagggtaaaccggggaccggggttacccgttaaacttaccccgtaacgttaaccgttcccgtaaaccggaacggaaacgaaacccccggtaaaacgtaaaccgaaaacggttaaacccgtaacccggttaaactttaccgggttaaacttacccgtaaacgtaaaccgttaaagtaacccggtaaacgacccccggttaagaacgggaaaccgggaacccgggttaccgggaacgttacccgggtaaccggtggtttaccgtttaaggttaaccggtttaggtacccggggtaagtaacccggggaaagttaaaccggtaacggggttaaacccggggtaaaacgggaaacgggggggttaaaaacgggggggaggggaaccgtttttcgggtaacgggtttaggggacccgggg

SEQ ID NO: 235671 - DNA, 860 bp, Homo sapiens
  misc_feature: GYAE6OF01CP4N2.23.17.B06.1.454.CMB.1.raw
tcagacgcgagtatcacgaccggtgctcgatttagtcgatagtgaaggggctcagagaggagccttagccctggactccaaggcctttccacttggtgatcagcactgagcacagaggactcaccagtggaagttggggctgagtcgttggggtttttccttgttgtcttatttttaggaaggtcgtaccaggttgtgaggtgcagcgtggtggaggttcggtggggggaggtcgttcggccgacggtcccgggttcgggggggttcccctggacgtaccttcctccgtggcgccacggtcccttgtacggtactttaccgttaccgttttacgttaccttacgttgggtactccggtaccggttccggggtccccgaccggtacgggtcccggttaccgggacggggggtaaagggggtccgtaggggtacgggggttacggggtacgggaacccctaaaaggaacggtaaagggaaccgaaagggtaggtaggggaggtaagtaaaggtaaacttaacgtaggtggttacggtacgttcggtagggtaacgggaccgggtaccgttacgtttacccaaccgttacgttccgtaacccgtaagggaaaccgaaacccggtaaaacgaaaccgtaaactaaaccccgtcttaaccgtggttaaccttacgaactaagtaaacgtacgtaaacccgacgggtccgtaagggaccgacggggtaccggaaacgggtaccgtaggtcgtttaaggttagttacgtttaagtcggaggaacggaaggtaaccggtacgaacggggtaaccggtaaaggggggaacgggggaaggggtacgtaacgggtttgtaagggtaccggg

SEQ ID NO: 235672 - DNA, 661 bp, Homo sapiens
  misc_feature: GYAE6OF01BCVPP.23.17.B06.1.454.CMB.1.raw
  modified_base (203)..(203): a, c, t, g, unknown or other
  misc_feature (203)..(203): n is a, c, g, or t
  modified_base (387)..(387): a, c, t, g, unknown or other
  misc_feature (387)..(387): n is a, c, g, or t
  modified_base (394)..(394): a, c, t, g, unknown or other
  misc_feature (394)..(394): n is a, c, g, or t
  modified_base (449)..(449): a, c, t, g, unknown or other
  misc_feature (449)..(449): n is a, c, g, or t
tcagacgcgagtatcacgaccggtgctcgatttagtcgatagtgaagggggctcagagaggagccttacgccctggactccaaggcctttcccacttggtgatcagcactgagcacagaggactcaccatggaattggggctgagtctgggttttacctgttgcttattttagaaggtgtccagtgtgaggtgcagcgtaggnggacgtcgtgggggagcttggtccgagccgtggggtcctagacgtacctctcgtgtcgcgacgctcgtaggtacgttctaccgtttagtacccttattaggactcgtaccgtcgggtccgtccgaggtccgtccgaaggggtacgggcgtggacggtgggtcggaccaacaggtaacgcaaggntggaggngaagtaaatacgtagtggtcgactcgtaggaggaacgggcctagttcccaacgtntaccgtacaggaacgaactaaaccggaataacgaacttaccgtattgtaactctggaactaaagtagaaacgcgtccgtaggacgacgacggtacggacgacggtcgtagttacgtaagttcgtaggttacggacggtagtacggaacggttaaccggtaacggaaacggtaaagggggtaacgggggagtacggttcgttaccgggtacgg

SEQ ID NO: 235673 - DNA, 897 bp, Homo sapiens
  misc_feature: GYAE6OF01A1LP3.23.17.B06.1.454.CMB.1.raw
  modified_base (497)..(497): a, c, t, g, unknown or other
  misc_feature (497)..(497): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccagtggaagttggggctgagtcgttcgggtttttccttgttcgtactttaagttttaggaaggttcgttaccgtaaggttggtaggaggttcgcgtagtcgtgggtcggtaggtcggtgggggacgtcgttacggtccgtacggtccgggtacggggggtccctaggtacgtccgttccgtccgtgtcgcgaccgtccgttacgtggttacttaccgttaccgttttactacgtttagttggtactcggtacccggttcgggtccccgacgtaccgggtaccgttacccgggaagggggtaacgggttcggtaggggtacggtacggggttaccgaaacccggaacgtaaaggtaacgggtaacctaaagggngttacgggggtacgtagaaaacggttaaatacgttacggtgtacggtacgtacggttagggacggtaacggtacctataccgtaacctacgtttccggaaccaaggtaaccaaacccggtaaacgaaaccttaaaccggacccttacgtaaccgtttaagttaacgtaccgtaagtaaaccgttaataaccgggaaccttacgggaaccttaggaaaccggggccctaaaccgggaccggtaaccgtacggttaccggttaagttacgttttaaacgtggttaacggtcggaaaaccggtgggttaaaccaaccgggtaaacgggtaacccgggtaaaggggaaaccggggggtaaagggttaagggaccggttttaaaccggtcgggttaaacccgggg

SEQ ID NO: 235674 - DNA, 834 bp, Homo sapiens
  misc_feature: GYAE6OF01CBWLA.23.17.B06.1.454.CMB.1.raw
tcagacgcgagtatcacgaccggtgctcgatttagtcgatagtgaagggctcagagaggagccttagccctggactccaaggtcctttccacttggtgatcagcactgagcacagagacctcaccagtaggtaagttgggctgagtcgttgggttttccttgttgtacgttagtttaagtaaggtcgacccgtaggtggtggaggttgaccgtagtcggtggtggtacggtcggtgggggacgtcggttacggtccgcggtccgggttccgggggtacccgtagtaccgtccgttccgttccgtgtacgacctacgtcccgttgtacggtacgtttaccttaacccgttttacgtaaccgtttagtacggtacgtcggtacccgttccgggtaccccgccgtacggtccggtacccgggaggggaaaccggggtcgtagggaggggttacgggacccgtacgaaaaccggtaagtaaccggaacgtaaggtaggtagggtaacgtaggtaaaactaacgttaacgtgtaggtacggtaaccttgtaacgggtacgtaacggtacccgttactaccgtactaccgtacctacgaagaaccaaacgtaaacggaaccgtaacgtaacctaaccgtaagttacgtaacgtacgtacgtaaacgtaaacgtaaaccgtaaccgtaaccgtacgtaaccggaacggacggaacggtaccgggacgtacggtagttgttaacggttagttaacgtggtacgtaacgtaggtaacggtaccggaacggtaggaaacgggtaaaggggtcggaaagggtttgtacccggttggtaaaccggg

SEQ ID NO: 235675 - DNA, 623 bp, Homo sapiens
  misc_feature: GYAE6OF01C1TKA.23.17.B06.1.454.CMB.1.raw
  modified_base (209)..(209): a, c, t, g, unknown or other
  misc_feature (209)..(209): n is a, c, g, or t
  modified_base (567)..(567): a, c, t, g, unknown or other
  misc_feature (567)..(567): n is a, c, g, or t
  modified_base (573)..(573): a, c, t, g, unknown or other
  misc_feature (573)..(573): n is a, c, g, or t
  modified_base (580)..(580): a, c, t, g, unknown or other
  misc_feature (580)..(580): n is a, c, g, or t
  modified_base (584)..(585): a, c, t, g, unknown or other
  misc_feature (584)..(585): n is a, c, g, or t
  modified_base (588)..(588): a, c, t, g, unknown or other
  misc_feature (588)..(588): n is a, c, g, or t
  modified_base (590)..(591): a, c, t, g, unknown or other
  misc_feature (590)..(591): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
  modified_base (602)..(604): a, c, t, g, unknown or other
  misc_feature (602)..(604): n is a, c, g, or t
  modified_base (607)..(607): a, c, t, g, unknown or other
  misc_feature (607)..(607): n is a, c, g, or t
  modified_base (609)..(609): a, c, t, g, unknown or other
  misc_feature (609)..(609): n is a, c, g, or t
  modified_base (611)..(611): a, c, t, g, unknown or other
  misc_feature (611)..(611): n is a, c, g, or t
  modified_base (615)..(617): a, c, t, g, unknown or other
  misc_feature (615)..(617): n is a, c, g, or t
  modified_base (619)..(620): a, c, t, g, unknown or other
  misc_feature (619)..(620): n is a, c, g, or t
  modified_base (623)..(623): a, c, t, g, unknown or other
  misc_feature (623)..(623): n is a, c, g, or t
tcagacgcgagtatcacgaccggtgctcgatttagtcgatagtgaaggggctggagtgggtggccaacataaggcaagatggaggtgagaaatactatgtggactctgtgaaggccgattcaccatctccagagacaacgacaagaactcactgtatcgtgacaaatgaaacagcctgagagccgaggaccacggctgtgtattattgngcgagagaccgagggtccaaagggaaagggacggggggtagaggtcgttttagaccgtgtcggtcggggaccggaacgggaccgtcggtccgtaccgtcctcctcacgcctcccaccgaaccggccgtacgtaccggttcctccccgtcggccgtcccgtcgccgtccgacggcgaaaaaaaccgccgtaccggacgacggccgaccgacggcccggtcccggtacgggtccgtcggtcccggtcggtaccggaacggtaaccgttaccgttaccgtaacgtacccgtacccggtcccgttccgtacggtacgggccgggtcggtcggaaccggtacgggaccgacgagtacgcgacncgactngacgtcncgcnnacngnncgcgcncncgnnngcncncnctcnnncnncgn

SEQ ID NO: 235676 - DNA, 736 bp, Homo sapiens
  misc_feature: GYAE6OF01DYG5D.23.17.B06.1.454.CMB.1.raw
  modified_base (175)..(175): a, c, t, g, unknown or other
  misc_feature (175)..(175): n is a, c, g, or t
tcagacgcgagtatcacgaccggtgctcgatttagtcgatagtgaaggggctcagagaggagccttagccctggactccaaggcctttccacttggtgatcagcactgagcacagagactcaccatggaattggggctgagcttgggttttccttgttgcttattttagaaggtntccagtgtgaggtgcagctggtggagtcggtgggggagtcgttggtccaggtccggtggggggtcccctgacgaccttcctccgtgtgcacgtcctcgtggactttccttacctttacgttaccttagttggactcggaccgttcgggtcccgccgtacggtcctaccggaagggggtacgggtcgtgggaggttcggggtacgaaccctaaagtaacgtaaggacgaaggagtgggaggtagaaagtaaatacgtagtggtacggtacgttcggtaggtacgggaacgggtccttaacgtacccaccgtacgtacccgtaccgaaacggtaacgaaacccgaaacggtaaacctaaacggtaaacctccgtaacgttagttaaccgtctaacggaactaaacgtacgaacctgaacccgtagacgaccgtaaccgaagcgaacgtccgtaggttacgttaattggttcgtacggacggtaagacgggaacgaaacgggtacccggaaaagggggtaaacgggggaacgggggtaagttaccgggttggttccgtacgggg

SEQ ID NO: 235677 - DNA, 912 bp, Homo sapiens
  misc_feature: GYAE6OF01C1GDI.23.17.B06.1.454.CMB.1.raw
  modified_base (207)..(207): a, c, t, g, unknown or other
  misc_feature (207)..(207): n is a, c, g, or t
tcagacgcgagtatcacgaccggtgctcgatttagtcgatagtgaaggggctcagagaggagccttagccctggactccaaggtccctttccactttggtgatcagcactgagcacagacggactcacagtaggaagttggggctgagtcgtttggttttcttgttgtacttttaagtttaaggaggtcgtacgtaggttggtaggnggtgacgtggtcggttgggtgggtacggttcggggtagggggtccgttcgttccggtaccgcggtccgggggttccgggggtcctaggacgtcccttcgtcgtcgtcgacgccgtccgttgttacgttacctttacccgtaacgttttaacgtcctttaggttgacgttcggtacccggtcgggtccccgaccgtccggtacggtaaccggggaaggggttacggggtcggtaggggtacgggggtgggtaacccggaaaccgtaaaagtaaacgggtaacggaagggttaaggacgggttaaggggtaaggttaaaccgggtaaaaatttaaacggttaagttacggggttcgttaccgggtacgtttaccggtaggggtaacgggaaccccgggttactttaaccctaccaccgttaccgtaacccgtaccggtaaaccgaaacggaaacccgtaaaccggtaaacgaaacctacccgttacttacgttacgtacgttacgtaacgaaacgtaaccgacgtaaacgtcgaacggacgacggtaccggaaccgggacgtaccggtaggttcgtaacgttaggtttagtacggttcggacggtaaagggaccggtaacgggtaaacgggaccgggtaaacgggaaacggggtaaacggggggtaaaggtcggtttaaccggggttcgggttaggtaacccggggg

SEQ ID NO: 235678 - DNA, 830 bp, Homo sapiens
  misc_feature: GYAE6OF01A179U.23.17.B06.1.454.CMB.1.raw
  modified_base (734)..(734): a, c, t, g, unknown or other
  misc_feature (734)..(734): n is a, c, g, or t
tcagacgcgagtatcacgaccggtgctcgatttagtcgatagtgaaggggctcagagaggagccttagccctggactccaaggcctttccacttggtgatcagcactgagcacagagactcaccatggaagttggggctgagtcttgggttttccttgttgtcttattttagagtgtccagtgtgaggtgcagcgtggtggacggtcggtgggggagtcgttcggtccgacggtccgggttcggggggtcccctaggaacgtacccttccgtcccgttggtcgacctaccgtccttcgttaggtacctttaccttaaccgttttaccgttaaccgtttagtacgggtacttaccggtacccggttcggggtacccccgacccggtacggtaccccggtaccgggtaaacggggggaacgggttccggtaaggggacgggtacggggtccgaaaccgtaaagtaaggtaaaccggaacgaaagggtacggttacggggtaaaggtaaggtaaaacgtaaaacgttacgtaggtttacggtacgtaccgttacgtagggtacggtaaccggtacgtacttaccgaccgttaatcccgaagtagtaacgaaacaacgaacgtaaacgtacctactaccgttaaagttcctaagaccggttaaaactaagaccttaaacggcgtaaccgtaaggcccgaaccgggagtaacccggacgtaacggttctaaagggtttntttaaacttgggttacgaacggaggtaacggtaacgaacggttacgggtaaacggaaagggggaacgggtagacgttaaagttcggtacggtacgg

SEQ ID NO: 235679 - DNA, 823 bp, Homo sapiens
  misc_feature: GYAE6OF01DTDSN.23.17.B06.1.454.CMB.1.raw
  modified_base (165)..(165): a, c, t, g, unknown or other
  misc_feature (165)..(165): n is a, c, g, or t
  modified_base (194)..(194): a, c, t, g, unknown or other
  misc_feature (194)..(194): n is a, c, g, or t
  modified_base (624)..(624): a, c, t, g, unknown or other
  misc_feature (624)..(624): n is a, c, g, or t
  modified_base (641)..(641): a, c, t, g, unknown or other
  misc_feature (641)..(641): n is a, c, g, or t
  modified_base (735)..(735): a, c, t, g, unknown or other
  misc_feature (735)..(735): n is a, c, g, or t
tcagacgcgagtatcacgaccggtgctcgatttagtcgatagtgaaggggctcagagaggagccttagccctggactaccaaggtccctttccacttggtgatcagcactgagcacagagactcaccatggaattggggctgagcgttgggttttccttgttgtnttattttagagtgtccagtgtgaggtgcngcgtggtggagtcggtgggggagtcgttggtccgacggtccggtcggggggtccctaggacgtaccttccgtccgttggtacgccgacgtccgttcgtaggtactttacccgtaaccttttagtaacccttaggtttacggtaacttcggtaccggttccgggtacccccgagtaaccggggccgttaccgggaaggggggtaacgggggtcgtaggggtaggggttcgggggtacggaacccgtaaaacgaaggttaaaaccggacgaaaagggtagtagggggtaaaggtaacggaaaggttaaaattacgttaaggtgggttacggtacgttacggtagggttaacgggaccggggacttacgttaccaacctacttccgacgaaagtacgaaacaaaccggaacaagtaacctgtaactatttacngtaacgtaaacgttaanacggtaaacctcggtaaaccgtacggaaaggtaacccggtaacggtaaccggaaccggtacgtacgttggtttaaattaggtttgttaccgggnggaaaccggaagggacggtaaacggaacggtaaacgggaaacggggaaggggggtaacgggttaaggtggttaccgttacggaacggg

SEQ ID NO: 235680 - DNA, 598 bp, Homo sapiens
  misc_feature: GYAE6OF01DW49Z.23.17.B06.1.454.CMB.1.raw
  modified_base (177)..(177): a, c, t, g, unknown or other
  misc_feature (177)..(177): n is a, c, g, or t
  modified_base (274)..(274): a, c, t, g, unknown or other
  misc_feature (274)..(274): n is a, c, g, or t
  modified_base (284)..(284): a, c, t, g, unknown or other
  misc_feature (284)..(284): n is a, c, g, or t
  modified_base (464)..(464): a, c, t, g, unknown or other
  misc_feature (464)..(464): n is a, c, g, or t
  modified_base (469)..(469): a, c, t, g, unknown or other
  misc_feature (469)..(469): n is a, c, g, or t
  modified_base (478)..(478): a, c, t, g, unknown or other
  misc_feature (478)..(478): n is a, c, g, or t
  modified_base (484)..(484): a, c, t, g, unknown or other
  misc_feature (484)..(484): n is a, c, g, or t
  modified_base (505)..(505): a, c, t, g, unknown or other
  misc_feature (505)..(505): n is a, c, g, or t
  modified_base (534)..(534): a, c, t, g, unknown or other
  misc_feature (534)..(534): n is a, c, g, or t
  modified_base (547)..(547): a, c, t, g, unknown or other
  misc_feature (547)..(547): n is a, c, g, or t
  modified_base (549)..(549): a, c, t, g, unknown or other
  misc_feature (549)..(549): n is a, c, g, or t
  modified_base (553)..(553): a, c, t, g, unknown or other
  misc_feature (553)..(553): n is a, c, g, or t
  modified_base (558)..(558): a, c, t, g, unknown or other
  misc_feature (558)..(558): n is a, c, g, or t
  modified_base (562)..(562): a, c, t, g, unknown or other
  misc_feature (562)..(562): n is a, c, g, or t
  modified_base (565)..(567): a, c, t, g, unknown or other
  misc_feature (565)..(567): n is a, c, g, or t
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
  modified_base (580)..(580): a, c, t, g, unknown or other
  misc_feature (580)..(580): n is a, c, g, or t
  modified_base (585)..(585): a, c, t, g, unknown or other
  misc_feature (585)..(585): n is a, c, g, or t
  modified_base (593)..(593): a, c, t, g, unknown or other
  misc_feature (593)..(593): n is a, c, g, or t
  modified_base (595)..(595): a, c, t, g, unknown or other
  misc_feature (595)..(595): n is a, c, g, or t
tcagacgcgagtatcacgaccggtgctcgatttagtcgatagtgaagggccgattcaccatctccagagacaacgacaagaactcactgtatctgacaaatgaacagcctgagagccgaggacacggctgtagtattattgtgacgagagacaggtaccgaaggaaagggagggganagtcgttttagactgcgtacggggaccacgggtaacctggtccaccgtctcctcgacgccctaccacgaacggtccctacgtccgttccctccccgnggccctccgngccgtcgacggaccgtccaccgtcgagacgcaacgccgaccggtcccgtggtccgtcgtccggtacggtaacgtaaccggtacctttcccttaccgaactttcccggtcgttacgtccggttagggaccgggtcgggaaccgttcgggaacggacggggtaccctaagtacgttaacggntcgtntacgagtancgtacncgacacgtcgtctacgacganactacagtagtacgacgacgcgagacacnagacacacgcgcngngtanagagnctcncgnnngcgctncncagtnacgtnacactacncngcg

SEQ ID NO: 235681 - DNA, 757 bp, Homo sapiens
  misc_feature: GYAE6OF02H72PZ.23.17.B06.1.454.CMB.1.raw
  modified_base (256)..(256): a, c, t, g, unknown or other
  misc_feature (256)..(256): n is a, c, g, or t
  modified_base (295)..(295): a, c, t, g, unknown or other
  misc_feature (295)..(295): n is a, c, g, or t
tcagacgcgagtatcacgaccggtgctcgatttagtcgatagtgaagggctcagagaggagccttagccctggactccaaggcctttccacttggtgatcagcactgagcacagaggactcaccatggaattggggctgagctgggtttcctgttgctatttagaaggtgtccagtgtgaggtgcagctggtggagtcgtgggggagcgttggtccaggccgtggggggtccctggacgactctctgtgcagcctntggattcacctttagtacctatggatgaccgtgggtccncgaggctccggaagggtaacgggcgttaggacggtcggggtacgtacctaaacgtagtaacggtcgaaggtacgtacggacggtacgaagtaaactacgtagtcgtacggacttcgtagtacggaacgggtcccgtaagtttcccgaaccgtaagttccgtacccgaaggtaacgtaaccgtaaacggtaactaaacggtaacccttcgtaaccgttacgttaacgtttcccgtaaggtaacccgttaaaaacgttccggaaaaccgtacggtaccccgttaagggtacccggtaaacgggtcccggtaaacggtaacccggttaaccgggtacgtttacgggttacgtttaacgtttaccgtttcgggtaaccggacggtaacggtacgggtaaccgttacgggtaacccgtaagggtaaacgggtcgggggtaactacggttaccgttttaggaacccgg

SEQ ID NO: 235682 - DNA, 403 bp, Homo sapiens
  misc_feature: GYAE6OF02JB2ZR.23.17.B06.1.454.CMB.1.raw
  modified_base (174)..(174): a, c, t, g, unknown or other
  misc_feature (174)..(174): n is a, c, g, or t
  modified_base (259)..(259): a, c, t, g, unknown or other
  misc_feature (259)..(259): n is a, c, g, or t
  modified_base (315)..(315): a, c, t, g, unknown or other
  misc_feature (315)..(315): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
  modified_base (392)..(392): a, c, t, g, unknown or other
  misc_feature (392)..(392): n is a, c, g, or t
  modified_base (394)..(403): a, c, t, g, unknown or other
  misc_feature (394)..(403): n is a, c, g, or t
tcagacgcgagtatcacgaccggtgctcgatttagtcgatagtgaagggccgattcaccatctccagagacaacgacaagaactcactgtatctgcaaatgaacagccttgagagccgaggacacggctggtgtattattgtgccgagagacaggttccagaaaggaggggganagtctttgactgctggggccagggaaccctgggtcaccgtctcctcgagccctccaccaagggtcccacgtcggtccttcccccngggccgccctcgcctccaggagtcacctccgagagcctacgagtccggcctcgggntcggcctcggtcaaggacctacttccgataacgttcgctactggacgcgggcctaggcgaaggcgctanaggtcngntnnnnnnnnnn

SEQ ID NO: 235683 - DNA, 351 bp, Homo sapiens
  misc_feature: GYAE6OF02GQHPQ.23.17.B06.1.454.CMB.1.raw
  modified_base (351)..(351): a, c, t, g, unknown or other
  misc_feature (351)..(351): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggagggggagagctttgactgctggggccagggaaccctggtcaccgtctcctcagcctccaccaagggcccatcggtcttccccctggcgccctgctccaggagcacctccgagagcacagcggccctgggctgcctggtcaaggactacttccatactcgcgtctgagcgggctggcaaggcgcatagn

SEQ ID NO: 235684 - DNA, 356 bp, Homo sapiens
  misc_feature: GYAE6OF02GNFG2.23.17.B06.1.454.CMB.1.raw
  modified_base (351)..(356): a, c, t, g, unknown or other
  misc_feature (351)..(356): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggaggggagagctttgactgctggggccagggaaccctggtcaccgtctcctcagcctccaccaagggcccatcggtcttccccctggccgccctgctcccaggagcacctccgagagcacagcggccctgggctgcctggtcaaggactacttccatactcgcgtctgagcggctggcaaggcgcatagnnnnnn

SEQ ID NO: 235685 - DNA, 524 bp, Homo sapiens
  misc_feature: GYAE6OF02GEEON.23.17.B06.1.454.CMB.1.raw
  modified_base (422)..(422): a, c, t, g, unknown or other
  misc_feature (422)..(422): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtggggggtccctgagactctcctgtgcagcctctggattcacctttagtacctattggatgacctgggtccgccaggctccgagggagggctggagtgggtggccaacataaggcaagatggaggtgagaaatactatgtggactctgtgaagggccattcacatctccagagacaacgacaacgaactcactgtatntagacaaatgaaacagcctagagagaccgaggacgacggctgtagtacttagttgtagcgagagacgaggtccgaaggaacgggaggggagagtcgttgacg

SEQ ID NO: 235686 - DNA, 353 bp, Homo sapiens
  misc_feature: GYAE6OF02H9IXR.23.17.B06.1.454.CMB.1.raw
  modified_base (350)..(353): a, c, t, g, unknown or other
  misc_feature (350)..(353): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggaggggagagctttgactgctggggccagggaaccctggtcaccgtctcctcagcctccaccaagggcccatcggtcttccccctggcgccctgctccaggagcacctccgagagcacagcggccctgggctgcctggtcaaggctacttccatactcgcgtctgagcgggctggcaagggcgcatagnnnn

SEQ ID NO: 235687 - DNA, 520 bp, Homo sapiens
  misc_feature: GYAE6OF02FZMV8.23.17.B06.1.454.CMB.1.raw
  modified_base (461)..(461): a, c, t, g, unknown or other
  misc_feature (461)..(461): n is a, c, g, or t
  modified_base (474)..(474): a, c, t, g, unknown or other
  misc_feature (474)..(474): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtcccctgagactctcctgtgcagcctctggattcacctttagtaccttattggatgacctgggtccgccaggctccagggagggctggagtgggtgccaacataaggcaagatggaggtgagaaatactatgtaggactctgtagaagggccgattccaccatctccagagacaacgacaagaactcactgtatctgacaaatgaacagcctagagagccgaggacacggntgtgtattattgngtcgaagagacaggtaccaaggaagggaggggagaggtacttgacg

SEQ ID NO: 235688 - DNA, 686 bp, Homo sapiens
  misc_feature: GYAE6OF02H1AYT.23.17.B06.1.454.CMB.1.raw
  modified_base (298)..(298): a, c, t, g, unknown or other
  misc_feature (298)..(298): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattgggctgagctgggttttccttgttgctattttagaaggtgtccagtgtgaggtgcagctggtggagtcgtggggggaggcttggtccagccgtggggggtccctgagactctcctgtgcagcctctggattcacctttagtacctattggatgacctgggtcccncaggctccgagggaagggctggagtgggtggccaacagtaaggcaagatggaggtgagaaatacgtatgtggacttcgtggtagaaaggggtcccgagttttacccaaccgtaattcccgtaccccgaaagggaacgaaacccgaaaacggaaaccgaaaaggtaaaacccttcgaaaacccgttggttaaacttcccgttaaggaacccaaaaagttgaaaacccaggtacccgtaagggacggaaacgggacccggaaacggggtacccgaaccggggacttgggttaagttaatttaagttcggttaggaccggtaaggacggtaaccgaacgggtccgaaagggaaaggggggaagggggaagtacggtgttttaggaaccggg

SEQ ID NO: 235689 - DNA, 354 bp, Homo sapiens
  misc_feature: GYAE6OF02FSBZF.23.17.B06.1.454.CMB.1.raw
  modified_base (349)..(354): a, c, t, g, unknown or other
  misc_feature (349)..(354): n is a, c, g, or t
tcagacgcgagtatcacgaccggtgctcgatttagtcgatagtgaaggccgattcaccatctccagagacaacgacaagaactcactgtatctgcaaatgaacagcctgagagccgaggacacggctgtgtattattgtgcgagagacaggtccagaaaggagggtagagctttgactgctggggccagggaaccctggtcaccgtctcctcagcctccaccaagggcccatcggtcttcccctggccgccctgctccaggagcaccctccgagagcacagcggcccctggctgcctggtcaaggactactccatctcgcgtctgagcgggctggcaagggcgcatagnnnnnn

SEQ ID NO: 235690 - DNA, 552 bp, Homo sapiens
  misc_feature: GYAE6OF02H6HF3.23.17.B06.1.454.CMB.1.raw
  modified_base (299)..(299): a, c, t, g, unknown or other
  misc_feature (299)..(299): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctggggggaggcttggtccagccgtgggggggtccctggagactctcctgtgcagcctctggattcacctttagtacctattggatgacctgggtccncaggctccagggaagggctggagtgggtggcaacataaggcaagatggaggtgaagaaatactatgtggactctagtgaagggccgattcacctatctccagagaacaacgaacaaagaactcaactgtaatctagactaaatgaacagcctaggagacgccggaaggacgacggctagtagtattagttgtgcggaaggagaaccgtaggtacccgaagggaaagggagggggaagaggtcgtttaggacgg

SEQ ID NO: 235691 - DNA, 520 bp, Homo sapiens
  misc_feature: GYAE6OF02GF8HY.23.17.B06.1.454.CMB.1.raw
  modified_base (437)..(437): a, c, t, g, unknown or other
  misc_feature (437)..(437): n is a, c, g, or t
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
  modified_base (477)..(477): a, c, t, g, unknown or other
  misc_feature (477)..(477): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtacctattggatgacctgggtccgccaggctccgagggaaggggctgggagtgggtggccaacataaggcaaagatggaggtagagaaatactaatgtggactcgtgtgaagggccattcaccatctccagagacaacgacaagaactcactgtatctgacaaatnaacagcctagagacgccgaggacacggctgtntattntgngcgagagacaggtaccaaggaagggaggggagaggtcttgacg

SEQ ID NO: 235692 - DNA, 642 bp, Homo sapiens
  misc_feature: GYAE6OF02HZVUT.23.17.B06.1.454.CMB.1.raw
  modified_base (299)..(299): a, c, t, g, unknown or other
  misc_feature (299)..(299): n is a, c, g, or t
  modified_base (616)..(616): a, c, t, g, unknown or other
  misc_feature (616)..(616): n is a, c, g, or t
tcagacgcgagtatcacgaccggtgctcgatttagtcgatagtgaaggggcgtcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggagcttggtccaggccgtggggggtccctgagactctctgtgcagcctctggattcacctttagtacctattggatgaccgtgggtccncaggctccgaggggaagggctgggagtgggtcggaccaaacgagtaaagggcaaaggatgggaaggtggaaagtaaaagtactaatggtaggaccttgtgtaggaaaggggcccaatttccaacccgtatcctaccaaaggaagaaccaaacggaacaaaggaaaccttactaacctaggtaacttcgtacgaacctaaaagtacgaaacgtacgaccgtaggacgaacggaccggaacggaacaccgggacttagtagttaagtttacgttggtagacggtaagacggaacgtacggtaccgaaggaaaacggggngggggaactaggtaccgtttagacgg

SEQ ID NO: 235693 - DNA, 504 bp, Homo sapiens
  misc_feature: GYAE6OF02I3GLS.23.17.B06.1.454.CMB.1.raw
  modified_base (327)..(327): a, c, t, g, unknown or other
  misc_feature (327)..(327): n is a, c, g, or t
  modified_base (337)..(337): a, c, t, g, unknown or other
  misc_feature (337)..(337): n is a, c, g, or t
  modified_base (361)..(361): a, c, t, g, unknown or other
  misc_feature (361)..(361): n is a, c, g, or t
  modified_base (385)..(385): a, c, t, g, unknown or other
  misc_feature (385)..(385): n is a, c, g, or t
  modified_base (445)..(445): a, c, t, g, unknown or other
  misc_feature (445)..(445): n is a, c, g, or t
  modified_base (450)..(450): a, c, t, g, unknown or other
  misc_feature (450)..(450): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtacctattggatgacctgggtccgcaggctccagggagggctggagtgggtgcaanataggcaagntggagtgagaaatctatgtgactntgtgaggccgattcacatctcagnacacgacaagactcactgtatctgacaatgaacagctgagacgccgagacacggctagtntattntgtgcgtagacgagaggtaccgaaggaacgggaggggagaggtcgtttaggacg

SEQ ID NO: 235694 - DNA, 524 bp, Homo sapiens
  misc_feature: GYAE6OF02IDO7F.23.17.B06.1.454.CMB.1.raw
  modified_base (427)..(427): a, c, t, g, unknown or other
  misc_feature (427)..(427): n is a, c, g, or t
  modified_base (465)..(465): a, c, t, g, unknown or other
  misc_feature (465)..(465): n is a, c, g, or t
  modified_base (488)..(488): a, c, t, g, unknown or other
  misc_feature (488)..(488): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtacctattggatgacctggtccgcaggctccgagggaaggggctgggagtgggtggccaacataaggcaaggatggaggtgaagaaatactatgtggactctgtgaagggccattcacatctccagagacaacgacaagaactcactgtaatctanacaaatgaaaccagcctaggacgagccgaggacacggntgtagtattattgtagcggaagngacaggaccaggaagggaggggagaggtcgttgacg

SEQ ID NO: 235695 - DNA, 360 bp, Homo sapiens
  misc_feature: GYAE6OF02G6B9N.23.17.B06.1.454.CMB.1.raw
  modified_base (267)..(267): a, c, t, g, unknown or other
  misc_feature (267)..(267): n is a, c, g, or t
  modified_base (351)..(360): a, c, t, g, unknown or other
  misc_feature (351)..(360): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggaggggagagctttgactgctggggccagggaaccctggtcaccgtctcctcagcctccaccaagggcccatccggtcttccccctggccgccctgctccaggacncacctccgagagcacagcggccctgggctgcctggtcaaggacctactccatactcggtctgagcggctggcaaggcgcatagnnnnnnnnnn

SEQ ID NO: 235696 - DNA, 533 bp, Homo sapiens
  misc_feature: GYAE6OF02JGQOL.23.17.B06.1.454.CMB.1.raw
  modified_base (341)..(341): a, c, t, g, unknown or other
  misc_feature (341)..(341): n is a, c, g, or t
  modified_base (389)..(389): a, c, t, g, unknown or other
  misc_feature (389)..(389): n is a, c, g, or t
  modified_base (432)..(432): a, c, t, g, unknown or other
  misc_feature (432)..(432): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggtttccttgttgctattttagaaggtgtccagtgtgaggtgcagctggtggagtctgggggaggcttggtccagcctggggggtccctgagactctcctgtgcagcctctggattcacctttagtacctattggatgacctgggtccgcaggctccgagggaagggctggagtgggtcgccaacataaggcaagntggaggtgagaaatactatgtagactctgtgaaggccgattcacatcncagagacaacgacaagactcactgtatctagacaaatgaaacngacctagagagaccgaggaccacggctagtcgtattagttgtacgcgagacggaacgacggtaccaaggaaagggaggggaagtacggtacgtttaggacg

SEQ ID NO: 235697 - DNA, 599 bp, Homo sapiens
  misc_feature: GYAE6OF02I70X6.23.17.B06.1.454.CMB.1.raw
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctggagactctcctgtgcagcctctggattcacctttagtacctattggatgacctgggtccgccaggctccgagggaaggggctggagtgggtggaccaacataaggcaagatggaggtgagaaatactatgtgggactctgtaggaaacgggccgatttccacatctacaagagacaacgacaacgaactcactgtatctagacaaatcgaacacgcctaggaacgtacggaccggaagggaccgtaacgggtccgttgtagttaatttagttcggtaggcggtaacggacggtaaaccggtacgggttacccgaaagggaaacgggggtaagggggaaggtacggtacggttttgaaccgg

SEQ ID NO: 235698 - DNA, 354 bp, Homo sapiens; identical to SEQ ID NO: 235616
  misc_feature: GYAE6OF02HDJAI.23.17.B06.1.454.CMB.1.raw
  modified_base (351)..(354): a, c, t, g, unknown or other
  misc_feature (351)..(354): n is a, c, g, or t

SEQ ID NO: 235699 - DNA, 363 bp, Homo sapiens
  misc_feature: GYAE6OF02G6S04.23.17.B06.1.454.CMB.1.raw
  modified_base (348)..(348): a, c, t, g, unknown or other
  misc_feature (348)..(348): n is a, c, g, or t
  modified_base (355)..(363): a, c, t, g, unknown or other
  misc_feature (355)..(363): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggaggggagagctttgactgctggggccagggaaccctggtcaccgtctcctcagcctccaccaagggcccatccggtcttccccctggccgccctgctccaggacgcacctccgagagcacagccggccctgggctgcctggtcaaggactactccatactcgcgtctgagcgggctggacaaggcncagtagnnnnnnnnn

SEQ ID NO: 235700 - DNA, 515 bp, Homo sapiens
  misc_feature: GYAE6OF02F4ME5.23.17.B06.1.454.CMB.1.raw
  modified_base (461)..(461): a, c, t, g, unknown or other
  misc_feature (461)..(461): n is a, c, g, or t
  modified_base (504)..(504): a, c, t, g, unknown or other
  misc_feature (504)..(504): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtcccctgagactctcctgtgcagcctctggattcacctttagtacctattggatgacctgggtccgccaggctccgagggagggctggagtgggtgccaacataaggcaagatggaggtgagaaatactatggtggactctgtgaagggccgattcacatctccagagacaacgacaagactcactgtatctgacaaatgaacagcctagagagccgaggacacggctgtntattatgtggcgagagacaggtaccgaaggaaagggagggganaggtcttgacg

SEQ ID NO: 235701 - DNA, 437 bp, Homo sapiens
  misc_feature: GYAE6OF02HK3DN.23.17.B06.1.454.CMB.1.raw
  modified_base (165)..(165): a, c, t, g, unknown or other
  misc_feature (165)..(165): n is a, c, g, or t
  modified_base (172)..(172): a, c, t, g, unknown or other
  misc_feature (172)..(172): n is a, c, g, or t
  modified_base (217)..(217): a, c, t, g, unknown or other
  misc_feature (217)..(217): n is a, c, g, or t
  modified_base (380)..(382): a, c, t, g, unknown or other
  misc_feature (380)..(382): n is a, c, g, or t
  modified_base (385)..(385): a, c, t, g, unknown or other
  misc_feature (385)..(385): n is a, c, g, or t
  modified_base (388)..(437): a, c, t, g, unknown or other
  misc_feature (388)..(437): n is a, c, g, or t
tcagacgcgagtatcacgaccggtgctcgatttagtcgatagtgaaggggccgattcaccatctccagagacaacgacaagaactcactgtatcctgcaaatgaacagcctgagagccgaggacacggctgtgtattattgtgcgagagacaggtccagaaaggnggggganagctttgacctgctggggccagggaaccctggtcaccgtctcctnagcctccaccaagggcccagtcgtccttccccctggccgccctgctcccaggtaagcacctccgagagcacgagccggccctgggctcgccttggtcaagggactactttccataactccgcgtactggacgacggggctcggggcaaagggcgcaagtaggnnntgntannnnnnnnnnnnnnnnnnnnnnnnnnnnnnnnnnnnnnnnnnnnnnnnnn

SEQ ID NO: 235702 - DNA, 359 bp, Homo sapiens
  misc_feature: GYAE6OF02FV5SH.23.17.B06.1.454.CMB.1.raw
  modified_base (352)..(355): a, c, t, g, unknown or other
  misc_feature (352)..(355): n is a, c, g, or t
  modified_base (357)..(359): a, c, t, g, unknown or other
  misc_feature (357)..(359): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggagggggagagctttgactgctggggccagggaaccctggtcaccgtctcctcagcctccaccaagggcccatcggtcttccccctggccgccctgctccaggagcacctccgagagcacagccggccctgggctgcctggtcaaggctacttccatactcgcgtctgagcgggctggcaaggcgcatagnnnngnnn

SEQ ID NO: 235703 - DNA, 441 bp, Homo sapiens
  misc_feature: GYAE6OF02JMCOO.23.17.B06.1.454.CMB.1.raw
  modified_base (269)..(270): a, c, t, g, unknown or other
  misc_feature (269)..(270): n is a, c, g, or t
  modified_base (411)..(441): a, c, t, g, unknown or other
  misc_feature (411)..(441): n is a, c, g, or t
tcagacgcgagtatcacgaccggtgctcgatttagtcgatagtgaagggccgattcaccatctccagagacaacgacaagaactcactgtatctgcaaatagaacagcctgagagccgaggacacggctgtgtattattgtgcgagagacaggtccagaaggaggggaggagcttgtactgcgtcgggccgacggaaccgtcggtcgaccgtcctcctcacgcctccaccgaacggacccgacgtcggtccttcccctcgccgcccgtnnccgtcctaccgacggacgaccgtaccgtaccgacgacgacgacgaccggccgtccggcgtcgtcgtcgtcgtacgacgtactacctactactacgtcgtcgtcgacgacggcggtcggacgacggacggacgacgtagagnnnnnnnnnnnnnnnnnnnnnnnnnnnnnnn

SEQ ID NO: 235704 - DNA, 356 bp, Homo sapiens
  misc_feature: GYAE6OF02H7W76.23.17.B06.1.454.CMB.1.raw
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
  modified_base (346)..(346): a, c, t, g, unknown or other
  misc_feature (346)..(346): n is a, c, g, or t
  modified_base (351)..(356): a, c, t, g, unknown or other
  misc_feature (351)..(356): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggagggggagagctttgactgcgtggggccagggaaccctggtcaccgtctcctcagcctccaccaagggcccatccggtccttcccctggccgccctgctccaggngcacctccgagngcacagccgccgtggctcgcctggtcaaggctacttccatactcgcgtctgagcggctggcaaggcnatagnnnnnn

SEQ ID NO: 235705 - DNA, 527 bp, Homo sapiens
  misc_feature: GYAE6OF02FQV7X.23.17.B06.1.454.CMB.1.raw
  modified_base (297)..(297): a, c, t, g, unknown or other
  misc_feature (297)..(297): n is a, c, g, or t
  modified_base (430)..(430): a, c, t, g, unknown or other
  misc_feature (430)..(430): n is a, c, g, or t
  modified_base (438)..(438): a, c, t, g, unknown or other
  misc_feature (438)..(438): n is a, c, g, or t
  modified_base (442)..(442): a, c, t, g, unknown or other
  misc_feature (442)..(442): n is a, c, g, or t
  modified_base (510)..(510): a, c, t, g, unknown or other
  misc_feature (510)..(510): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgtgttttccttgttgctatttagaaggtgtccagtgtgaggtgcagctggtggagtcgtgggggaggcttggtccagccgtgggggggtccctgagactctcctgtgcagcctctggattcacctttagtacctattggatgacctgggtccncaggctccgagggaagggctgggagtgggtggccaacataaggcaagatggaggtgaagaaatactagtgtggactcgtgtggaagggccaattcacctatctccagagacaaacgacaagactcatgtatcngacaaatnaacngcctagagacgccgaggacacggctggtagtattagtggtgcgagagacgaggtacaagggaaagggnggggataggtcttacgg

SEQ ID NO: 235706 - DNA, 600 bp, Homo sapiens
  misc_feature: GYAE6OF02HR84O.23.17.B06.1.454.CMB.1.raw
  modified_base (353)..(353): a, c, t, g, unknown or other
  misc_feature (353)..(353): n is a, c, g, or t
  modified_base (573)..(573): a, c, t, g, unknown or other
  misc_feature (573)..(573): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctggagactctcctgtgcagcctctggattcacctttagtacctattggatgacctgggtccgccaggctccgagggaacgggctgggagtgggtggccaacgagtaagggcaaaggngtgggaggtgaagaaatactagtggtaggactcgtagtaggaacgggtccatttaccgacgtacttccgtacccaggtaacgaccaaacgtaacaaagtaacctcaacgtgtactctagactaaatgaacagtcctagacgacgaccggagacgacggctagttagtacgttagtcggtagcgtaaggacgtaaccgacggtaccgaaggaaacgggggnggggtaacgtaggtacgtttagaccgg

SEQ ID NO: 235707 - DNA, 528 bp, Homo sapiens
  misc_feature: GYAE6OF02IP9L8.23.17.B06.1.454.CMB.1.raw
  modified_base (355)..(355): a, c, t, g, unknown or other
  misc_feature (355)..(355): n is a, c, g, or t
  modified_base (374)..(374): a, c, t, g, unknown or other
  misc_feature (374)..(374): n is a, c, g, or t
  modified_base (398)..(398): a, c, t, g, unknown or other
  misc_feature (398)..(398): n is a, c, g, or t
  modified_base (411)..(411): a, c, t, g, unknown or other
  misc_feature (411)..(411): n is a, c, g, or t
  modified_base (413)..(413): a, c, t, g, unknown or other
  misc_feature (413)..(413): n is a, c, g, or t
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
  modified_base (429)..(429): a, c, t, g, unknown or other
  misc_feature (429)..(429): n is a, c, g, or t
  modified_base (449)..(449): a, c, t, g, unknown or other
  misc_feature (449)..(449): n is a, c, g, or t
  modified_base (453)..(453): a, c, t, g, unknown or other
  misc_feature (453)..(453): n is a, c, g, or t
  modified_base (458)..(458): a, c, t, g, unknown or other
  misc_feature (458)..(458): n is a, c, g, or t
  modified_base (466)..(466): a, c, t, g, unknown or other
  misc_feature (466)..(466): n is a, c, g, or t
  modified_base (490)..(490): a, c, t, g, unknown or other
  misc_feature (490)..(490): n is a, c, g, or t
tcagacgcgagtatcacgaccggtgctcgatttagtcgatagtgaaggggctcagagaggagccttagccctggactccaaggcctttccacttggtgatcagcactgagcacagaggactccaccatggaattggggctgagcttgggtttttccttgttgctattttagaaggtgtccagtgtgaggtgcagctggtggagtcgtgggggaggcttgggtccagccgtggggggtccctgagctctcctgtgcagcctctggattcacctttagtacctattggatgacctggtccgcaggctccgaggggaggggctggaggtgggtgccaagataaggcaagagtggagtnaagaaatatatgtggactntgagaggcgatcacatctacaganacaagacaagacncntntatcnacaatcganagctagacaggccaggaccncggntaggntttaagtntagtggaagagagtacacgggtanaaagggtaaggggaggggtaaggtcgtgtttaggacgg

SEQ ID NO: 235708 - DNA, 365 bp, Homo sapiens
  misc_feature: GYAE6OF02F6C2R.23.17.B06.1.454.CMB.1.raw
  modified_base (356)..(365): a, c, t, g, unknown or other
  misc_feature (356)..(365): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggagggggagagctttgactgatggggccagggaaccctggtcaccgtctcctcagcctcaccaacggaccgactcgtccgttcccctcggcgcctcgctcccacggagcacctccgacgagcacagcggccctcggcgtgcctggtcaaggactacttccactactcgcgtctgagcggcgtgcaagcgcatagnnnnnnnnnn

SEQ ID NO: 235709 - DNA, 670 bp, Homo sapiens
  misc_feature: GYAE6OF02JGK7A.23.17.B06.1.454.CMB.1.raw
  modified_base (297)..(297): a, c, t, g, unknown or other
  misc_feature (297)..(297): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagactcctcctgtgcagcctctggattcactttagtacctattggatgacctgggtccnccaggctccgagggaaggggctgggacgtggggtcgccaacgagtaaggcaagagtaggaggtgaagaaagtactagtggtgactcgtgtggaacgggccgtattcaccatcctaccgagaagacaacgacaagaacctcaacttgtactcgtacgactaaactagaaaccgtacgtaccctaggaaaggacccggaccggaaacgggtaacccgaacccgggtaccgttagggttacgtttaactttacggttttaggacgggtaaccggtaacggaacgggtaacccgtaaccgggggttaacccaaaagggggttaaacgggggaaaccggggggtaaacgggtaacggttaccggtttaccgtaacggg

SEQ ID NO: 235710 - DNA, 549 bp, Homo sapiens
  misc_feature: GYAE6OF02JZIVK.23.17.B06.1.454.CMB.1.raw
  modified_base (294)..(294): a, c, t, g, unknown or other
  misc_feature (294)..(294): n is a, c, g, or t
  modified_base (425)..(425): a, c, t, g, unknown or other
  misc_feature (425)..(425): n is a, c, g, or t
  modified_base (534)..(534): a, c, t, g, unknown or other
  misc_feature (534)..(534): n is a, c, g, or t
tcagacgcgagtatcacgaccggtgctcgatttagtcgatagtgaagggctcagagaggagccttagccctggactccaaggcctttccacttggtgatcagcactgagcacagaggactcaccatggaattggggctgagctgggttttcctgttgctattttagaaggtgtccagtgtgaggtgcagctggtggagtctgggggaggcttggtccagcctggggggtccctgagactctcctgtgcagcctctggattcacctttagtacctattcggatgacctgggtccnccaggcctccgagggaagggctggagtgggtgaccaacagtaaggcaagatggaggtgaagaaatacgtatgtaggactctgtgaacgggccgattcacatcacagagacaacgacaagaactcacgggtntactactagcaaatgaacagcctagacgagaccggagaccgacggctagtacgtattagttgtaggcgtagacgaacgtacggtaccgaaggaaacggggacggggaanaggttccttaggacg

SEQ ID NO: 235711 - DNA, 743 bp, Homo sapiens
  misc_feature: GYAE6OF02JQNVD.23.17.B06.1.454.CMB.1.raw
  modified_base (518)..(518): a, c, t, g, unknown or other
  misc_feature (518)..(518): n is a, c, g, or t
  modified_base (572)..(572): a, c, t, g, unknown or other
  misc_feature (572)..(572): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctatttagagtgtcagtgtgaggtgcagctggtggagtcgtgggggagtcgttggtccaggtccgtggggggtccctggagactctcctgtgcacgcctcgtggacttcctaccttttacgtaccttagttcggatgacccgtggtcccgccaggtcctccgaaggggaacgggcgtgggaggtgggtcgaccgaacgtaagtaacgggaccaaaggagttaggggaggtaggaaacgtaaatacgttaagtgggtaggtaacctgtaggtacggaacggggtacccgtactttaccgaacctacgtacccttacccggaagaacgaaacccgaaaccggtaaccaaaagaacccgttnaaaccggttggttaaacccttcgttaacggaaactaaaacgtcgggaaaaaccncggttaccgaaggaaacggtacggacccgggtaaaggacccgtaccgggtcttagggttacttaatttagtcgggtacgtaccggggaatttaaccggaacccggtacgggttaaacccgaaggggtaaacggggggacgggttaagaaccggttttcgttacggaaccgg

SEQ ID NO: 235712 - DNA, 575 bp, Homo sapiens
  misc_feature: GYAE6OF02IM9KP.23.17.B06.1.454.CMB.1.raw
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
  modified_base (327)..(327): a, c, t, g, unknown or other
  misc_feature (327)..(327): n is a, c, g, or t
  modified_base (346)..(346): a, c, t, g, unknown or other
  misc_feature (346)..(346): n is a, c, g, or t
  modified_base (365)..(365): a, c, t, g, unknown or other
  misc_feature (365)..(365): n is a, c, g, or t
  modified_base (433)..(433): a, c, t, g, unknown or other
  misc_feature (433)..(433): n is a, c, g, or t
tcagacgcgagtatcacgaccggtgctcgatttagtcgatagtgaaggggctcagagaggagccttagcccctggactccaaggcctttccacgttggtgatcagcactgagcacagaggactcaccatggaattgggctgagctgggtttccttgttgctatttagaaggtgtccagtgtgaggtgcagctggtggagtcgtgggggaggcttggtccaggccgtggggggtccctggagactcgtcctgtgcagcctctggattcacctttagtacctattgatgacctgggtccncaggctccgaggggagggcnggagtgggnggccaacagtaagcaaganggagtgaagaatactatgnggtatcgtgtgaagggccattcaccatcaccagacgacaaacgacaacgactcgactggtactcgtanacaaatcgaaccacgtccgtagacgacgcccggaaggaccctagggctggttagttatttacgttagtcgggactaacggagaccggtaagtacccggaagggtaaaagggggcggggaatacgggttcctttaggaaccgg

SEQ ID NO: 235713 - DNA, 606 bp, Homo sapiens
  misc_feature: GYAE6OF02F6AIO.23.17.B06.1.454.CMB.1.raw
  modified_base (296)..(296): a, c, t, g, unknown or other
  misc_feature (296)..(296): n is a, c, g, or t
  modified_base (376)..(376): a, c, t, g, unknown or other
  misc_feature (376)..(376): n is a, c, g, or t
  modified_base (391)..(391): a, c, t, g, unknown or other
  misc_feature (391)..(391): n is a, c, g, or t
  modified_base (421)..(421): a, c, t, g, unknown or other
  misc_feature (421)..(421): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtggggggtccctgagactctcctgtgcagcctctggattcacctttagtacctattggatgacctgggtccnccaggctccgagggaagggctggagtgggtggccaacataaggcaaagatgggaggtgaagaaatactatgtgactctgngaggcgatcacatcncagagacaacgacaaagaactcactgtatntgacaaagtgaaacacgccgtagacggtacgaccggaagggaccgaacgggtccttagggttacgttaaagtttagtttaggtaggtaaccggaaggtaaacggaaccgtaacggggttaacccgaaagggggaaaagggggtaagggggggaaaggtaaggttaccggttttaggtaacccggg

SEQ ID NO: 235714 - DNA, 861 bp, Homo sapiens
  misc_feature: GYAE6OF02HZ86E.23.17.B06.1.454.CMB.1.raw
tcagacgcgagtatcacgaccggtgctcgatttagtcgatagtgaaggggctcagagaggagccttagccctggactccaaggcctttccacttggtgatcagcactgagcacagaggactcaccatggaagttggggctgagcgttgggttttccttgttgcttattttagaaggtgtccagtgtgaggtgcagctgggtggaggtcgtggggggaggtcgttggtccgaggccggttcgggggggtccctggacgtacctcgtccgtggtgcagcctcgtggtacttcctaccgtttagtacctaagttgggatcggaccgttcggggtacccgtccgagggtccgttacccggaaaggggggtaacggggcgttaggggaacggttcgggggtaccgacccgaaaacgtaaggtaaacgggacgtaaaggagttaggggaacggttaggaaagtaaaagttacttaggttacggttacggtaccgtttcgtagggttaagggaaaccggggtcccggttaaagtttacccgaaacccgttaagtttacccctaccggtaaaacgggaaccgaaaacccggtaaaacgtaaaccgaaaaacggtaaaccctacccgtaaccggttaacgttaacggtttacccgtaggtaaaaccctaaaagtacggaaaacccagggttaacccgtaaggaaacgggtaccgacccggtaaacgggaccgtaaaccgggtcggttaagttacggtttaagttagtttcgggtacggtaacggtaagggtaaccgtaaacgggtaacggaacccggtaaaggggaaaccggggggtaaggggaacgtagggttacggttaacggtcggg

SEQ ID NO: 235715 - DNA, 696 bp, Homo sapiens
  misc_feature: GYAE6OF02IPKWR.23.17.B06.1.454.CMB.1.raw
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtcccctgagactctcctgtgcagcctctggattcacctttagtacctattggatgaccgtgggtcccgccgaggcctccgaggggaaggggctagggaggtgggtgaccaacagtaaggacaagagtgggaggtagaagtaaatacgtaatggtaggacttcgtaggtggaaacggggccgtaacgtttaccaaccgtatacctaccgaagacgtaacaaaaccgaacaaacgaactaccaacttgttaactacgtcgaacaaaacgttcgaaaactacggcccgtaggaacggtacggacccggaaagggaacccgtaccgggtctttaacggttaggttttaacttttagtttagggtacggtaacgggaaggtaacgggtaacccggaacggggttaacccggaaagggggaaaacggggggtacggggggaaggtacggtttaccgggttttaggaccgg

SEQ ID NO: 235716 - DNA, 631 bp, Homo sapiens
  misc_feature: GYAE6OF02JE6GR.23.17.B06.1.454.CMB.1.raw
  modified_base (586)..(586): a, c, t, g, unknown or other
  misc_feature (586)..(586): n is a, c, g, or t
  modified_base (591)..(591): a, c, t, g, unknown or other
  misc_feature (591)..(591): n is a, c, g, or t
  modified_base (594)..(594): a, c, t, g, unknown or other
  misc_feature (594)..(594): n is a, c, g, or t
  modified_base (597)..(598): a, c, t, g, unknown or other
  misc_feature (597)..(598): n is a, c, g, or t
  modified_base (602)..(602): a, c, t, g, unknown or other
  misc_feature (602)..(602): n is a, c, g, or t
  modified_base (604)..(604): a, c, t, g, unknown or other
  misc_feature (604)..(604): n is a, c, g, or t
  modified_base (606)..(607): a, c, t, g, unknown or other
  misc_feature (606)..(607): n is a, c, g, or t
  modified_base (609)..(611): a, c, t, g, unknown or other
  misc_feature (609)..(611): n is a, c, g, or t
  modified_base (613)..(617): a, c, t, g, unknown or other
  misc_feature (613)..(617): n is a, c, g, or t
  modified_base (620)..(622): a, c, t, g, unknown or other
  misc_feature (620)..(622): n is a, c, g, or t
  modified_base (624)..(626): a, c, t, g, unknown or other
  misc_feature (624)..(626): n is a, c, g, or t
  modified_base (628)..(630): a, c, t, g, unknown or other
  misc_feature (628)..(630): n is a, c, g, or t
tcagacgcgagtatcacgaccggtgctcgatttagtcgatagtgaaggggctggagtgggtggccaacataaggcaagatggaggtgagaaatactatgtggactctgtgaagggccgattcaccatctccagagacaacgacaagaactcactgtatctgcaaatgaacagcctgagagccgaggatacggctgtgtattattgtgcgaagagacaggtccaagaaaggaggggagagctttgactgcgtggggccagggaaccctggtcaccgtctccctcagcctccaccaacggggaccccagtccggtaccttccccccgtgggccgtccccgtcgtcccgtcccgtaacgggaccgcccgtaaccccgtcccggaacggtacgacccaaccgaccggccccggtcccccggttacggggcccttaccgggtccccgttacggggtacccgaaaacggggtacctttaacccgtttcccctaagttacccgttcccggtacccggtttcggtacggtaccggggtccgggccggttacgggacccgaaacgggtcccgtaccgtaacgttaggacgtcagngcagngcngcnncgcncngnngnnngnnnnngcnnncnnncnnng

SEQ ID NO: 235717 - DNA, 699 bp, Homo sapiens
  misc_feature: GYAE6OF02FOUGC.23.17.B06.1.454.CMB.1.raw
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttgggtccagccgtggggggtcccctggagactctcctgtgcagcctctggattcacctttagtacctattggatgactgggtccgccaggcctccgagggaaggggctgggaggtgggtggccgaacgagtaaaggcaaaggagtagggaggtagaagaaatacgtagtggtaggaactcgtggtacggaaggggccgtacttaccaccgtatcctaccgtagaacgtaaccaaacgaacaaacggtaaacctacgaacctaggttaaactcgttacgaactaaaagtcgtaaaacgacgtaccgtaaggacggtaacgggaccggtaaacgggaccgtaaccggtaccgttgggtagtttaacgttttagttacgggttacggacggtaaaggtaccggtaaaccgtaaaccgggttacccgggaaaagggtaaacggggggtaacggggggaactaacgggtttacgtttaccgggtaacggg

SEQ ID NO: 235718 - DNA, 711 bp, Homo sapiens
  misc_feature: GYAE6OF02I6A09.23.17.B06.1.454.CMB.1.raw
tcagacgcgagtatcacgaccggtgctcgatttagtcgatagtgaaggggctccagagaggagccttagccctggactccaaggcctttccacttggtgatcagcactgagcacagaggactcaccatggaattggggctgagcttgggttttccttgttgcttatttttagaaggtgtccagtgtagaggtgcagctggtggagtcggtgggggagtcgtttggtccagtccggttcggggggtcccctggaacgccttctcctggtagcacgcctcgtggtactttcgaccttttacgtaccttagttcgggaattcgaccgttcgggtccccgtccacgggtccttaccggagggggaacgggcttgggaggttcggggtcgacccaaactagtaacggcaaagtgtacgggaaggtagaagtaaattccgtaagttcggtaggacttcgttaggaggaacgggtcctaacttaccgaactactttccgaacccgaaggaacaaccgtaaacgaaccgaaacgtaacctcaacgttggttacttcgagaacaaacttacgaaacgtcgacgttacggaacgtccggaaccggagtaccgacggtccttagtaacgtttattggtcgtacggaccggtaatcggaaccggtcggtaaccgaaaggggttaacggggggagggtacggtaccggtttgtttaccggacgg

SEQ ID NO: 235719 - DNA, 603 bp, Homo sapiens
  misc_feature: GYAE6OF02F6FXL.23.17.B06.1.454.CMB.1.raw
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtggggggaggcttggtccagcctggggggtccctggagactctcctgtgcagcctctggattcacctttagtacctattggatgacctggggtcccgccaggctccgagggaggggctgggaggtgggtgccaacgataaggcaagatggaggtgaagaaatactaatggtggactcgtggtagaacggggccgtagtccacctatcctccaagacgaaccaaacgacaaaggtaacctacgaactggttaactccgttgaacctaaatcgaaccgagtccaggagacgccggaagaccgaggcttgggtcttaagtttattggtcggacggaagaacggaacgtaggtaacccgaagggaaacgggggtagggggaacgtacggtacgtttacggacgg

SEQ ID NO: 235720 - DNA, 854 bp, Homo sapiens
  misc_feature: GYAE6OF02HVUBL.23.17.B06.1.454.CMB.1.raw
  modified_base (195)..(195): a, c, t, g, unknown or other
  misc_feature (195)..(195): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaagttggggctgagtcgttgggttttcccttgttgcttattttagaaggtgtccagtgtgaggtgnagctggtggagtcgtgggggagtcgttcggtcgtacggtccgttcgggggggtccctggaacgtaccgttccgttcccgttaggtcgccgtacgtcccgttaccgttgggtaacttttaccgtaacccgtttttacgttaacccgttaaggtttggtacttaccggtacccggttccggggttaccccgcccgtaacgggtcccgttaacccggtaagggggtaacggtcggttaccgggtaggggtacggttcggggggttaaccggacccaaaacgtacggttaaaacgggcctaaaagggtagttccggggtaagggttagtaaaaccgtaaaagtttacccggtaagtttcggggtaacgtacccgttagttacggggttacgggtacgggggtaacccttacggttaccctaacccgtaacgttccgtaccgaaagggacctaaaccggaaaccgtaacgtaacggtaaccttaccgtaaccgtggttaacctacgttacgaacgttaaagtaccggaaacgtccgtacccgtggaaccgtacgggaacccgtaggaaaccgcggttacgtgggttaacgtacgtttaagttcggaggtacgtaggcggtaagccggtacggaaggaaggggtagggtacgtacgttagtacgg

SEQ ID NO: 235721 - DNA, 745 bp, Homo sapiens
  misc_feature: GYAE6OF02J08KA.23.17.B06.1.454.CMB.1.raw
  modified_base (197)..(197): a, c, t, g, unknown or other
  misc_feature (197)..(197): n is a, c, g, or t
tcagacgcgagtatcacgaccggtgctcgatttagtcgatagtgaagggctcagagaggagccttagccctggactccaaggcctttccacttggtgatcagcactgagcacagaggactcaccatggaattggggctgagctgggttttccttgttgctattttagaaggtgtccagtgtgaggtgcgagcgtggnggagtcgtgggggaggcttggtccaggccgtggggggtcccctggagaccgtctccgtgtgcacgccttcgtggtattccacctttagtacctattgggatggaccgtcgggtccgaccgtaggccgtccgaaggggaacgggtcggtcggtaggtggggtcggaccaaacgtagtaaggcaagagttaggaggttcggaagaaacttacgtaggttggtaggtacgtacttggtacgggaacggggtcccgagtttaccgaaccgtattaccgtaccgaagggtaacgaaccgaaacgaacgaaaacgtaacgtaccgtaaccgttggttaacttaccgagttaccgaaaagtagtaaaccgacggtccgttaggaacggaacgggtacccggaaagggtccgtaaccgggtaacgttgggttaacgttaacgtttacggttaggtttacgggaaacccggagggtaaacgaaccggtacggggtaaacccgtaaaggggaaaccggggagggggggtaagtacggtaccgggttttagaacccggg

SEQ ID NO: 235722 - DNA, 612 bp, Homo sapiens
  misc_feature: GYAE6OF02GJUZX.23.17.B06.1.454.CMB.1.raw
  modified_base (475)..(475): a, c, t, g, unknown or other
  misc_feature (475)..(475): n is a, c, g, or t
  modified_base (557)..(557): a, c, t, g, unknown or other
  misc_feature (557)..(557): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggtttccttgttgctatttagaaggtgtccagtgtgaggtgcagctggtggagtcgtgggggaggcgttggtccagccgtggggggtcccctgagactctcctgtgcagcctcgtggattcctacctttagtacccttattgggatcggtaccgtggggtccccgaccgaggcctccggaaggggaagggggccgtaggggaggttcggggtcggacccgaaacgagtaaaggacgaagagtgggaaggtgaagtaaatactagtggtggtactcgtagtggaacgggcgtacttaccaccgtatccgtaccgaagacgaacaacggaanaaacgaactcactgttatctagactaaatgaacacgtctagacgacggccggaagccgtacggctgtacttagttagttggngacggagagacgtacggtacgaagggtaagggggagggagaggttcgtagtacgg

SEQ ID NO: 235723 - DNA, 590 bp, Homo sapiens
  misc_feature: GYAE6OF02FMR8K.23.17.B06.1.454.CMB.1.raw
  modified_base (298)..(298): a, c, t, g, unknown or other
  misc_feature (298)..(298): n is a, c, g, or t
  modified_base (334)..(334): a, c, t, g, unknown or other
  misc_feature (334)..(334): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgtggggggtcccctgagactctcctgtgcagcctctggattcacctttagtacctattggatgacctgggtcccnccaggcctccgagggagggctggagtgggtgccaanagtaaggcaagagtgggaggtagaagaatactagtgtggactcgtagtggaacgggccgtatttccgactatctacagacgacaacgacaagtactcacgtagtatcgtagactaaatcgaacacgtaccgtaggacgacgaccggaacggaaccgaccgggtcttggttacttagtttagtcggtggacggaagacggacgtacggtaccggaagggtaacggggagggggtaagtcggttacgtttggaaccgg

SEQ ID NO: 235724 - DNA, 558 bp, Homo sapiens
  misc_feature: GYAE6OF02F15N7.23.17.B06.1.454.CMB.1.raw
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtacctattggatgacctggtccgccaggctcgagggaagggctggagtgggtggccaacataaggcaagatggaggtgagaaatactatgtggactctgtgaagggcgatcaccatctcagagacaacgacaagaactacactgtactcgtagacaaagtgaaccagacctaggagaccgaccggacggaccgaacggtctgtacgttatttagttggtggcggaagacgaacgtacggtaccgaagggaaaggggaaggggggaagtaggtaccgtttaggaacgg

SEQ ID NO: 235725 - DNA, 745 bp, Homo sapiens
  misc_feature: GYAE6OF02J17DL.23.17.B06.1.454.CMB.1.raw
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctatttagaaggtgtccagtgtgaggtgcagctggtggagtcgtgggggagcgttggtccaggccgtggggggtcccctgacgacctctcctgtgcacgcctcgtggtacttctacctttagtaccttagttggatgaccgtgggtccgccgaggctccgaagggagggctgggaggttgggtcgccaacaagtaggacgaagatgggagtgaaataaagttactagtggtacggtactcgttaggaggtaacgggtcctaagtttcacctagtaccgtacccaaaggtaacgaacccgtaaacggaccgtaaagaaacccttacgtaacgttacggttacttaaccgttggaaacctaaaggttaaccgaacgtaaccgtacccggttagaaacgggtacccggaaccgggaacggaacccgggaaccgggtacggttagttttaacggtttaacgtttacgtttacgggtacggtaacccgggaaggtaacggtaaacccggtaacggggttaaccggaaagggggtaaaacgggggtaacggggggtaaacggtcggttaacggttttaacggtaaaccgggg

SEQ ID NO: 235726 - DNA, 480 bp, Homo sapiens
  misc_feature: GYAE6OF02G6LC3.23.17.B06.1.454.CMB.1.raw
  modified_base (432)..(432): a, c, t, g, unknown or other
  misc_feature (432)..(432): n is a, c, g, or t
  modified_base (435)..(480): a, c, t, g, unknown or other
  misc_feature (435)..(480): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggagggggagagctttgactgcgtggggccagggaaccctggtcaccgtctcctcacgcctccaccgaacgggccccagtccggtccttcccccctggccgcccctgccctccgagggacgccaccctcccggaagacgccacacggccggccccgtggggcctcggcccgttggtaccaaacggccttaaccttcccaacgttaccgtccggccgttcgtaggacgggtccggggtctcggggaccgaaacgggccggtacaagtacgcanctnnnnnnnnnnnnnnnnnnnnnnnnnnnnnnnnnnnnnnnnnnnnnn

SEQ ID NO: 235727 - DNA, 947 bp, Homo sapiens
  misc_feature: GYAE6OF02IG5HS.23.17.B06.1.454.CMB.1.raw
tcagacgcgagtatcacgaccggtgctcgatttagtcgatagtgaaggggctcagagaggagccttagccctggactccaaggcctttccacttggtgatcagcactgagcacagaggactcaccatggaattgggctgagcttgggttttccttgttgcttattttagaaggtgtccagtgtgaggtgcagctggtggagtcgtgggggaggtcttcggtccagccgtggggggtccctggacgactctccgtgtgcagccgttctggtaactttcctaaccgtttttacgttaacccttaagtttgggaagttacggtaacccgttcgggggtaccccgtacccgacggggtacccttcccggaaaggggggtaacgggggcccttagggggtaacgggtttggggggtacggtaccccgtaaaacgtaacggttaaaagggaaccgtaaaaggtacggttagggggtaacgggttaggaaacgggtaaaaacttaaccggttaagtttacgggttacggtaaaccgtttcgggttaaggttacggggaaacgggggtacccgttacgtttaccccggtaaaccctagttacccgttacccgaaacgggttaaacggaaacccgaaaccggtaaaaaccgtaaaacggtaaaacccttccgtaaacgttaacggtttaaaccgttccgttaacgggaacctaaaaacggttacggaaaaacccggtacggtacccggttaagggaagggaacccggtaacccggggaaagggacccgtaaacccgggttcgtttaggttacggtttttaacgtttacggttttcggtaacgggtacccgggaaggtaaccggtaaccgggttaaccggttaacccggaaagggggtaaaaccgggggaggggggttaacggaacgggttttccggtttaaccggttaacccgggg

SEQ ID NO: 235728 - DNA, 676 bp, Homo sapiens
  misc_feature: GYAE6OF02GANT0.23.17.B06.1.454.CMB.1.raw
  modified_base (305)..(305): a, c, t, g, unknown or other
  misc_feature (305)..(305): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagcgtggtggagtcgtgggggagcttggtccaggccgtggggggtccctggagactctctgtgcacgcctctggtacttcacctttagtaccttaattggactgaccgtgggtccnccgacggctccgaggggaagggctgggaggtgggtcgaccaagagtaacggcaagagtggaggtaggaagaaaatactagtggtacgactcgtggtaaggaacggggcccgtaatttcccgacctacgttaccttaccgaacgaaacgaaccgaaaccgtaaccaaaacgaaccttaccgacttacgttattaccgtagaactaaagtacgaaaccgtagacccgtaggaaggtaacggacccggaaggaaccgaaccggtcggtagttagttagtttagttacggtggtacggaaggtaacggtaacggacgggttaaccgaaacggggaaagggggaacggggaaggtacggttacgttaggtaaccgg

SEQ ID NO: 235729 - DNA, 484 bp, Homo sapiens
  misc_feature: GYAE6OF02JGD0Z.23.17.B06.1.454.CMB.1.raw
  modified_base (254)..(254): a, c, t, g, unknown or other
  misc_feature (254)..(254): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
  modified_base (432)..(446): a, c, t, g, unknown or other
  misc_feature (432)..(446): n is a, c, g, or t
  modified_base (448)..(484): a, c, t, g, unknown or other
  misc_feature (448)..(484): n is a, c, g, or t
tcagacgcgagtatcacgaccggtgctcgatttagtcgatagtgaagggccgattcaccatctccagagacaacgacaagaactcactgtatctgcaaatgaacagcctgagagccgaggacacggctgtgtattattgtgcgagagacaggtccagaaaggagggggagagctttgactgcgtggggccagggaaccctggtcaccgtcctcctcagccctccaccaacgggcccatccggtccttcccccgnggccgcccctgcctccgaggacgccaccgtccgacgagcacgacgccggcccgtgggcctcggccgtggtaccgaacggaccttaccttccaacgtaccgtaccggtccgttcgtagggtacggccggggtacgttacgggaccgaaacgggccgtacgtaacggtacgngngcnctnnnnnnnnnnnnnnncnnnnnnnnnnnnnnnnnnnnnnnnnnnnnnnnnnnnn

SEQ ID NO: 235730 - DNA, 452 bp, Homo sapiens
  misc_feature: GYAE6OF02IF8N6.23.17.B06.1.454.CMB.1.raw
  modified_base (237)..(237): a, c, t, g, unknown or other
  misc_feature (237)..(237): n is a, c, g, or t
  modified_base (436)..(452): a, c, t, g, unknown or other
  misc_feature (436)..(452): n is a, c, g, or t
tcagacgcgagtatcacgaccggtgctcgatttagtcgatagtgaaggggctggagtgggtggccaacataaggcaagatggaggtgagaaatactatgtggactctgtgaagggccgattcaccatctccagagacaacgacaagaactcactgtatctgcaaaatgaacagcctgagagccgaggacacggctgtgtattattgtgcgagagacaggtccagaaaggaggggganagctttggactgcgtggggcagggaaccccgtggtcaccgtctcctcacgcctccaaccaacgggacccagtccggtccttcccccgtggccgccctgctccgaggacgcacctccgagacgcacgagcggccctgggctgcctggtcaaggctacttccatactcgcgtctggagcgggcctggcaaggcgacagtannnnnnnnnnnnnnnnn

SEQ ID NO: 235731 - DNA, 759 bp, Homo sapiens
  misc_feature: GYAE6OF02JSVC9.23.17.B06.1.454.CMB.1.raw
  modified_base (201)..(201): a, c, t, g, unknown or other
  misc_feature (201)..(201): n is a, c, g, or t
  modified_base (556)..(556): a, c, t, g, unknown or other
  misc_feature (556)..(556): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattgggctgagctgggttttccttgttgctatttagaggtgtccagtgtgaggtgcagctggtggagtcgngggggagtcttggtccaggccgtggggggtccctgagactctcctgtgcagcctcgtggtacttcctaccgtttagtaccttagttcggatcgacccgttggggtcccgtccgaggtcctaccggaggggaacgggtcgtgggtacggtggggtaccggtaccaacgtagtaaacgggacgaaaggaggttagggaggtaagaaaggtaaacttaacgtagttacggtacggtaacgttcgttaggggtacggtaacgggacccgttagttaccgtaacccgagtttacccgtaccgaaggtaaaccgaaacccgtaaaccggaaacgtaaaccggaaaccgttaccaacgtttntaaacgttccgtaaagaacctaaacgacggaaaccctcgtacgtaaggaacgaaccggacccgggaagtaccgtacggttaccgttagttacgtttaattttagtcggtaccggaacgtaagggaaacgttcccgaagggggttaacccgaaaaggggaacgggggtacggggaagtcggtttacccggtttaggaacccggg

SEQ ID NO: 235732 - DNA, 724 bp, Homo sapiens
  misc_feature: GYAE6OF02I0CZJ.23.17.B06.1.454.CMB.1.raw
  modified_base (204)..(204): a, c, t, g, unknown or other
  misc_feature (204)..(204): n is a, c, g, or t
  modified_base (517)..(517): a, c, t, g, unknown or other
  misc_feature (517)..(517): n is a, c, g, or t
  modified_base (618)..(618): a, c, t, g, unknown or other
  misc_feature (618)..(618): n is a, c, g, or t
  modified_base (711)..(711): a, c, t, g, unknown or other
  misc_feature (711)..(711): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgngggggaggcttggtccagccgtggggggtcccctgaggacctctcctgtgcacgcctcgtggtacttcctaacctttacgtacctagttcggatacgtaccggtcggccgacgacgggcctccggaggggtaacgggcggttagggacgggttggggcggaaccctaaacgtagtaaacgggacaaagggtacgaggggtaggtacgtaaaggtaaaacgttagtacgtttaggacgttacgttacgtacgggtaaggaacggggtaccgtacgtttaccaaaccgtgttaacccgtcaaagggacccgaaanaacccgggtaaactaaacgtaccacgtacttaggtactctacggaactaaggtccaagccgtagtacgggaacgtacccgacggacggtacaaccgggttnttacgggtaatttcgttaggttccgacggtacgtaaaggacttaacggggtaacccggtagaaaagggacgggggaagggttataacgggttnttaccggtacggg

SEQ ID NO: 235733 - DNA, 726 bp, Homo sapiens
  misc_feature: GYAE6OF02H00PD.23.17.B06.1.454.CMB.1.raw
  modified_base (300)..(300): a, c, t, g, unknown or other
  misc_feature (300)..(300): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggtcttggtccagccgtggggggtccctgagactctctgtgcagcctctggacttcacctttagtacctattggatcgaccgtgggtccncaggcctccgaggggaacggggcgtgggaggtcggggtggacccaaacgagtaacggacaaaggtagtacgggaggttacgaaagtaaattacgtagtggtacggtacttcgtaggtacggaacggggtcccgtaactttacccaaccgttacttacccgtaccgaaagggaacgtaacccgaaaacggtaaccaaaacgtaacctaccgtaacgttagttaaccttcgttaacgaacctaaagtacgaaaccgtcgtacccgtaggaacggacggaccggaacgggtaaccgacgggtacgtttagttaacggtttatttacggttcggttacggaacgggtaacggtaacggaaccggtaccgggtaacgaaacgggggtaaagggggacgggggtaataacgggtttccgttagggtaaccgg

SEQ ID NO: 235734 - DNA, 711 bp, Homo sapiens
  misc_feature: GYAE6OF02FXT4Z.23.17.B06.1.454.CMB.1.raw
  modified_base (252)..(252): a, c, t, g, unknown or other
  misc_feature (252)..(252): n is a, c, g, or t
  modified_base (624)..(624): a, c, t, g, unknown or other
  misc_feature (624)..(624): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagtcttgggttttccttgttgctattttagaggtgtccagtgtgaggtgcagctggtggagtcgtgggggagcgttggtccagccgtggggggtccctggagtcctcttccngtcgcacgcctcgtggattcctactttacgacctttatggattgaccgtggtcccgcaggctacggagggaggggctgggacgtggggcgtacctaacaaggtaacgacgtagagtaggggtaaggtacgaagtaaactcgtatagggtaggtaccttacgttacgggtacgggaaacggggtccggtaacttacccggtaaccgtactttacggtacccagggtaacggaaaccggaacgaaacgtaaacggtaaacccttaccggaaaccgttcggtttaaactccgttaacggaacgtaaacgttacgaaacgacggtccgtaggaacgggacggtaacccggacggaaccggtaccgacgttaggttntaaccgtttaggtcgtaacggtggaacggacgaccgttaggtacccggaagggaaggggaggggtacgtaacggtagttacgtacgg

SEQ ID NO: 235735 - DNA, 732 bp, Homo sapiens
  misc_feature: GYAE6OF02HS7M3.23.17.B06.1.454.CMB.1.raw
tcagacgcgagtatcacgaccggtgctcgatttagtcgatagtgaaggggcgtcagagaggagccttagccctggactccaaggcctttccacttggtgatcagcactgagcacagaggactcaccatggaagttgggctgagctgggttttccttgttgctatttagaagtgtccagtgtgaggtgcagctggtggagtcgtgggggacgcttggtcaggccgttggggggtccctagagtactctccgtgtgacgacgctccgtaggacttcaccttttaacgtaccttattggtaatggtaccgtgggtcccgccaggcctaccgaagggaaggggtcctgggacggtggggttcggaccaaaacgtagtaagggacgaaaggagtggtaaggtggaaagaaattactagtcgtggtaacttcgtagtaggaacgggactacgttaccacgtaactcgtacccgaaaggaagaacccgtaaagaaaacggtaaacggtaaaaccttcctaaacgttacgttaacgttaccgtaggaaccttaaaaagtagaaaccgtacggaacccgttagttaacggaaccggaccgggaacgggaacccggacgggtacgttaggttaagtttacgttaagttcggttagggtaccggaaaggacgtaacggtaacggtacccgtaaagggtaaacggggaacggggttaaggtaacggttcgttaacggttacggg

SEQ ID NO: 235736 - DNA, 681 bp, Homo sapiens
  misc_feature: GYAE6OF02HPJND.23.17.B06.1.454.CMB.1.raw
tcagacgcgagtatcacgaccggtgctcgatttagtcgatagtgaaggggctcagagaggagccttagccctggactccaaggcctttccacttggtgatcagcactgagcacagaggactcaccatggaattggggctgagcttgggttttccttgttgcttattttagaaggtgtccagtgtgaggtgcagctggtggagttcgtgggggagtcgttggtccaggccgtgggggtccctggagactctcctgtgcagcctcgtggtattcctaaccttttacgtaccttagttcggatcgaccgtcgggtcccgccgacggcctacggaaggggaacggggcgtgggaggtggggtacgaccaaacgagtaaacggacaaggagtagggaaggtagaaagtaaacttactagtaggtacggtacttgtagtacgggaacgggtccgtaagtttacccaacgtactcccgtaaccgaaggaacgaaaccaaaccggaacaaacggtaacctacgtaacgttagttaacttcgaacgtaacaaagtcgaaacctcgtaccgtaagacgggaaccgcccggaaggacccgtacgggtctagttaagttatttagttcggacgaggaaggaccgtaacgacggtaacgaagggaacggggagggtatacgttacgttagacgg

SEQ ID NO: 235737 - DNA, 592 bp, Homo sapiens
  misc_feature: GYAE6OF02FURRS.23.17.B06.1.454.CMB.1.raw
  modified_base (301)..(301): a, c, t, g, unknown or other
  misc_feature (301)..(301): n is a, c, g, or t
  modified_base (391)..(391): a, c, t, g, unknown or other
  misc_feature (391)..(391): n is a, c, g, or t
  modified_base (415)..(415): a, c, t, g, unknown or other
  misc_feature (415)..(415): n is a, c, g, or t
  modified_base (424)..(424): a, c, t, g, unknown or other
  misc_feature (424)..(424): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctggagactctcctgtgcagcctctggattccacctttagtaccttattggatgaccttgggtccnccaggcctccgaggggaaggggctgggacggtgggtggccaacagtaaggacaaggagtggaggtgagaaatactatgtggactcgtggngaacgggcgattcacatctcaganaacaacganaacgacacactgtactctagcaaatcgaaacacgtacctagaacggacgcggaaccgggcgaacggtcttacggttagttaagtttacgttaggacggtcggaaggaccgaacgtacgggtacccgaagggaaacgggggagggggaagtacggtcggtttagacggg

SEQ ID NO: 235738 - DNA, 844 bp, Homo sapiens
  misc_feature: GYAE6OF02FUDFJ.23.17.B06.1.454.CMB.1.raw
tcagacgcgagtatcacgaccggtgctcgatttagtcgatagtgaaggggctcagagaggagccttagccctggactccaaggcctttccacttggtgatcagcactgagcacagaggactcaccatggaagttggggctggagcgttgggttttccttgttgcttattttagaaggtgtccagtgtgaggtgcagcgtggtggagtcggtgggggacgtcgttcggtccgaggtccggttcgggggggtcccctaggaccgtaccgttaccttccgtggtcgcacgtccttcgtggtacttccgtaaccttttagtaaccttagttggattacggtaccgttcgggtcccgccgtacggccgttaccggaagggggaacggggtccgtaggggtacggtggggtacggaaccccaaacgtaacggtaacgggacgtaaaggtaggtaggggtaaggtaacggaaagtaaacgttacgttaggtttacggtacggtaaccgttgtacggtacgggtaaaccgggtccgttaccgttaccgtaaccgttacctaccggtaaccgaaaggaacggtaaaacccaaacggtaacgaaaaacggtacccttacgaacgtttaaggttaacctccgtaacgtaaacaaaccgttaagaacccgtagtcccgtaaggaacggacccgtaaccgggaacggtcccgaaacggttccgttaagggttcgtttaagttttacggtgggtaacggtacgggtaaacgaccggtaacccggggtaaccggttaaacccggaaaagggggtaacggggggttacgggaactttaccgggttagtttaccggggccg

SEQ ID NO: 235739 - DNA, 605 bp, Homo sapiens
  misc_feature: GYAE6OF02G11GG.23.17.B06.1.454.CMB.1.raw
  modified_base (292)..(292): a, c, t, g, unknown or other
  misc_feature (292)..(292): n is a, c, g, or t
  modified_base (533)..(533): a, c, t, g, unknown or other
  misc_feature (533)..(533): n is a, c, g, or t
  modified_base (539)..(539): a, c, t, g, unknown or other
  misc_feature (539)..(539): n is a, c, g, or t
  modified_base (545)..(545): a, c, t, g, unknown or other
  misc_feature (545)..(545): n is a, c, g, or t
  modified_base (550)..(550): a, c, t, g, unknown or other
  misc_feature (550)..(550): n is a, c, g, or t
  modified_base (552)..(553): a, c, t, g, unknown or other
  misc_feature (552)..(553): n is a, c, g, or t
  modified_base (557)..(605): a, c, t, g, unknown or other
  misc_feature (557)..(605): n is a, c, g, or t
tcagacgcgagtatcacgaccggtgctcgatttagtcgatagtgaagggccgattcaccatctccagagacaacgacaagaactcactgtatctgcaaatgaaacagcctgagagccgaggacacggctgtgtattattgtgcgagagacaggtccagaaagggagggggagagctttgactgcgtggggccagggaacccgtggtcaccgtctccgtcacgccctccaaccgaacgggcccaacgttccggttcccgttccccccgtagggcccgtccccacgttttcccnccgtaagggtaccgcccgtaacccctacccggaaggaaccgacccgaacgaccgggccccgggtaccccggtcgggggaccgttccgggtacccggttacggggttaaccggaaaaccgggttacctttaacccgggtttaacccctaacggttaacccgttcccggtaccggttccgttaacgggaccggggacccgggggttccgtacggggaaccgaaacgggccggacctaaagtanagtgcnaaccgnacgtnannacgnnnnnnnnnnnnnnnnnnnnnnnnnnnnnnnnnnnnnnnnnnnnnnnnn

SEQ ID NO: 235740 - DNA, 672 bp, Homo sapiens
  misc_feature: GYAE6OF02IB2EA.23.17.B06.1.454.CMB.1.raw
  modified_base (173)..(173): a, c, t, g, unknown or other
  misc_feature (173)..(173): n is a, c, g, or t
  modified_base (320)..(320): a, c, t, g, unknown or other
  misc_feature (320)..(320): n is a, c, g, or t
  modified_base (360)..(360): a, c, t, g, unknown or other
  misc_feature (360)..(360): n is a, c, g, or t
  modified_base (381)..(381): a, c, t, g, unknown or other
  misc_feature (381)..(381): n is a, c, g, or t
  modified_base (501)..(501): a, c, t, g, unknown or other
  misc_feature (501)..(501): n is a, c, g, or t
tcagacgcgagtatcacgaccggtgctcgatttagtcgatagtgaagggggctcagagaggagccttagccctggactccaaggccctttccactttggtgatcagcactgagcacagaggactcaccatggaattggggctgagcgtggttttctgttgctatttagaggtntcagtgtgaggtgcagctggtggagtcgttgggggggaggcgtttagggtccaaggccgtcgggggggttcccctgaagtacctcctcctgtgcaggcctctggattctacctttagtaacctagttcggatgaccttggggtaccnccaggccttaccgaaggggaacggggcgtggacggtgggnggtaccaaacgaataaacggnaagataggaggtagaagaaatactagtagtcggaacttcgtagaggaacgggaccgtaattaccgacctataccctacgtaaggaaacggaaccaaaaccggaaacaaacggtaaaaccncgtaaacttgttaaacttcctagaactaaaagtcgaaaccaagtcctaacggagaacgccgggaaggtaacacgacgtgttagtatttagttgggtagtacgaacggaggtaaccgaacggttaccgaaagggtaaaagggggacggggtaaggaacgttagttgtaacgg

SEQ ID NO: 235741 - DNA, 545 bp, Homo sapiens
  misc_feature: GYAE6OF02FXSZF.23.17.B06.1.454.CMB.1.raw
  modified_base (175)..(175): a, c, t, g, unknown or other
  misc_feature (175)..(175): n is a, c, g, or t
  modified_base (484)..(484): a, c, t, g, unknown or other
  misc_feature (484)..(484): n is a, c, g, or t
  modified_base (487)..(487): a, c, t, g, unknown or other
  misc_feature (487)..(487): n is a, c, g, or t
  modified_base (489)..(493): a, c, t, g, unknown or other
  misc_feature (489)..(493): n is a, c, g, or t
  modified_base (496)..(496): a, c, t, g, unknown or other
  misc_feature (496)..(496): n is a, c, g, or t
  modified_base (499)..(505): a, c, t, g, unknown or other
  misc_feature (499)..(505): n is a, c, g, or t
  modified_base (507)..(545): a, c, t, g, unknown or other
  misc_feature (507)..(545): n is a, c, g, or t
tcagacgcgagtatcacgaccggtgctcgatttagtcgatagtgaagggccgattcaccatctccagagacaacgacaagaactcactgtatctgcaaaatgaacagcctgagagccgaggacacgggctggtgtattattgtgcgagagacaggtccaggaaagggaggggganagtctttgacgtgcgtggggccacgggtaaccctgggtcacccgtcctcctcacgccctaccaccgaacggcccagttccggtcccttccccctgggtcccgcccctgtcctccgaaggcgccaccgtccgaagacgccaacgacggtccccgggcccgtacggggtcctccgggtccccgttggggtaccggtaaaacggtacccttaaccgttacccaacgttacccgtcgtccgttacctcggggaaccgggtccggggtactacgggggaccgaacgggtccgaccgtaagttaggctaatgacngtnannnnnacnacnnnnnnncnnnnnnnnnnnnnnnnnnnnnnnnnnnnnnnnnnnnnnn

SEQ ID NO: 235742 - DNA, 929 bp, Homo sapiens
  misc_feature: GYAE6OF02GBS5J.23.17.B06.1.454.CMB.1.raw
  modified_base (177)..(177): a, c, t, g, unknown or other
  misc_feature (177)..(177): n is a, c, g, or t
  modified_base (208)..(208): a, c, t, g, unknown or other
  misc_feature (208)..(208): n is a, c, g, or t
  modified_base (719)..(719): a, c, t, g, unknown or other
  misc_feature (719)..(719): n is a, c, g, or t
tcagacgcgagtatcacgaccggtgctcgatttagtcgatagtgaaggggctcagagaggagccttagccctggactccaaggcctttcacttggtgatcagcactgagcacagaggactcacccatggaatttggggctgagcttgggttttccttgttgctattttaggaaggtntccagtgtgaggtgcagctgggtggagtcgngggggagcttggccgagccgtcgggggtcctggagtctccgtcctgtcgcacgtcctcgtggtacttccgtaccttttaacgtaccttagttcggtactacggtaccgtacggggttcccgacccgtagggcccgttaccgggacgggggtaaacggggggcgttagggggacgggttacgggggttaccggacccgtaaaaccggtaagtaaacgggaaaccggtaagaagttacgggggtaaggttaacgggaaacggtaaaagtttacggttaacggtacggtttagggtaaccgtttcggtttacggaacgggggtaaacccgggtacccggtaacgtttaacccgtacccttaacgttacccccggttaacgaaacgggtaaacgtaaacccggaaaaacccgtaaccgtaaaaacggtaaacccgttacgaaaccggtttacgttaaacgttccggtaaacgtaaccttaaaagtaacggtaaaccgaaccgttaccgggtaaanaacgggtaccggtaaacccgggaacggtaacccgtaaccgggttccggttaaagttttacgggtttaatttacgggttttacgggaacgggttaacgggtaaacgttaaccggggaccggtttaaacccgggaaaccgtaacgggggggtaaaaacggggggaagggggttaaccggtaacgggtttaacgggttttacccgaaccgggg

SEQ ID NO: 235743 - DNA, 789 bp, Homo sapiens
  misc_feature: GYAE6OF02IWTT9.23.17.B06.1.454.CMB.1.raw
  modified_base (709)..(709): a, c, t, g, unknown or other
  misc_feature (709)..(709): n is a, c, g, or t
tcagacgcgagtatcacgaccggtgctcgatttagtcgatagtgaaggggctcagagaggagccttagccctggactccaaggcctttccacttggtgatcagcactgagcacagaggactcaccagtggaagttggggctgagcgttgggtttttcctttgttgcttagttttagaaggttcgtccagtgtgaggtgcagcgtggtggagtcggtgggggagtcgttggtccgaggtcccggttcggggggtccctaggacgtaccttcgtccttgtgacgactccgttcgtggtactttcctaccgttttagtaccttaggttaggaatcgtaccgtcggggtcccgccgaggtcctccggaagggggtaaggggccgtagggtagggttggggtcgacccaaagaggttaaacgggcaaaggtaggtaggggaaggtacggaaagtaaacgttaactaggtggtaacgtacgttagtggtacgggaacgggtcctaactttccaacccgtattcccgaacgaacgggtaaacgaaaccgtaaaaccgaaccgtaaaaaggtaccctttagaacccggttaagttacttaccccggtaagtaaacgtaaaacgtagtaaaccccgtcggaacctagggaaccgtaaccggaacccgggtaacggaaccgtaccggggttacgtacgttagtttacttgtttacgggnggtaaccgacggtaacggtaacggaccggtaacggaaaggggtaacggggagggtaactaggttcccggtttaggtacgg

SEQ ID NO: 235744 - DNA, 684 bp, Homo sapiens
  misc_feature: GYAE6OF01CBBYK.16.64.F09.1.454.CMB.1.raw
  modified_base (307)..(307): a, c, t, g, unknown or other
  misc_feature (307)..(307): n is a, c, g, or t
tcagtgtactactccacgaccggtgctcgatttagcgcgtatacaaggggtctgggagacgagcccagcactggaagtcgccggtgtttccattcggtgatcagcactgaacacggaggactcaccatggagtttgggctgagcttgggttttcctcgttgctcttttaagaggtgtccagtgtcaggtgcagctggtggagtcgtgggggaggcggtggtccagccgtggggaggtcctgagactctcctgtgtacgcctcgtggacttcaccttcaactaaccatcctctgctacgtcgggtccncgacggctccgaggaccgaagggctggaggtgggtgctagttatagtcaatagtaggatagggaaactaaataaatacctagacaaggtacctaccggtagaaacggccgtataccgacctatctaccaagaacgaactaaacgttaaccaaaaacgtcgactacgtactctacgacaacctaatacgaaaccgtacgacccgtaaggtaacggtaacggggtacggaacgggtaaccgaccgggtacgttacggttaacgtttacgttaaccggtacggaaccgggtaccggaaggggtacgggtaccgggaacgtaaacggtaaacgtaacccgttaaccgttaaggtcgggttaacgttttccggttttaacgg

SEQ ID NO: 235745 - DNA, 622 bp, Homo sapiens
  misc_feature: GYAE6OF01BCRKM.16.64.F09.1.454.CMB.1.raw
tcagtgtactactccacgaccggtgctcgatttagcgcgtatacaaggggtctgggagacgagcccagcactggaagtcgccggtgtttccattcggtgatcagcactgaacacggaggactcaccatggagtttgggctgagctgggttttcctcgttgctcttttaagaggtgtccagtgtcaggtgcagctgggtggagtcgtggggggagcgtggtccagccgtgggaggtccctgagactctcctgtgtacgcctctggatttccaacctttacaaattaacccattccctctgccacgttcgggtcccaccgagggcctaccgaggacgaagggggctgggaggtcggggtggactagtttatagtctatagtgagtaggaaataaataaatactacgcaagacctccggtagaacgggtcctattacccactactcctaccgaagaacgtaactaaacttaaccaaaaacacgtactagttaactcgtacgacacaatacgaaccacgaccgtagacggaggtagaacggacgacggtctagtacgttatacgtggacggtcgaggacggtcggacgtaagaaacgtaccgtaccgtagtaggtacttgtttacg

SEQ ID NO: 235746 - DNA, 729 bp, Homo sapiens
  misc_feature: GYAE6OF01DO9GX.16.64.F09.1.454.CMB.1.raw
tcagtgtactactccacgaccggtgctcgatttagcgcgtatacaaggggtctgggagacgagcccagcactggaagtcgccggtgtttccattcggtgatcagcactgaacacggaggactcaccatggagtttgggctgagctgggttttcctcgttgctcttttaagaggtgtccagtgtcaggtgcagctggtggagtcgtgggggaggcgtggtccagccgtggggacgtccctgagactctccgtgtgtagcctcgtggacttccacccttacaaactaacccacttccctctcgctaccgtgggtccccgccgaggcctcccgagggcgaagggggctggggaggttggggtcggactagttatagtcaattagtgagttaagggaaattaaaattaaaactacgttaacggcctaacggtaccgttaccgggttagggaaaccggggtacccgttaagtttacccaaccgtaacttacccgtacccgaaaggaaccgtaaacctaaaacctttaaacccgaaaaaacgtacccgtacgttacgtacttaccgtacgacctaactaacgtacgaaaccgtacgtaccgtagggaacggtagggtacggaacgggtaccgtacgggtccgttaggttacgttacgtacgtcggacggtacggaggacgggtcgaacggtaagaacgtaaccgtacgtaggttacgggtcttttcgttaaccgg

SEQ ID NO: 235747 - DNA, 598 bp, Homo sapiens
  misc_feature: GYAE6OF01EXKV4.16.64.F09.1.454.CMB.1.raw
  modified_base (308)..(308): a, c, t, g, unknown or other
  misc_feature (308)..(308): n is a, c, g, or t
  modified_base (541)..(541): a, c, t, g, unknown or other
  misc_feature (541)..(541): n is a, c, g, or t
  modified_base (546)..(546): a, c, t, g, unknown or other
  misc_feature (546)..(546): n is a, c, g, or t
tcagtgtactactccacgaccggtgctcgatttagcgcgtatacaaggggtctgggagacgagcccagcactggaagtcgccggtgtttccattcggtgatcagcactgaacacggaggactcaccatggagtttgggctgagctgggttttcctcgttgctcttttaagaggtgtccagtgtcaggtgcagctggtggagtctgggggaggcgtggtccagcctggggaggtccctgagactctcctgtgtagcctctggattccacctttcaataacccattccctctgcctacgtcggggtcccnccgagggcctccgaggggtccaaagggggcttaggggagtggggtggctaggtttatatcatatgaagtaggaaagtaaataaaactactaacgcaagtacctacgtggaaacgggcctattaccacctatcctaccagacgaactaattaacccaaaacgacgactagtactctgacacaagtacgaacacgccgtagaggaggtgacggacgacgacgtgtgtacttacgngcggngaggacggtcggacggaagaacgtacgtacttagtgggttattcggtttacg

SEQ ID NO: 235748 - DNA, 866 bp, Homo sapiens
  misc_feature: GYAE6OF01CRC2J.16.64.F09.1.454.CMB.1.raw
tcagtgtactactccacgaccggtgctcgatttagcgcgtatacaaggggtctgggagacgagcccagcactggaagtcgccggtgtttccattcggtgatcagcactgaacacggagactcaccatggagttgggctgagctgggttttcctcgttgctcttttaagaggtgtccagtgtcaggtgcagctgggtggaggtcgtggggggagcgtggtccagccgtggggacggtccctagacgactctcctgtgtacgcctcgtggtacttcctaaccctttacaaaacttaaaccctacttcccttaccgttcgaccgtaaccggttccggggggttcccccgaccccgaacggggccccttaccccggaagggaccgggaaacggggggtccgtagggggacggggttgggggtacgggtacttaaagggttttaactaagttaccgaattaaggttagtaaggttaaggggtaaaaaagttaaaagttaaaaacgttaccgtaacgacgtaaacggaccgttacccggtagggaaaaccggtcccgtaaattaccgaaccctacgttacctaaccgaacgaactaaacctaaacgttaaacccaaaaacgtaccgacttaacgtactccgttacgaccaactaaatcggaaacctcgtaaccgtagggaaacggtaggggtacggaacggaaccggtaaccgggtcgttacgggttacgttaacgttacggtacgggtaaccgggaccgggtaaggggtaaccgggggtaaccgggtaaccgggtaaaaggtaaaacccgtttaccgtaaacccggtttagggttaacggggtttacctttttaacgggttttaaacccgg

SEQ ID NO: 235749 - DNA, 845 bp, Homo sapiens
  misc_feature: GYAE6OF01AJEDU.16.64.F09.1.454.CMB.1.raw
  modified_base (213)..(213): a, c, t, g, unknown or other
  misc_feature (213)..(213): n is a, c, g, or t
tcagtgtactactccacgaccggtgctcgatttagcgcgtatacaaggggtctgggagacgagcccagcactggaagtcgccggtgtttccattcggtgatcagcactgaacacggaggactcaccatggagtttgggctgagctgggttttcctcgttgctcttttaagaggtgtccagtgtcaggtgcagcgtggtggagtcggtgggggnggtcggtcggtccgaggtccggtaggggtaccggttcccgtaggacgtaccttccgtccgttggttaggtacgtccgttcgtggtactttacccgtaacccttacaaacttaaaccctacttccctcgtcgacctacggttccggggtccccgaccgcggtccctaccgacggcggaaaggggcgtagggagggttggggtaggcgtaaggtttataatctaattacgtagtaggtaaggaaaactttaaataaaacgttaccgtacggacgtaaacgtacccgtaccggttaagggaaaccgggggtccttaaacgtttcccgaaccctacgttccctaaccgaacggtaacgtaaacttaaacccttaaaacccgaaaaacccgtaccgttaccgttaagttacttacgtaccgtaacctaaccgtacgtaacgtaaaccgaacggtcccgtaaggaacgggtacgggttaacgggaaaccggacggtaacccggtcgttagggttaacggttaactttaccggtaccgggaccggtaccggtaagggtaccggggtccgggaacgggtaaacgtaaacgtaacccggtaacgttaaggttacgggttaacgttttcgttttaaacccgg

SEQ ID NO: 235750 - DNA, 610 bp, Homo sapiens
  misc_feature: GYAE6OF01E1GSK.16.64.F09.1.454.CMB.1.raw
  modified_base (313)..(313): a, c, t, g, unknown or other
  misc_feature (313)..(313): n is a, c, g, or t
  modified_base (376)..(376): a, c, t, g, unknown or other
  misc_feature (376)..(376): n is a, c, g, or t
  modified_base (411)..(411): a, c, t, g, unknown or other
  misc_feature (411)..(411): n is a, c, g, or t
  modified_base (430)..(430): a, c, t, g, unknown or other
  misc_feature (430)..(430): n is a, c, g, or t
tcagtgtactactccacgaccggtgctcgatttagcgcgtatacaaggggtctgggagacgagcccagcactggaagtcgccggtgtttccattcggtgatcagcactgaacacggaggactcaccatggagtttgggctgagctgggttttcctcgttgcttcttttaagaggtgtccagtgtcaggtgcagctggtggagtcgtggggggagcgtggtccagccgtggggaggtccctgacgacctctcctgtgtacgcctctggattccaccttcaaactaacccatccctctgccacgtcggggtcccnccaggctccgaggcgaagggggctgggagtgggtgcagttatatcatatgatggaataataanactagcagactccgtgaacgggcctatcaccatcncagagacaataccaaaacncgactgtatctcgacacatagaaccgagccgtaggacggtaaggtacggacgggaaccgtaccgggtacgttaggttacggttacgttacgtacggcggcggtaagggacgggtaccggggaaccgaacggtaaaccgtaaccgtaacccgttaggtacgggttagtttccgtttaacgg

SEQ ID NO: 235751 - DNA, 665 bp, Homo sapiens
  misc_feature: GYAE6OF01BPYQ2.16.64.F09.1.454.CMB.1.raw
  modified_base (186)..(186): a, c, t, g, unknown or other
  misc_feature (186)..(186): n is a, c, g, or t
  modified_base (309)..(309): a, c, t, g, unknown or other
  misc_feature (309)..(309): n is a, c, g, or t
  modified_base (610)..(610): a, c, t, g, unknown or other
  misc_feature (610)..(610): n is a, c, g, or t
  modified_base (616)..(616): a, c, t, g, unknown or other
  misc_feature (616)..(616): n is a, c, g, or t
tcagtgtactactccacgaccggtgctcgatttagcgcgtatacaaggggtctgggagacgagcccagcactggaagtcgccggtgtttccattcggtgatcagcactgaacacggaggactcaccatggagtttgggctgagcgtggtttctcgtagctctttaagaggtgtccagtgtcaggtncagcgtggtggagtcgtgggggagcgtggtccgagccgtgggagtcccgtgacgactctcctgtgtagcctgtgtacttccaccttacaactaccatccctactgccgacgtccggggtcccnccgtacgggcctccgagggccgaaggggtcgtggggacggtggggtagacgtaggtttactagttcaagttagtagtaagtaagggtaaaattaaacttaaagttacccgtaaacgcgtaacgtaccgtacccggtaagggaaccggtacctacgttaacccacgtacgttcctaccgaagaaccgtaacctaaaacttaaaccgaaaaccgtacgtaccgttagtacttacgtacgtacctaacgtataacgaacgacgtaccgtagacggagtacggaagaccgcgtacgtagtacgtnttacgngtcggagaggcggtcgacgaagtacgtacgtacgtagtgtgttgttacg

SEQ ID NO: 235752 - DNA, 837 bp, Homo sapiens
  misc_feature: GYAE6OF01C8XCH.16.64.F09.1.454.CMB.1.raw
  modified_base (152)..(152): a, c, t, g, unknown or other
  misc_feature (152)..(152): n is a, c, g, or t
tcagtgtactactccacgaccggtgctcgatttagcgcgtatacaaggggtctgggagacgagcccagcactggaagtcgccggtgtttccattcggtgatcagcactgaacacggagactcacatggagtttgggctgagctggttttccncgttgctcttttaagaggtgtccagtgtcaggtgcagctggtggagtcgtgggggaggcgtggtccaggcctggggagtccctagacgactcgtcctgtcgtacgcctctggatttccaccttacaaactaaaccacgttcccttactcggacctaaccgttcgggggtcccccgccgaacgggtccccttacccggaaggggtcccgaaaagggggggtcctagggggaacgggttgggggtacgggtaccttaaagggttttaactacgtactaattaagttaggtaacgttaagggaaaagtttaaaaaataaaacgttacgtaaacggactaacggtaacccttccggggttaaacgggaaccggggtacccgttaactttacccgaaacccgtaattaccccgtaccgaacggtaaacggaaaccctaaaccgtttaaacccaaaaaaccgtaccgtaccttaacgttaaccttaccgtcgaccctaaccttaagtaacccgaaaccgaccggtaccgtaagggtaacgggtaacggggttggaaaccggggtaacccggtacgggtcgttacggggtttacttaacgttaccggtcggaccgggtacggaacgggtacgggtacgggacggtaaacgaacgtacccgtaaacgttagggtacggtgtttcctttaacgg

SEQ ID NO: 235753 - DNA, 673 bp, Homo sapiens
  misc_feature: GYAE6OF01BCK2D.16.64.F09.1.454.CMB.1.raw
  modified_base (295)..(295): a, c, t, g, unknown or other
  misc_feature (295)..(295): n is a, c, g, or t
  modified_base (338)..(338): a, c, t, g, unknown or other
  misc_feature (338)..(338): n is a, c, g, or t
  modified_base (340)..(340): a, c, t, g, unknown or other
  misc_feature (340)..(340): n is a, c, g, or t
  modified_base (347)..(347): a, c, t, g, unknown or other
  misc_feature (347)..(347): n is a, c, g, or t
  modified_base (349)..(349): a, c, t, g, unknown or other
  misc_feature (349)..(349): n is a, c, g, or t
tcagtgtactactccacgaccggtgctcgatttagcgcgtatacaaggggtctgggagacgagcccagcactggaagtcgccggtgtttccattcggtgatcagcactgaacacggaggactcaccatggagtttgggctgagctgggttttcctcgttgctcttttaagaggtgtccagtgtcaggtgcagctggtggagtcgtgggggagcgtggtccaggccgtggggacggtcccgtggacgactccgtcctgtgtacgcctctggattccaccttacaataccatcctcngcacgtcggccacaggcctccgaggcgaagggctggagtgggngnagtttanancatactggaacgtaggaaagtaaactaaatacgtaacacgaagtacccgtaccgggaaggaacggggacctaacgttaccgaaccctaagtccctacgaagaacgaaaactaaacttaaaccaaaaactacgtacgtacgtatacgtacaccgtaacaagtacaaacgacgtaccgtaggaaacgggagtacggaacgggacgtaacgggtcttaagggtaacgttaacgttacgtacgggtaccggaaccggtagggtacggggtacggaacgaaacgtaacgtaacctacgtaacggttagggtaacgttttcgttaaacgg

SEQ ID NO: 235754 - DNA, 779 bp, Homo sapiens
  misc_feature: GYAE6OF01A4GIE.16.64.F09.1.454.CMB.1.raw
tcagtgtactactccacgaccggtgctcgatttagcgcgtatacaaggggtctgggagacgagcccagcactggaagtcgccggtgtttccattcggtgatcagcactgaacacggaggactcaccatggagtttggctgagcttgggttttcctcgttgcttcttttaagaggtgtccagtgtcaggtgcagcgtggtggagtcgtgggggagcgtggtccagccgtggggacgtccctggacgactctcctggtcgtacgtccctcgtaggtacttccaacccttacaaactaaacccagttcccttctcggacctaacggttccggggtccccgacccgagggccccttaccggaagggtaccgaaacgggggggtcctagggggtaggttcgggggtggaccgtaaaggtttaactactacgtaattagtacggaaagttaaggggtaaaaattaaaagtaaaactaccgtaacgactaacgtacccgtacggtaggaaaccgggtcctaacgtttaccaacctactaccgtaccaagtaacgaacctaaaacgttaaacccaaaaacgtccgtacttacgtacttacgtacgacctaacgtacgtaaccaaccgaacgtccgtaagggaacggtacggggtacggaacgggaccgtacgggtacgttaggttagtactttacggaccggtacggtacgggaagggtacgggtacgggaacggtaacggtaaacctacgtaaccgttaggtacgggttacgtttcgtttaaccgg

SEQ ID NO: 235755 - DNA, 838 bp, Homo sapiens
  misc_feature: GYAE6OF01AS9P8.16.64.F09.1.454.CMB.1.raw
tcagtgtactactccacgaccggtgctcgatttagcgcgtatacaaggggtctgggagacgagcccagcactggaagtcgccggtgtttccattcggtgatcagcactgaacacggaggactcaccatggagtttgggctgagtcgttgggttttcctcgttgcttacgttttaaggaggttgtctagtgtcgaggtgcgagcgtgggtggtagtcggtgggggaggtcggtcggtccgagtccggtggggaccggtcccgtgaccgtacctccgttccgtaggttcggtacgtcccgttcggttacggtacctttaccctaaccctttaactaaaccttaaccctacgttccccttcgtccggtacctacccggttcggggttaccccgaccgtacggtccgtacccggaggggaaccgggaacggggtcgtaggggtacgggttggggtcgacgtttagttacgtagtacgtaattacgtaggtaaggttaagggtaaaagttaaaattaaacgttaaacgtccgaacggtaacgttacccggtaccggtaacgggtaaccggtacccgttattacccgaaaccttcgtaacccgtaacgaacggtaaccgttaaacctaaaacccgttaaacccgaaaaaccgtcggttaaccttacgttaacgtaccgtaccgaactaaacgtactacggtaaccaggtaccgaaggtaggacggtacggaccggacgtacggtcgtagtacgttacttaccggacgtacggaggtagggacgggtacgaacggtaaacgtacgtaaccgtacgttaggttacgtttcgtttaacgtttaaccg

SEQ ID NO: 235756 - DNA, 788 bp, Homo sapiens
  misc_feature: GYAE6OF01EQKU2.16.64.F09.1.454.CMB.1.raw
tcagtgtactactccacgaccggtgctcgattttagcgcgtatacaaggggtctgggagacgagcccagcactggaagtcgccggtgtttccattcggtgatcagcactgaacacggaggactcaccatggagtttgggctgagcttgggttttcctcgttgtctcttttaagaggtgtccagtgtcaggtgcagcgtggtggagtcgtgggggaggcggtggtccagccgtgggacggtccctgacgtactctcctgtgtacgcctctggtacttccaccttacaaactaacctactccctctcgaccacgttcggggttccccgaccgacgggccgtcccgagggtaccggaaacggggggtcgtagggggtaggtgggggtgggtaccgtaaggtttaacgttaagttacctaattaagttagaaagttaaggggtaaaagttaaaattaaaacttaaccgtaacgacaacggtaacccgttaccggtaagggaaccggggtacccgttaacgtttacccgaaccctacgttaccccttaccgaaagaacgtaaacccttaaaacttaaaacccccgtaaaaaacgaccggttacgttacggttaacttaccgttacccggaactaaccgtaacgttacgaaccgtacggtacctaggaacggtagggtacgaggtaccgacggtattacgttagttaaccgttgtacgggaccgtaggtaaggacggtaggaaccggaaataaaccgtacaaccggttagtacggtttagttcgttttaaaccg

SEQ ID NO: 235757 - DNA, 725 bp, Homo sapiens
  misc_feature: GYAE6OF01B4HC9.16.64.F09.1.454.CMB.1.raw
  modified_base (155)..(155): a, c, t, g, unknown or other
  misc_feature (155)..(155): n is a, c, g, or t
  modified_base (191)..(191): a, c, t, g, unknown or other
  misc_feature (191)..(191): n is a, c, g, or t
  modified_base (298)..(298): a, c, t, g, unknown or other
  misc_feature (298)..(298): n is a, c, g, or t
  modified_base (580)..(580): a, c, t, g, unknown or other
  misc_feature (580)..(580): n is a, c, g, or t
  modified_base (636)..(636): a, c, t, g, unknown or other
  misc_feature (636)..(636): n is a, c, g, or t
tcagtgtactactccacgaccggtgctcgatttagcgcgtatacaaggggtctgggagacgagcccagcactggaagtcgccggtgtttccattcggtgatcagcactgaacacggagactcaccatggagtttgggctgagcttgggttttccncgttgcttcttttaagaggtgtccagtgtcgaggtnacgagcgtggtggaggtcggtggggggacggcggtcgggtaccaggtccgtggggacgtccctagagtacctcctcgtgtgtacgcctcgtggtacttcacccttanaaactaacctatcctcgtgcctacggtcgggtcccgacgacgggtcaccgtaaggcgtaaacggggcttacggggaggtcgggtgtaccgtaagttacctagacgtaatagtaggtaaagtaaggtaaaagttaaactaaagtaaccgtaacgacgtaacgtaccttacgggagggaacggcctaattccgaacctataccgaccgtaagaaccgtaactaaacgtaaaccctaaacggcgtactacgtacttcgaacgtacacctaagtaacgaaccgtanaccggtaaggaggacgggtacgaaggacgtacccgtgtacggttagactttaccgnggaccggtagggtaaggacggggttaacgggactaaaacgggtacttaaacccgtacggttaagtacgggtttacctttggtttaaccg

SEQ ID NO: 235758 - DNA, 515 bp, Homo sapiens
  misc_feature: GYAE6OF02HBY1J.16.64.F09.1.454.CMB.1.raw
  modified_base (296)..(296): a, c, t, g, unknown or other
  misc_feature (296)..(296): n is a, c, g, or t
  modified_base (336)..(336): a, c, t, g, unknown or other
  misc_feature (336)..(336): n is a, c, g, or t
  modified_base (391)..(391): a, c, t, g, unknown or other
  misc_feature (391)..(391): n is a, c, g, or t
  modified_base (427)..(427): a, c, t, g, unknown or other
  misc_feature (427)..(427): n is a, c, g, or t
  modified_base (434)..(434): a, c, t, g, unknown or other
  misc_feature (434)..(434): n is a, c, g, or t
tcagtgtactactccacgaccggtgctcgatttagcgcgtatacaaggggtctgggagacgagcccagcactggaagtcgccggtgtttccattcggtgatcagcactgaacacggaggactcaccatggagtttgggctgagctgggttttcctcgttgctcttttaagaggtgtccagtgtcaggtgcagctggtggagtctgggggaggcgtggtccagccgtgggagtccctgagactctcctgtgtagcctctggattcaccttcaataaccatcctctgcactgggtccnccaggctccaggcaaggggctgggagtgggtggcagttanatcatatgatggaataataaatactacgcagactcgtgaagggccattcacatcnccagagacaattaccaaaacacgactgtatctgcanatgaacngcctgagagtgacggacacggctgtagtattacgtgcgcggagacggtcggcgagaactacgacctagtggtattgttacg

SEQ ID NO: 235759 - DNA, 674 bp, Homo sapiens
  misc_feature: GYAE6OF02G7HZE.16.64.F09.1.454.CMB.1.raw
tcagtgtactactccacgaccggtgctcgatttagcgcgtatacaaggggtctgggagacgagcccagcactggaagtcgccggtgtttccattcggtgatcagcactgaacacggaggactcaccatggagtttgggctgagctgggttttcctcgttgctcttttaagaggtgtccagtgtcaggtgcagctgggtggagtcgtgggggaggcgtggtccagcctgggaggtccctgagactctcctgtgtagcctctggattcaccttcaactaaccatcctctgcactgggtccgccaggctccgaggcaaggggctgggagtgggtgcagttatatcatatgagtaggaaagtaaataaatactacgacagtactcgtaggaacgggccgtaagttccacctactcctaccgaagaacgtaactaaacgttaaacccaaaaaccgtaccgtacctacgttaacttctacgacctaacaacgtacgaaaccgacgtacccgtaggacggaagggttacgggaacggtaaccgtaaccgggcggttacggttaggtttaacgtttaccgtcggacgggtaccgggtaacgggtaacggggtccgggtaacggaaacggttaacgtaaccggtaaccgttaacggttacgggttacgtttccgtttaaccgg

SEQ ID NO: 235760 - DNA, 566 bp, Homo sapiens
  misc_feature: GYAE6OF02FWC0R.16.64.F09.1.454.CMB.1.raw
  modified_base (256)..(256): a, c, t, g, unknown or other
  misc_feature (256)..(256): n is a, c, g, or t
  modified_base (297)..(297): a, c, t, g, unknown or other
  misc_feature (297)..(297): n is a, c, g, or t
tcagtgtactactccacgaccggtgctcgatttagcgcgtatacaaggggtctgggagacgagcccagcactggaagtcgccggtgtttccattcggtgatcagcactgaacacggaggactcaccatggagtttgggctgagctgggttttcctcgttgctcttttaagaggtgtccagtgtcaggtgcagctggtggagtctgggggagcgtggtccagcctgggagtccctgagactctcctgtacagccctntggattcacctttaggagcccatgccatgagctgggtcccnccaggcctccgaggggaaggggctgggagtgggtctcgtactattactgctaggtggtaatcatgcaatactatgacagtactccggtagaacggggtccgttacaccttacaccagacgaactaattccaaagaaccacgctctatctgctaattcaccagcctagcgccgcgaggaccacggccagtgtacttactagtaactaagcggtcgggtcggcccgcggacccggttaccgtcggtaagttcggttttagtagtttccggg

SEQ ID NO: 235761 - DNA, 635 bp, Homo sapiens
  misc_feature: GYAE6OF02HNHV4.16.64.F09.1.454.CMB.1.raw
tcagtgtactactccacgaccggtgctcgatttagcgcgtatacaaggggtctgggagacgagcccagcactggaagtcgccggtgtttccattcggtgatcagcactgaacacggaggactcaccatggagtttgggctgagctgggttttcctcgttgctcttttaagaggtgtccagtgtcaggtgcagctggcggagtctgggggagcgtggtccagcctggggaggtccctgagactctcctgtgtagcctctggattcaccttcaataaccattcctctgccacgtcggggtcccgaccagggcctccgaggcgaaggggctgggagtggggtgctaggttatatcatatgatagggaaataataaatacgtacgacagactccggtaggaacgggcctaattccacactcctaccagaagactaaacttaaccaaaactccgtactagtactctacgaccactagtacgaacctagaccgtaggacggtagggtacggacgggaaccgtacgggtactaggtacgttaacgttacgtacggtaccggtacggtaacgggtacgggtaccggaacggtaacggtaacgtaccgtaaccgttaggttacggggtactttacgtttaacgg

SEQ ID NO: 235762 - DNA, 768 bp, Homo sapiens
  misc_feature: GYAE6OF02HU9IW.16.64.F09.1.454.CMB.1.raw
  modified_base (191)..(191): a, c, t, g, unknown or other
  misc_feature (191)..(191): n is a, c, g, or t
  modified_base (322)..(322): a, c, t, g, unknown or other
  misc_feature (322)..(322): n is a, c, g, or t
tcagtgtactactccacgaccggtgctcgatttagcgcgtatacaaggggtctgggagacgagcccagcactggaagtcgccggtgtttccattcggtgatcagcactgaacacggaggactcaccatggagtttgggctgagcttgggttttcctcgttgcttcttttaagaggtgtccagtgtcaggtncagctggtggagtcgtgggggagcgtggtccagccgtgggacggtccctgacgactctccgtgtgtacgcctcgtggtacttccacctttagaaactaaccattccctctacgctaccgttcggggtcccncgacggcctacccgagggaccggtaaggggctgggacggttcgggtacgcttaagtattacgtctaagttacgtagtaacgtagggtaaaaattaaataaaacttaccgtaacgacgtaacggtacccttccgggtaaagggaaccgggtccgtaacttaccgacctactcccgtcgaaagtacgtaaacctaaacttaaaccaaaaccgcgtacttagtaccgtctaccgactaactaactaacaacccggtagtaacccgtaaggaaccgggtaaggtacgggtaaaccggaccgtaacgggttcgttaacgggttacttaaccgttaccggtggtacccggtaacggggtaacggttccgggtaaacgggtaaccgtaaccgggttaaacttacccggtaaacggtttacgggttaccggtttaagttttcccggtttaacgg

SEQ ID NO: 235763 - DNA, 885 bp, Homo sapiens
  misc_feature: GYAE6OF02G30TL.16.64.F09.1.454.CMB.1.raw
tcagtgtactactccacgaccggtgctcgatttagcgcgtatacaaggggtctgggagacgagcccagcactggaagtcgccggtgtttccattcggtgatcagcactgaacacggaggactcaccatggagtttgggctgagctgggttttcctcgttgctcttttaagaggtgtccagtgtcaggtgcagctggtggagtcgtgggggaggcgtggtccagccgtgggaggtcctgagactctccgtgtcgtagcctcgtggacttccacctttacaaattaacccgaacttcccttaccgtgtccgaacgttcggggttacccgacccgtacggtcccgttacccggaacgggaccgtaaacggggggtccgttgggtaacgggttgggggtacggtaccgtaaggtttaactaagttacgtaagttagtagtaagttacggggtaaaactttaaagtaaaacgttaccgtaacgacgtaacggtaaccgttaccggtacgggtaaacggggtcccgtaacgtttacccgaacccgttaacgttacccgttaccggaacggtaacgtaaacccggttaaaacttaaaaccccgaaaaaaaccggtccgtaaccggtttaacgttaacgttaaccgtttacggaaacctaacctaaacgtaccgtaaaccggtaaccgttaccgggtaacgggacgggttaaacggggtaacccggaaacgggttaccggaaccgggtacgtttacgggttaacgtttaccgtttaacgggtcgggtaccggtaaccgggtagggtaaaccggggttcgggtaaccggtaaagtaacccggttaacgtaaccggttaagggtttacgggttagtttacccggtttttaaacgg

SEQ ID NO: 235764 - DNA, 197 bp, Homo sapiens
  misc_feature: GYAE6OF01BEHV7.46.52.E08.1.454.CMB.1.raw
  modified_base (169)..(197): a, c, t, g, unknown or other
  misc_feature (169)..(197): n is a, c, g, or t
tcagactagcagtacacgaccggtgctcgatttagtcgagctctcccgcgagagaggcgatacgctgtcagtctctcggcgcgagggaggcgatacgctgtcagtctctcggcgcgagggagcgagtacggctgtcagtctctcgtgatggcgcgagggagcgatacgnnnnnnnnnnnnnnnnnnnnnnnnnnnnn

SEQ ID NO: 235765 - DNA, 208 bp, Homo sapiens
  misc_feature: GYAE6OF01BEERI.46.52.E08.1.454.CMB.1.raw
  modified_base (106)..(106): a, c, t, g, unknown or other
  misc_feature (106)..(106): n is a, c, g, or t
  modified_base (110)..(110): a, c, t, g, unknown or other
  misc_feature (110)..(110): n is a, c, g, or t
  modified_base (129)..(129): a, c, t, g, unknown or other
  misc_feature (129)..(129): n is a, c, g, or t
  modified_base (141)..(141): a, c, t, g, unknown or other
  misc_feature (141)..(141): n is a, c, g, or t
  modified_base (146)..(146): a, c, t, g, unknown or other
  misc_feature (146)..(146): n is a, c, g, or t
  modified_base (161)..(161): a, c, t, g, unknown or other
  misc_feature (161)..(161): n is a, c, g, or t
  modified_base (163)..(163): a, c, t, g, unknown or other
  misc_feature (163)..(163): n is a, c, g, or t
  modified_base (165)..(167): a, c, t, g, unknown or other
  misc_feature (165)..(167): n is a, c, g, or t
  modified_base (169)..(169): a, c, t, g, unknown or other
  misc_feature (169)..(169): n is a, c, g, or t
  modified_base (171)..(171): a, c, t, g, unknown or other
  misc_feature (171)..(171): n is a, c, g, or t
  modified_base (173)..(173): a, c, t, g, unknown or other
  misc_feature (173)..(173): n is a, c, g, or t
  modified_base (175)..(175): a, c, t, g, unknown or other
  misc_feature (175)..(175): n is a, c, g, or t
  modified_base (177)..(177): a, c, t, g, unknown or other
  misc_feature (177)..(177): n is a, c, g, or t
  modified_base (179)..(208): a, c, t, g, unknown or other
  misc_feature (179)..(208): n is a, c, g, or t
tcagactagcagtacacgaccggtgctcgatttagtcgagctctcccgcgagggaggcgatacgctgtcagtctctccgcgagggaggcgatacgctgtcagtctntggngcgagggaggcgatacgcngtcagtctgagnggcgnggaggcgatactcgngnannngngngngngngnnnnnnnnnnnnnnnnnnnnnnnnnnnnnn

SEQ ID NO: 235766 - DNA, 139 bp, Homo sapiens
  misc_feature: GYAE6OF01ELNFV.46.52.E08.1.454.CMB.1.raw
  modified_base (128)..(139): a, c, t, g, unknown or other
  misc_feature (128)..(139): n is a, c, g, or t
tcagactagcagtacacgaccggtgctcgatttagtcgagctctcccgcgagagaggcgatacgctgtcagtctctcggcgcgagggaggcgatacgctgtcaggatggcgcgagggaggcgatacgnnnnnnnnnnnn

SEQ ID NO: 235767 - DNA, 262 bp, Homo sapiens
  misc_feature: GYAE6OF02GGPGN.46.52.E08.1.454.CMB.1.raw
  modified_base (115)..(115): a, c, t, g, unknown or other
  misc_feature (115)..(115): n is a, c, g, or t
  modified_base (123)..(123): a, c, t, g, unknown or other
  misc_feature (123)..(123): n is a, c, g, or t
  modified_base (140)..(140): a, c, t, g, unknown or other
  misc_feature (140)..(140): n is a, c, g, or t
  modified_base (177)..(177): a, c, t, g, unknown or other
  misc_feature (177)..(177): n is a, c, g, or t
  modified_base (182)..(182): a, c, t, g, unknown or other
  misc_feature (182)..(182): n is a, c, g, or t
  modified_base (207)..(207): a, c, t, g, unknown or other
  misc_feature (207)..(207): n is a, c, g, or t
  modified_base (213)..(214): a, c, t, g, unknown or other
  misc_feature (213)..(214): n is a, c, g, or t
  modified_base (221)..(221): a, c, t, g, unknown or other
  misc_feature (221)..(221): n is a, c, g, or t
  modified_base (232)..(262): a, c, t, g, unknown or other
  misc_feature (232)..(262): n is a, c, g, or t
tcagactagcagtacacgaccggtgctcgatttagtcgagctctcccgcgagagaggcgatacgctgtcagtctctcggcgcgagggaggcgagtacggctgtcagtctctcggngctagggngcgagtacgctagtccngtctctcggcgcgaggaggagcgagtacgctgcatcnctcgncgaggcgtgatgcgtgccaggtctnacctgnnggccagnggagcagttgnnnnnnnnnnnnnnnnnnnnnnnnnnnnnnn

SEQ ID NO: 235768 - DNA, 155 bp, Homo sapiens
  misc_feature: GYAE6OF02GV66C.46.52.E08.1.454.CMB.1.raw
  modified_base (139)..(155): a, c, t, g, unknown or other
  misc_feature (139)..(155): n is a, c, g, or t
tcagactagcagtacacgaccggtgctcgatttagtcgagctctcccgcgagagaggcgatacgctgtcagtctctcggcgcgagggaggcgatacgctgtcgtactgctagtctgatggcgcgagggaggcgatacgnnnnnnnnnnnnnnnnn

SEQ ID NO: 235769 - DNA, 553 bp, Homo sapiens
  misc_feature: GYAE6OF02IH4P0.46.52.E08.1.454.CMB.1.raw
  modified_base (139)..(139): a, c, t, g, unknown or other
  misc_feature (139)..(139): n is a, c, g, or t
  modified_base (146)..(146): a, c, t, g, unknown or other
  misc_feature (146)..(146): n is a, c, g, or t
  modified_base (164)..(164): a, c, t, g, unknown or other
  misc_feature (164)..(164): n is a, c, g, or t
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (273)..(273): a, c, t, g, unknown or other
  misc_feature (273)..(273): n is a, c, g, or t
tcagactagcagtacacgaccggtgctcgatttagtcgagctctcccgcgagagaggcgatacgctgtcagtctctcggcgcgagggaggcgatacgctgtcagtctctcggcgcgagggagcgatacgctgtcagtcncgtggcncgagggagcgaataccgntgtcagtctcgtcggcgacgaggagccgatacgctgtcaagtcncgcggngcggaagggngaccgtactacggctagctaagtctcggaacgtccgaggaaggggtacncgtacgtacgtacgtacgtacgtacgtcgtacgtacggtacggtacggacggtacggacgtagtacgtacgtacgtacgtacgtacgtcgtacggacgacgtacggtacgtacgaacggacgtactacgtcgtacgtcgtcgacgacgacgtcggtacgtagacgtacgacgtacgagacgtacgtacgcgtacgtagtacgagacgtagtacgacgtacgacgtacgtagtacgtacgtcgtacgacgtacgtacgtacgtacgtcgtacgtacgtacg

SEQ ID NO: 235770 - DNA, 158 bp, Homo sapiens
  misc_feature: GYAE6OF02IAN26.46.52.E08.1.454.CMB.1.raw
  modified_base (136)..(158): a, c, t, g, unknown or other
  misc_feature (136)..(158): n is a, c, g, or t
tcagactagcagtacacgaccggtgctcgatttagtcgagctctcccgcgagagaggcgatacgctgtcagtctctcggcgcgagggagcgatacggctgtcagtctctcctgatggcgcgagggaggcgatacgnnnnnnnnnnnnnnnnnnnnnnn

SEQ ID NO: 235771 - DNA, 280 bp, Homo sapiens
  misc_feature: GYAE6OF02FJHOM.46.52.E08.1.454.CMB.1.raw
  modified_base (83)..(83): a, c, t, g, unknown or other
  misc_feature (83)..(83): n is a, c, g, or t
  modified_base (116)..(116): a, c, t, g, unknown or other
  misc_feature (116)..(116): n is a, c, g, or t
  modified_base (182)..(182): a, c, t, g, unknown or other
  misc_feature (182)..(182): n is a, c, g, or t
  modified_base (190)..(190): a, c, t, g, unknown or other
  misc_feature (190)..(190): n is a, c, g, or t
  modified_base (192)..(192): a, c, t, g, unknown or other
  misc_feature (192)..(192): n is a, c, g, or t
  modified_base (195)..(195): a, c, t, g, unknown or other
  misc_feature (195)..(195): n is a, c, g, or t
  modified_base (202)..(203): a, c, t, g, unknown or other
  misc_feature (202)..(203): n is a, c, g, or t
  modified_base (207)..(207): a, c, t, g, unknown or other
  misc_feature (207)..(207): n is a, c, g, or t
  modified_base (209)..(210): a, c, t, g, unknown or other
  misc_feature (209)..(210): n is a, c, g, or t
  modified_base (212)..(212): a, c, t, g, unknown or other
  misc_feature (212)..(212): n is a, c, g, or t
  modified_base (214)..(214): a, c, t, g, unknown or other
  misc_feature (214)..(214): n is a, c, g, or t
  modified_base (216)..(216): a, c, t, g, unknown or other
  misc_feature (216)..(216): n is a, c, g, or t
  modified_base (218)..(218): a, c, t, g, unknown or other
  misc_feature (218)..(218): n is a, c, g, or t
  modified_base (220)..(220): a, c, t, g, unknown or other
  misc_feature (220)..(220): n is a, c, g, or t
  modified_base (222)..(280): a, c, t, g, unknown or other
  misc_feature (222)..(280): n is a, c, g, or t
tcagactagcagtacacgaccggtgctcgattttagtcgagctctccccgcgagagaggcgatacgctgtcagtctctcggcncgagggaggcgatacgctgtcagtctctcggcncgagggaggcggatacgcttgcagtcctgtacgctggacggaggcggatccgatcgtcagtcatcntgaccggngnggngctatcnncgantnngngngngngngnnnnnnnnnnnnnnnnnnnnnnnnnnnnnnnnnnnnnnnnnnnnnnnnnnnnnnnnnnn

SEQ ID NO: 235772 - DNA, 502 bp, Homo sapiens
  misc_feature: GYAE6OF02FO3TJ.46.52.E08.1.454.CMB.1.raw
  modified_base (318)..(318): a, c, t, g, unknown or other
  misc_feature (318)..(318): n is a, c, g, or t
  modified_base (346)..(346): a, c, t, g, unknown or other
  misc_feature (346)..(346): n is a, c, g, or t
  modified_base (358)..(358): a, c, t, g, unknown or other
  misc_feature (358)..(358): n is a, c, g, or t
  modified_base (493)..(502): a, c, t, g, unknown or other
  misc_feature (493)..(502): n is a, c, g, or t
tcagactagcagtacacgaccggtgctcgattttagtcgagctctcccgcgagagaggcgatacgctgtcagtctctcggcgcgaggaggcgatacgctgtcagtctctcggcgcgaggagcgacgtatcgctcgtgctctacgtcggcgacggaggcgcgtatacgctcgtcgaagtcttacgcgcgacgaacggagcgactcgcgtcgacgcgtcgtcgtcgcgcgcgacgcgacgacgcgcgcgcgactcgtacgcgtcgcgcgacgtacgagtcgcgtgcgcgtcgtcgtcgacgacgcgacgacgcgcgcgcnctacgactacgacgacgcgacgacgcanacgcgtcgtcgnactcgcgagagacgacgacgacgcgagacgagcgtacgcacgtcgtacgtagagtacgcgtactacacgtctacgagtacgtacgtacgacgacgcgacgacgacgacgtacgacgtacggtacgtagtacgtannnnnnnnnn

SEQ ID NO: 235773 - DNA, 593 bp, Homo sapiens
  misc_feature: GYAE6OF02IOBYM.46.52.E08.1.454.CMB.1.raw
  modified_base (54)..(54): a, c, t, g, unknown or other
  misc_feature (54)..(54): n is a, c, g, or t
  modified_base (106)..(106): a, c, t, g, unknown or other
  misc_feature (106)..(106): n is a, c, g, or t
  modified_base (113)..(113): a, c, t, g, unknown or other
  misc_feature (113)..(113): n is a, c, g, or t
  modified_base (131)..(131): a, c, t, g, unknown or other
  misc_feature (131)..(131): n is a, c, g, or t
  modified_base (139)..(139): a, c, t, g, unknown or other
  misc_feature (139)..(139): n is a, c, g, or t
  modified_base (161)..(161): a, c, t, g, unknown or other
  misc_feature (161)..(161): n is a, c, g, or t
  modified_base (168)..(168): a, c, t, g, unknown or other
  misc_feature (168)..(168): n is a, c, g, or t
  modified_base (187)..(187): a, c, t, g, unknown or other
  misc_feature (187)..(187): n is a, c, g, or t
  modified_base (193)..(193): a, c, t, g, unknown or other
  misc_feature (193)..(193): n is a, c, g, or t
  modified_base (195)..(195): a, c, t, g, unknown or other
  misc_feature (195)..(195): n is a, c, g, or t
  modified_base (273)..(273): a, c, t, g, unknown or other
  misc_feature (273)..(273): n is a, c, g, or t
  modified_base (456)..(456): a, c, t, g, unknown or other
  misc_feature (456)..(456): n is a, c, g, or t
tcagactagcagtacacgaccggtgctcgattttagtcgagctctcccgcgagngaggcgatacgctgtcagtctctcggcgcgagggagcgatacgctgtcatcnctcggcncgagggcgtcgatacgcngtcagtcnctgcagtaggcggcaatgctancatctcncgcgaaggtgacggaccgntacgcntngtctcgcgcgcgacgacgtcgtacgacgcgcgtacgactacgtcgtacgacgtacgacgtacgtacgacgtacacganacgtacgtacgtacacgtacgaacgacgtacggacgacgtcgtacgacgtacgacgacgtacgacgacgtagtacgacgtactcgcgtcgacgtcgactagtcgtgacgacgtacggtagtacgaacgtacgtaacgtacgacgtaactgacgtacgtacgtacttacacgtcgtacgtcgtntactacgtaacgtacgtacgtaagtacgtacggtacgtactaacgtaaccgacgtacgtacgtaaccgtacgtacgtcggtacgttaccgttacgtaacgtaacgtacgtacgtactacgacgtacgtacgataacg

SEQ ID NO: 235774 - DNA, 648 bp, Homo sapiens
  misc_feature: GYAE6OF02JC8ZJ.46.52.E08.1.454.CMB.1.raw
  modified_base (122)..(122): a, c, t, g, unknown or other
  misc_feature (122)..(122): n is a, c, g, or t
  modified_base (129)..(129): a, c, t, g, unknown or other
  misc_feature (129)..(129): n is a, c, g, or t
  modified_base (132)..(132): a, c, t, g, unknown or other
  misc_feature (132)..(132): n is a, c, g, or t
  modified_base (145)..(145): a, c, t, g, unknown or other
  misc_feature (145)..(145): n is a, c, g, or t
  modified_base (163)..(163): a, c, t, g, unknown or other
  misc_feature (163)..(163): n is a, c, g, or t
  modified_base (167)..(167): a, c, t, g, unknown or other
  misc_feature (167)..(167): n is a, c, g, or t
  modified_base (170)..(170): a, c, t, g, unknown or other
  misc_feature (170)..(170): n is a, c, g, or t
  modified_base (177)..(177): a, c, t, g, unknown or other
  misc_feature (177)..(177): n is a, c, g, or t
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
tcagactagcagtacacgaccggtgctcgatttagtcgagctctcccgcgagagaggcgatacgctgtcagtctctcggcgcgagggagcgatacgctgtcagtctcgtcggcgcgaggagnggacacncgngtagctagctcgngcgacgaggcgcattcgntagncgntacgcgngagagcgacgtacgcgttngtactacgtcgngtaacgcgaacggacggacgcgttaccactcgacgtacgtctacgtcgtacgtacgtacgacggacggcgtacgtacgtacgtcgtcgcgtacgtacgcgacgtacggtcgtcgtacgacgtacgtaccgtacgtcgtacgtacgtacgtacgtcggtacggtacggtacggtacggacgtacgtacgtacgtacgtgtacgtacgtacgtacgtacgtacgacggtacgtacgtacgtaccgtacgtaccgtacggtacgtacgtaccgtacgtaccgttacgttacgttaacgtacgtacgacgtacgttacgtacgtacgtacgtacgtacgtacgttacgaccgtaacgtacgtacgtacgtacgtacgtacgtcggtacgtaacggacgtaacgtacgtacgacgtacggtacggtaccgtacgtacgtagtacg

SEQ ID NO: 235775 - DNA, 503 bp, Homo sapiens
  misc_feature: GYAE6OF01C9GVX.41.42.D09.1.454.CMB.1.raw
  modified_base (201)..(201): a, c, t, g, unknown or other
  misc_feature (201)..(201): n is a, c, g, or t
  modified_base (354)..(354): a, c, t, g, unknown or other
  misc_feature (354)..(354): n is a, c, g, or t
tcagtctatactatcacgaccggtgctcgatttagacacatacgcagggaaaggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaanagccaccctctcctgcagggccagtcagagtcttagcggcaccttagcctggtaccagcagaaacctggccaggctcccaggctcctcatctatggtacatccaccagggtcactggtgttccagccaggttcagtggcagtgggtccggganagagttcactctcaccatcagcagcctgcagtctgaagtattttgcgtatttattactgtcacactataataattggccctcgcgtggacgttcggccaagggaccaagggtgaaatcgaaacgatgtgctgcaccatctgtcttctac

SEQ ID NO: 235776 - DNA, 586 bp, Homo sapiens
  misc_feature: GYAE6OF01DO96Q.41.42.D09.1.454.CMB.1.raw
  modified_base (203)..(203): a, c, t, g, unknown or other
  misc_feature (203)..(203): n is a, c, g, or t
  modified_base (360)..(360): a, c, t, g, unknown or other
  misc_feature (360)..(360): n is a, c, g, or t
  modified_base (363)..(363): a, c, t, g, unknown or other
  misc_feature (363)..(363): n is a, c, g, or t
  modified_base (376)..(376): a, c, t, g, unknown or other
  misc_feature (376)..(376): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccgaggggaaancgcccaccctctcctgcagggccagtcagagtcttagcggcaccttagcctggtaccagcagaaacctggccaggctcccaggcctcctcatctatggtacactcccaccagggtcacgtggtcgttccagccaggttcagtggcaggtggccgganagngttcactctcacntcagcagcctgcagtctagaagtattttgacgttattttacttactgtacctaacctaacttaataattacgttcggcccccttaccgggtcgttacgggtacgttccggaccgtaaacggggtaccaagggttagaaacgtaccgaaaacggtaacgttggtacgggcttacggaccgtacctagttaccttcggttccttccgtaccg

SEQ ID NO: 235777 - DNA, 679 bp, Homo sapiens
  misc_feature: GYAE6OF01COAT2.41.42.D09.1.454.CMB.1.raw
  modified_base (201)..(201): a, c, t, g, unknown or other
  misc_feature (201)..(201): n is a, c, g, or t
  modified_base (373)..(373): a, c, t, g, unknown or other
  misc_feature (373)..(373): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaangccaccctctcctgcagggccagtcagagtcttagcggcaccttagcctggtaccagcagaaacctggaccaggcctccccaggtcctcctcatctatcggtaccactcccaccgtagggtcacgttggtcttccagcctaggttccaggtggctagggtcggggtccgganaggtacgttccacttctacgaacctatccagccgacgtccctagccgtacggttctaggtaacgttagtttttggaccgttaatttttaacgttaccgttacgttacctaacccgttaacttaactttaaacgttaacgtttcccgggtacccccgttccgggtacggttaccgggtaaccggtttcccgggaccgtaaaacggggtacctaaaggggtaggtaaaaccgttaccgaaaaccggtacgttcgggtagggccttacgggaccctaacccgtattcgttaccggttccttccgtaccg

SEQ ID NO: 235778 - DNA, 498 bp, Homo sapiens
  misc_feature: GYAE6OF01C3A2R.41.42.D09.1.454.CMB.1.raw
  modified_base (203)..(203): a, c, t, g, unknown or other
  misc_feature (203)..(203): n is a, c, g, or t
  modified_base (287)..(287): a, c, t, g, unknown or other
  misc_feature (287)..(287): n is a, c, g, or t
  modified_base (305)..(305): a, c, t, g, unknown or other
  misc_feature (305)..(305): n is a, c, g, or t
  modified_base (433)..(433): a, c, t, g, unknown or other
  misc_feature (433)..(433): n is a, c, g, or t
  modified_base (489)..(489): a, c, t, g, unknown or other
  misc_feature (489)..(489): n is a, c, g, or t
  modified_base (494)..(494): a, c, t, g, unknown or other
  misc_feature (494)..(494): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccgaggggaaangcccaccctctcctgcagggccagtcagagtcttagcggcaccttagcctggtaccagcagaacctggccaggctccagctctnatctatgtacatccacgnggtcagtggtctccagcctaggttcaggtggcaggtcgggtccggataggagttcacttcacaccatcagcagcctgcagtctgaagtctttgctatttatctgtcacctatatataatcgccctcgngtcgcgtcggcgaaggacaaggtgaaatcgaaacgtagtgtcgctgacactatctntcttntacc

SEQ ID NO: 235779 - DNA, 616 bp, Homo sapiens
  misc_feature: GYAE6OF01BPUUF.41.42.D09.1.454.CMB.1.raw
  modified_base (203)..(203): a, c, t, g, unknown or other
  misc_feature (203)..(203): n is a, c, g, or t
  modified_base (312)..(312): a, c, t, g, unknown or other
  misc_feature (312)..(312): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctccagatgtcactggagaaatagtgatgacgcagtctccagccaccctgtctgtgtctccgaaggggaaancgcccaccctctcctgcgagggccagtcagtacgtctagcggcaccgttagcctggtaccagcaacgaacctggccaggctccacggtcctcctcatctagtcggtacnctcccaccgtagggtccacgttcgggtcgttcccagtccctaggtttccaggtgcgtagggtcgggccggacaggtacgttcacctctacgaccctataccgagcgacgccgtagctacgtctaggtaacttcgtttcgacgttattttagtactcgtacctaactagttaattaagtaccgttcgccccttcgggtacgtacgggttacgttccggaacggaacggtaccgtaagggtacgaaaactcggaaaacgtcgtaggtcggaccttcgaccgtacctagttctcgttcttctacccg

SEQ ID NO: 235780 - DNA, 620 bp, Homo sapiens
  misc_feature: GYAE6OF01D6WFS.41.42.D09.1.454.CMB.1.raw
  modified_base (205)..(205): a, c, t, g, unknown or other
  misc_feature (205)..(205): n is a, c, g, or t
  modified_base (317)..(317): a, c, t, g, unknown or other
  misc_feature (317)..(317): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtcctccgaaggggaaancgcccaccctctcctgccagggccagtcagagtcttagcggcaccttagcctggtaccagcagaacctggccaggcctcccgaggcctcctcatctatggtacactccacgngggtcacgtggtcgttccacgccgtaggttcaggtcggcgtaggtcggggtaccggactaggtacgttccacgttctaccaaccgataccgagcacgtcctgctacgtctagtaagttattttcgacgttattttactacgtcgtacctaacctattaacttaataacgttccggtcccgttcccggtacggttacgggtaccgttaccggacccgtaaagggtacctaaagggtacggtaaaactacggaaaaccgtacgtaggtcggacctgaccgtactacttccttcgttcttctaccg

SEQ ID NO: 235781 - DNA, 647 bp, Homo sapiens
  misc_feature: GYAE6OF01DD0LB.41.42.D09.1.454.CMB.1.raw
  modified_base (376)..(376): a, c, t, g, unknown or other
  misc_feature (376)..(376): n is a, c, g, or t
  modified_base (429)..(429): a, c, t, g, unknown or other
  misc_feature (429)..(429): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctccagatgtcactggagaaatgtgatgacgcagtctccagccacctgtctgtcgtctccgaaggggaaagacgcccaccctctcctgcgagggccagtcagagtctagcgctacttagcctaggtaccagcaagaacctggaccaggcctccaggcctcctcatctagtcggtacactccaccgagggtcacgttggtcgtcccagtccgtaggttcaggtcggcgtagggtcggggtccgganaggtcgttcaccgttcaccacatcagcacgtcctagcctagtcgtagaagttntttggacgttatttactactgtaccaacctaacttaattaacgtaacgttccggtaccccgttcgggtaccggttacgggttacccggttaccgggacccgtaaacggggtaacccgtaaaggggttaaccggaaacttaaacccggaaaacggttaaccgttcgggtacggtaccgtacgaccgtaacctagttcccttacgttccttcgttacccg

SEQ ID NO: 235782 - DNA, 527 bp, Homo sapiens
  misc_feature: GYAE6OF01ENAZ4.41.42.D09.1.454.CMB.1.raw
  modified_base (202)..(202): a, c, t, g, unknown or other
  misc_feature (202)..(202): n is a, c, g, or t
  modified_base (369)..(369): a, c, t, g, unknown or other
  misc_feature (369)..(369): n is a, c, g, or t
  modified_base (413)..(413): a, c, t, g, unknown or other
  misc_feature (413)..(413): n is a, c, g, or t
  modified_base (458)..(458): a, c, t, g, unknown or other
  misc_feature (458)..(458): n is a, c, g, or t
  modified_base (498)..(498): a, c, t, g, unknown or other
  misc_feature (498)..(498): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaangcccaccctctcctgcagggccagtcagagtcttagcggcaccttagcctggtaccagcagaaacctggccaggctccgaggctcctcatctatggtacatcccacgagggtcagttggtcgttccagccctaggttccaggtcggcgtagggtcggggtccggganaggtacgttcactctcacatcagcacgcctgctagtctgaagtnttttgcttatttattactgtaccactactataatatcgccctcgngtgtcgtcggacgaagggacaggtagaaactcgaacgtanggtcggactgcctaccatctcttctctac

SEQ ID NO: 235783 - DNA, 590 bp, Homo sapiens
  misc_feature: GYAE6OF01C4WRP.41.42.D09.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (288)..(288): a, c, t, g, unknown or other
  misc_feature (288)..(288): n is a, c, g, or t
  modified_base (357)..(357): a, c, t, g, unknown or other
  misc_feature (357)..(357): n is a, c, g, or t
  modified_base (377)..(377): a, c, t, g, unknown or other
  misc_feature (377)..(377): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccgaggggaaangccaccctntcctgcaggcccagtcagagtcttagcggcaccttgcctggtaccagcagaacctggccaggctcccgagctcctnatctatcggtacatccaccgagggtcacgtggtcttccagcctaggttcagtggcaggtcgggccgganaggagttccactctcgaccntcacgcacgtcctgctagtctagtaagttatttggacgttatttcttactcgtacctactaataattaacttacgttccggtacccctcggtcgttagggtaccgttccggaccgaagggtaacccgaagggtagaaaccgttacggaaaacgtacgttaggtcggcccgtaacgacgtacccgtaattcccttaacggttccttcctacccg

SEQ ID NO: 235784 - DNA, 629 bp, Homo sapiens
  misc_feature: GYAE6OF01D6ZR1.41.42.D09.1.454.CMB.1.raw
  modified_base (205)..(205): a, c, t, g, unknown or other
  misc_feature (205)..(205): n is a, c, g, or t
tcagtctatactatcacgaccggtgctcgatttagacacatacgcaggggaaaggggaggaactgctccagttaggacccagacggaccatggaagccccagcgcagcttctcttcctcctgctactctggctcccagatgtcactggagaaatagtgatgacgcagtctccacgccaccctgtctgtcgtctccgaggggaaangccaccctgtcctgcgagggccagtcagagttctagcggcaccttgcctgtaccagcagtaacctggccaggctccgaggcctccgtcactctagtcgtacatccacgaggtcacgtgtgtcagctaggttcacgtcggcgtaggtcgggtaccggaactagggtacgtttccgacgtctaccgtaaccctataccgacgacctacgtcctcggctaacgtctaggaaacgttcgttttggacgttaattttacgtacgttcgtacctaacctattaacttaagttaacgttccggacccgttccggtacggttacggtaccgtttccggacccgtaagggaacccgtaagggtacgtaaacgtaccggaaaacgtacgttggtccgagtcgaaccgtacgtagttacctcgtcgttcgtaccc

SEQ ID NO: 235785 - DNA, 574 bp, Homo sapiens
  misc_feature: GYAE6OF01DGYI7.41.42.D09.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
  modified_base (316)..(316): a, c, t, g, unknown or other
  misc_feature (316)..(316): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccgaggggaaancgccacctctcctgcaggccagtcagagtcttagcggcacttagcctggtaccagcagaaacctggaccaggcctccgaggcctcctcatctatgacntccacaggtcatgtntcagccagttcagtggcgtaggtcgggtcggacaggacgttcaccgttctcaaccgtatccgagccacggcctcggctacggtcttaaggaagttagttttggacgttaagttttattaaccgttgtacctaccgtaacttataaactacgttcgcccgtcggtcgttaggcgtttccggacgtaacgggacgtaagggtaggaaactacgtaaacgtagtggtcgtacgacgtcctaactctcgttcgtcttcgtcc

SEQ ID NO: 235786 - DNA, 704 bp, Homo sapiens
  misc_feature: GYAE6OF01AXJQC.41.42.D09.1.454.CMB.1.raw
tcagtctatactatcacgaccggtgctcgatttagacacatacgcagggaaagggggaggaactgctcagttaggacccagacggaaccatggaagccccagcgcagcttctcttcctcctgctactctggcctcccagatgtcactggagaaatagtgatgacgcagtctccagcccaccctgtctgtgtcctccgaaggggaagacgccaccctctcctgcagggccagtcagtagtcttaggccggcaccgttagcctggtaccagacaagaacctggccaggcctcccgaggcctcctcatctatcggtaccactccacgtagggtcacgtggtcttccgagtcccgtaggttcaggtcggcgtagggtcggggtaccggacgtacggtacgtttccaccttccgtaccaaccctagtacccgacggtccacggtcccgttaggtacttcgttagtaaagtttagttttacgtacgtttaactttttacgttacttcgtaaccaaccgttaacttaacttaaacttaacgttcccgggtaccccgttccggtccgggttacgggtacccggtttaccgggaacccggtaacggggaaccgtaaggggtacgtaaaacctaccgaaaaccggttacgtgggttacggccttaccggaccctaccgtaacgttcgttacgttccctttctaccgtttccccg

SEQ ID NO: 235787 - DNA, 764 bp, Homo sapiens
  misc_feature: GYAE6OF01AIYK7.41.42.D09.1.454.CMB.1.raw
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
  modified_base (259)..(259): a, c, t, g, unknown or other
  misc_feature (259)..(259): n is a, c, g, or t
  modified_base (284)..(284): a, c, t, g, unknown or other
  misc_feature (284)..(284): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccgaggggaaanacgccaccctctcctgcagggccagtcagngtcttagcggcacttgcctggtaccngcagaacctggccagctcaggctcncatctatgtacactccacgaggtccacgttcggtcgttccagtcccgtaggtttccgaggtcggacgtagggtcggggtacccgggaactacggtaacgttccaacgttccctaccgaaccctacgttaccgaacgccgacgtcccgttagaccgtacgttccgttaaggtaacgtttacgtttttacggacgttttaacgtttttaacgtttaaccgttcgttacccgtaaacccgtttaactttaaacgtttaaaacgtttaaccgtttacccggtcccccgtttaccgggtaccgggtttaccggggttacccggtttaccccgggacccggtaaaacgggggtaacccggtaaacgggttaaccgggaaaacgttaacccggtaaaaaccgggttaacggttacgggttacgggttaccggtaccggtacccgtaacccgttacgttaccgtttcgtttccgttaaccgttacccg

SEQ ID NO: 235788 - DNA, 843 bp, Homo sapiens
  misc_feature: GYAE6OF01B8DLQ.41.42.D09.1.454.CMB.1.raw
  modified_base (205)..(205): a, c, t, g, unknown or other
  misc_feature (205)..(205): n is a, c, g, or t
  modified_base (294)..(294): a, c, t, g, unknown or other
  misc_feature (294)..(294): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggaagaaatagtgatgacgcagtctccagcccaccctgtctgtgtctccgaggggaaancgcccaccctctcctgcagggccagtcagagtctagcggcacttagcctggtaccagcaagaacctggccaggcctcccgaggcctccncatctagtcggtacactcccgacgtagggtccacgttggtcgttcccgagtcccgtaggttccaggtcggacgtacggggttcgggggtacccgggaacgtaacgggtacgtttaccgaaccgtttccgtaacccgaacccttaacgttaccggaacggtacccgtaaccggtccccgttacgggtacctacgggtttacccgtaaagggtaaacggtttagtttttacggaccgttttaaatttttaaccgtttaaccgttacgtttaccctaaaccgttaaacgtttaaacttaaaacgtttaaccgtttacccgggtaccccccgtttaccggggtaccgggtttaccgggttaacccggtttacccggggaacccggtaaaacgggggtaaccccgtaaaagggggttaaccggtaaaaaacgttaacccggaaaaaccgggttaaaccggttacgggttaaccgggtacccgttaaccggtaaaccccgttaacccgttaacgtttacccggtttacggtttccccgtttaaccgttaaccccg

SEQ ID NO: 235789 - DNA, 724 bp, Homo sapiens
  misc_feature: GYAE6OF01D92GE.41.42.D09.1.454.CMB.1.raw
  modified_base (202)..(202): a, c, t, g, unknown or other
  misc_feature (202)..(202): n is a, c, g, or t
  modified_base (217)..(217): a, c, t, g, unknown or other
  misc_feature (217)..(217): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtcctccagccacctgtctgtgtctccgaggggaanacgccaccctctccngcagggccagtcagcgtctaggcggctaccttagccgtcggtaccacgacgacgaaacccgtggaccacggcctacccgaggtcctcctcattcctagtcggtacctacgtcccgaccgtagggtaccacggttcgggttcgttacccgacggtaccgtacggttcgagggttacggacggtacggggttacgggggtcccggggaacgttaacggtacggttcccaaccgttcctaccggtaaccctacgttaccgacgccgtaacgtccccgttagaccggttaacgttacgttaaggtaaacgtttacgtttttcggacgtttaatttttaaccgttacgttcgttaaccctacctaactttaaattaacgttacttcccgggaccccttccgggtacggttacgggtaccggttaccgggaccgtaaacgggaccgtaaggacgaaaacttcggaaacgtgtggtcggctcggactacgtgttacgttcgttcctagtccccg

SEQ ID NO: 235790 - DNA, 698 bp, Homo sapiens
  misc_feature: GYAE6OF01A9FHA.41.42.D09.1.454.CMB.1.raw
  modified_base (204)..(204): a, c, t, g, unknown or other
  misc_feature (204)..(204): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccgaaggggaaancgcccaccctctcctgcgacggccagtcagtacgtcgtagccggctaccgttagccgtgtaccagacacgaaccgtcggccacggccctacccgaggcctcccgtactacgtctagttcggtaccaccgtcccgaaccgtagggtccacgttcggttacgttcccgacggtccgtacggttcgaaggtcggacgtacggggtcggggtacccgaagtacggtacggttaccaccttacgtaccaactacgttaccgacgacgacggtccgtcgacgtacgttaccgtaaggtaacgtttacgtttacgtacgtttaattttacgttacgttacgtacctaacgttaacttaagttaacgttagtccgtacccgtcgttacggtcgttaccggttaccggacggaacggtaccggtaaaggtaacgtaaacgtacgtaaacggtcgtacggtcgacgttaccgcctaacgtactcgttacgttccttcgtacccg

SEQ ID NO: 235791 - DNA, 818 bp, Homo sapiens
  misc_feature: GYAE6OF01BIT4B.41.42.D09.1.454.CMB.1.raw
tcagtctatactatcacgaccggtgctcgatttagacacatacgcagggaaagggggaggaactgctcagttaggacccagacggaaccatggaagccccagcgcagcttctcttcctcctgctactctggcctcccagatgtcactggaagaaatagtgatgacgcagtctccagcccaccctgtctgtgtctccgaaggggaaagagcccaccctctcctgccgacgggccagtcagagttcgtagcggctaccgttagccgttaggtaccagacaacgaaaccgtgggccaacggtcctccccgaggtccttccctctacttccgtaagttacggtaacctaccttacccggaaccgtacggggttacccacggtttcgggtttaccgttaccccgaacggtacccgttagggtttccgaaggttcgggacgtaacggggtcgggggtaccgggaactagggttacgttcccaacgtttccgtacctaaccctagttacccgaagtccgtaaccggtcccttacggaccgtacgttacgttaaggtaacggtttaacgttttcgtaacgttttaactttttaaccgttaccgttacgttaaccctaaccttaaacttttaaacgttaacgtttaaccgtttcccggtaccccgtttcggtaccggtttacggggtacccgtttaccgggaacccggtaaaacgggaaccggtaaagggtacggtaaaaccgttaaccgtaaacggtaaccgttaggccgggtacctacggtacccaaccgttacttacccggtttacttccgtttcgtaaccccg

SEQ ID NO: 235792 - DNA, 809 bp, Homo sapiens
  misc_feature: GYAE6OF01D8E7B.41.42.D09.1.454.CMB.1.raw
  modified_base (723)..(723): a, c, t, g, unknown or other
  misc_feature (723)..(723): n is a, c, g, or t
  modified_base (741)..(741): a, c, t, g, unknown or other
  misc_feature (741)..(741): n is a, c, g, or t
  modified_base (799)..(799): a, c, t, g, unknown or other
  misc_feature (799)..(799): n is a, c, g, or t
tcagtctatactatcacgaccggtgctcgatttagacacatacgcagggaaagggggaggaactgctcagttaggacccagacggaaccatggaagccccagcgcagcttctcttcctctgctactctcggctccagatgtcacgtggaagaaatgtgatgacgcagtctcagccacctgtctgtgtcaccgaaggggaacacgccctacctctccgtgacgacgggaccaggtccaaggtacgttcgttacggccggtactaccgtttacggcccgttacggtaacccgaaggaccgtaaacggtaaaccccgttcgggacccgaacggggtccccttacccgacggtcctttcccccgtacgtaacttccgttaaggttaccgggttaaacccaccgtttaccccgaacccggttaacggggtaccttaccggtttacggggttaccgtttacccgaaacggttcccgggtagtttaccggaggttaccggcggtaacggggttccggggaccgggaactacgggttacgttcctaacccgttcgacctaaccgtacgtaccggaacggtccaacggttcgtcggacttcgggtacttaaggtaacgttttcgtagttacggtttaactttcgtttaacctcgtaacctaacccgttacttaagttaaacgttccgttaccgccccgttacggtaccggttacgtaccggttaacccgggngtaaaaccggtaaccggnggtaaacgaaacctaacggtaacgtacgtggttacgctaacggcaacgtctaccgttntcgtctaccg

SEQ ID NO: 235793 - DNA, 812 bp, Homo sapiens
  misc_feature: GYAE6OF01CCNEI.41.42.D09.1.454.CMB.1.raw
  modified_base (173)..(173): a, c, t, g, unknown or other
  misc_feature (173)..(173): n is a, c, g, or t
  modified_base (214)..(214): a, c, t, g, unknown or other
  misc_feature (214)..(214): n is a, c, g, or t
  modified_base (231)..(231): a, c, t, g, unknown or other
  misc_feature (231)..(231): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggcctccagatcgtcacgtggaagaaatagtgatgacgcagtcnccacgcccaccgtgtctgtcgtacgtacggaaggggaaacncgccctacctcgtccgnggaccgacgggacctaggtacgaacggtacgttcttaacgggccggacctaaccgtttcggacccgttacggtaaccgacgaacgaacgtaaaaccggtcggaccgaacggccctaccgacggtccttcactactcgtacgtcgtacaccgtaccgaacggtcggtactacgttcggtcgtaccaacggtcgtaggttcgaggtcggacggtacggggttacgggaccggaagtacggttacgttacgtacctccgtaaactaccgagtaccgacgaccgacgtccgtcggacgttaacggttcgttaaaggtaacgtttaaggttttaccggtaacgttttaacgttttacctacgtttaccgaacttaaccctaaatttaacgttaaacgttacggtttacccggcccctttaacggggtcggttaacgggtcccggttaacgggaacccgaaaagggtaccgtaaagggtaaccgttaaaacgaacggtaaaaccgtaggtcccggttaagtacccgtaacccgaacgttaaacccggttacttcccggttaaccgtttcgttacccggttaaccccg

SEQ ID NO: 235794 - DNA, 708 bp, Homo sapiens
  misc_feature: GYAE6OF01CKHX9.41.42.D09.1.454.CMB.1.raw
  modified_base (204)..(204): a, c, t, g, unknown or other
  misc_feature (204)..(204): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccgaaggggaaanacgcccaccctctcctgccagggccagtcagagtcttagcggcaccgttagcctggtaccagcaacgaaaccgtggaccacggcctccccgaggcctcctacactctagtcggtacactacccgacgtagggtcctacgttcgggttacgttccgagtccgtagggttccaggtcggcgtacggggttcgggggtacccggtagtacggtacggtttccaccgttccgtaccacctagtaccgacgaccgacgtcccgttagaccgtagttacgttaaggaacgtttagttttcggacgttaattttttaaccggttaccttacggttacctaaaccttactttaaagttaacttaacggtttccgggtacccccttcgggtaccgggttacgggttaacccggttccgggaaccggtaaacgggtaccggtaaagggtacggtaaactaccgtaaaacggtacgtagggtcgactacgacctaacgtctcttactctctaccg

SEQ ID NO: 235795 - DNA, 560 bp, Homo sapiens
  misc_feature: GYAE6OF01E4U0P.41.42.D09.1.454.CMB.1.raw
  modified_base (203)..(203): a, c, t, g, unknown or other
  misc_feature (203)..(203): n is a, c, g, or t
  modified_base (361)..(361): a, c, t, g, unknown or other
  misc_feature (361)..(361): n is a, c, g, or t
  modified_base (377)..(377): a, c, t, g, unknown or other
  misc_feature (377)..(377): n is a, c, g, or t
  modified_base (403)..(403): a, c, t, g, unknown or other
  misc_feature (403)..(403): n is a, c, g, or t
  modified_base (557)..(557): a, c, t, g, unknown or other
  misc_feature (557)..(557): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccgaggggaaangccaccctctcctgcagggccagtcagagtctagcggctaccttagcctggtaccagcaagaacctggccaggcctccgaggcctcctcatctagtggtacatcccacgtaggtcacgtggtctccagcctaggttcagtggctaggtgggtccggangtgttcactctcaccntcagcacgcctgctagtctgtaagtntttgacgttatttacttacgtactccaactactaactaattaacgttccggccccgttccggtcggttacggtacgtttccggaccgaacgggtaccgagggtacgaaataccggaaacgtacgtggtcggctgcctacgacttctgttccttntcc

SEQ ID NO: 235796 - DNA, 728 bp, Homo sapiens
  misc_feature: GYAE6OF01EVOU1.41.42.D09.1.454.CMB.1.raw
  modified_base (153)..(153): a, c, t, g, unknown or other
  misc_feature (153)..(153): n is a, c, g, or t
  modified_base (220)..(220): a, c, t, g, unknown or other
  misc_feature (220)..(220): n is a, c, g, or t
  modified_base (467)..(467): a, c, t, g, unknown or other
  misc_feature (467)..(467): n is a, c, g, or t
  modified_base (695)..(695): a, c, t, g, unknown or other
  misc_feature (695)..(695): n is a, c, g, or t
tcagtctatactatcacgaccggtgctcgatttagacacatacgcagggaaagggggaggaactgctcagttaggacccagacggaaccatggaacgccccagcgcagcttctcttcctcctgctactctggcctccagtatgtcagtggaanaaattgtgatgacgctagtcctacgacgccctaccgtgtctgttcgtaccgtacggaaggggaaacnccgacccctacccttcgtaccgcggaccggacggtaccgtagtacggaacgttacggttcgttacggcccggtaccttaccgtaccgtccgtagtaaccgacgtaacgaaaccggtaaccgtccggtaccgacggtccctaccggacgtccttaccctgtacgttacgtacgttaccggtacctaccggtacccgtacggtacggtcctagtcggttcctaccgacgtcggtacgtcggacggtcgnggtacggggtcggtacgagtacgtacctacaccgttcacctaacgcaacgcgtacgaccggtcacggtctagtaccggttaagtaacgtttgttacgttacctttaagttccgttacctacgtaactaacgtttaacgtattaacgttccgtcccgtccgtagtaccggtcggttaacggccggaacggtacgaacggtaggtaacaacgtaagtacggtagtcggcncttacggactacgtctacgtctcgtacttaccg

SEQ ID NO: 235797 - DNA, 763 bp, Homo sapiens
  misc_feature: GYAE6OF01BYVTO.41.42.D09.1.454.CMB.1.raw
  modified_base (205)..(205): a, c, t, g, unknown or other
  misc_feature (205)..(205): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggcctccagatgtcactggagaaatgtgatgacgcagtctccagccacctgtctgtcgtcgtaccgaaggggaacncgccaccctctccgtgcgacgggccagtcagtacgttcgttaggccggtacctaaccgtttacggccgttacggtaaccagtaccaaacggtaaaccgtcgggacccacggtcctacccgacggtcccttacctacgtactttacgtacggttacggtaacctaaccgttacccgaaccggtagggtcctaacggttcgggttacgtaccgaacggtccggtaggttacgacggtacgggtacggtacgggggtcggggtaaccgggaacgtaacggttacgttacccgtaccgttaccgtaaccgtaaccctacgttacccgacggtacccggacggttccccgttaggaccgttaacggttaccgtaaggttaacgtttcggttttacgtacgtttaattttaacgtacctacgttacctaacgttaacttaacttaacgtacgtccgtaccgtccgtggtaccggtacgtacggacgtaacggacgtaaggtacgaaacgtacgaaacgtacgtggtcgactacggacctacgtacttacgtcttccgtctaccg

SEQ ID NO: 235798 - DNA, 668 bp, Homo sapiens
  misc_feature: GYAE6OF01DWPZV.41.42.D09.1.454.CMB.1.raw
  modified_base (204)..(204): a, c, t, g, unknown or other
  misc_feature (204)..(204): n is a, c, g, or t
  modified_base (373)..(373): a, c, t, g, unknown or other
  misc_feature (373)..(373): n is a, c, g, or t
  modified_base (386)..(386): a, c, t, g, unknown or other
  misc_feature (386)..(386): n is a, c, g, or t
tcagtctatactatcacgaccggtgctcgatttagacacatacgcagggaaagggggaggaactgctcagttaggacccagacggaaccatggaagcccccagcgcagcttctcttcctcctgctactctggctcccagatgtcactggagaaatagtgatgacgcagtctccagcccaccctgtctgtgtctcgaaggggaancgccaccctctctgcacgggccagtcagagtctagcgctactgctgacagcagaacctgacacgctccgagcctcctcatctagtcgtacactaccgaccgtaggtctacgtggtacgttccaagtcctaggtcaggtggcgtagggtcgggaccggacaggtctaccnctccgactacganactacgcgtacgtctcgtacgtaagttcgtagtaaggtttctttacggtactttaattttacggttacctacgtttaacccaaccgtttaacttaaacgtttaaacgtttaaccggttcccggtacccccgtttacgggtcccgggttaacgggttcccgtaacccggggtacgaaccggggtaacgtaacgggtaacgtaaaccgaaccggtaaacgtaacggttggtaccgggtacctacgacccgtacttaccgtgtttaccgttctcccgttaacccg

SEQ ID NO: 235799 - DNA, 717 bp, Homo sapiens
  misc_feature: GYAE6OF01BCOOT.41.42.D09.1.454.CMB.1.raw
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccgaggggaagcgccaccgtctccgtgcgaggccagtcgaggtacgttcgttacgccgggtactaccgttacgccgtcggtaacccagaccgtaaacgaaacccgtcggacctacggtcctacccgacggtacctcctacgacttccgtagttacggtacctacgtacccgaaccgtagggtacctacgttcgggttcgttacccgacgttacccggtaggttcgaacggtcggacggtacgggtcggggtaccggacgtaggttacgtcctacgtcctacaacctagacgtagcgtacgtccgtagtccgtaagtacccgtagtacgttacttttaggaccttttaagtttccttacgttacgttaccctaaacttacgttaaattaacgttacgttccggtacccgtcgtaccggttagggtcccgttaacgggacgtaacgggtaaccgaggtaacggtaaactaccgaaacggtcgttggacgtaccgtgtaccacgttcgtagtttccgtccttggtaccc

SEQ ID NO: 235800 - DNA, 930 bp, Homo sapiens
  misc_feature: GYAE6OF01AWSYI.41.42.D09.1.454.CMB.1.raw
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagcccaccctgtctgtgtcctaccgaaggggaaacgacgcccaccctcctccgtggccgacggggccagtccaaggtacgttacgttacggccggacctaccgttacgcccgtacggtacccacgtacaacggaaaccgtcggacccacgggccctaccccgacggtcctcctctactccttacgtacggtaccacgttacccaaccggtacgggtacctacggttcggttcgttacccgacggtaccgttaggttaccgtaggtcggcgtaggggtcggggtaccggaacgacggtacgttccaccgtttctacccgaacctacgtaccgacgtccgtaaccggtccgtacggaccgttacggttacgttaacggttaacggttacgtttttacggtaacgttttaacgttttttaaccgtttaccgtaccggtttaaccctaaaccctttaaacgtttaaaactttaaaccgttttaaccggtttaccccggggttacccccgttaaccccggggtttaccgggggttaacccggggtttaacccgggttaccccggggtaaaacccggggtaaccggggttaaaaacccgggttaaacgggttaaaacgggtaaaaacccgttaaacccgggtaaaaccgttaaccgggtttaacggggttaccgggttaacccgttaaccggtaacccgttaaaccccgttacggtttaccccgttttaccgggtttccccttttaacccggttaaccccccgg

SEQ ID NO: 235801 - DNA, 489 bp, Homo sapiens
  misc_feature: GYAE6OF01APJV9.41.42.D09.1.454.CMB.1.raw
  modified_base (399)..(399): a, c, t, g, unknown or other
  misc_feature (399)..(399): n is a, c, g, or t
  modified_base (435)..(435): a, c, t, g, unknown or other
  misc_feature (435)..(435): n is a, c, g, or t
  modified_base (470)..(470): a, c, t, g, unknown or other
  misc_feature (470)..(470): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaagagccaccctctcctgcagggccagtcagagtcttagcggcaccttagcctggtacccagcagaaacctggccaggctcccaggctcctcatctatggtacatccaccagggtcacgtggtgttcccagccaggttcagtggcaggtgggtccggacaggagttcactctcaccatcagcagcctgcagtctagagtntttgctatttatactgtcacactatatatgcctcgngtgcgtcgccaaggcaggtagaatcgaacgtatgngctgcacatctgtctctac

SEQ ID NO: 235802 - DNA, 701 bp, Homo sapiens
  misc_feature: GYAE6OF01DVTIH.41.42.D09.1.454.CMB.1.raw
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
  modified_base (695)..(695): a, c, t, g, unknown or other
  misc_feature (695)..(695): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccacctgtctgtgtctcgaaggggaancgccaccctctccngacgagggccagtcagcgtcgtagccggactaccgttacgccgtacggtaccagaccaacggaaacccgtcggacccgacggtacctaccgaacggtcctcccgtactaacgttccgttaagttcggtaacctactaccccgaaccggtacgggtcctacgttggtccgttccgacgtaccgtaggttcgaggtcggtacgtaggggtcggggtaccggaacgtaggtaccgttcaccgttctaccaactctaccgagccacgtccgtgacgtagtacgtaaggtaagttacgtttacgtacgtttattttacgtacgttacgtacctaacctaatttaacgtaactttaacgttaccggtcccgtacggtcggtaccgggttaccgttaccgggaccggtaacgggacgtaagggtaaccgaaacgtaccgaaaacggtacgtggtcggacgtcgacctaccgttactcgttctcgttntacccg

SEQ ID NO: 235803 - DNA, 794 bp, Homo sapiens
  misc_feature: GYAE6OF01B3KOC.41.42.D09.1.454.CMB.1.raw
  modified_base (210)..(210): a, c, t, g, unknown or other
  misc_feature (210)..(210): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtcctccagccctaccctgtcctggtgtcctccgaaggggaacncgcccaccctcgtcctgacgacgggcctagtcagtacgtcttaggcggacctaccttagccgtacggtaccacgacgaacgaaaccctggaccgacggtccctacccgacggtcctccgtctattccgtaagtcggtacacgtcccgacgtaggtctacgttggtcctaccagccgtagtcgaggtcggctgggtcgggtaccgatacggtctaccacttccaacgacctagtccgagccgacggtaccttgaccgttagtacgttaaggttaacgttgttttacgggtaacttttaacgttttaacgttaccgttacgtaaccctaaaccgttaacgttttaaacttaaaccggttaccggttaccccggtacccccgtttaccgggggtacccgggtttaaccggggttaccccgggtttaccgggaaacccggtaaaccgggggtaaccggttaaaggggttaaaccgtaaaactaaacccggggtaaaccgttagggtaccgggttacggtaaccttaccggtaaccccttaaccgttacgttaccccggttttcgttacccgtttccttaacccccggg

SEQ ID NO: 235804 - DNA, 855 bp, Homo sapiens
  misc_feature: GYAE6OF01A2DBG.41.42.D09.1.454.CMB.1.raw
  modified_base (210)..(210): a, c, t, g, unknown or other
  misc_feature (210)..(210): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcacgtggagaaatagtgatgacgcagtcctccagccaccctgtcctgtcgtcctaccgaaggggaacncgcccaccctctcctggaccgacggccacgtacgaggtacgttcgttaggccggtctaccgttacgccgtacggaccagtaccaacggaaacccgtggaccgacggccctacccgacggtcctacctactacttcgttagtcgtaacctaactcccgacggtacgggtctaacggttcggttccgtacccgacggtaccgtacggtttccgtaaggtcggacgtagggttcccggggtacggaacgtaggttaccggtacctacgttaccaccgtaacctaacgtccgaaccgacacccggttcccgtagttccaacgggtttctaaacgggttagttttaacgttttacgggaacttttaagttttaacttaccgtacgttaccctaaaccgttactttaaaagttaactttacgggttaccccgggttacccggttacccgggtttacgggtaacccgggggttcccgtaaacccgggggtacccggtaaaacgggtaacccggtaaaacggggttaaacggtaaaaccgtttaaaccccgggaaaacgtttacgggtacggtacccggtaaccttaacccgggaccccttaacggtaacccgtttaaggttcccgtttaaacccgttcccgttaaaccccgg

SEQ ID NO: 235805 - DNA, 495 bp, Homo sapiens
  misc_feature: GYAE6OF02GROLD.41.42.D09.1.454.CMB.1.raw
  modified_base (354)..(354): a, c, t, g, unknown or other
  misc_feature (354)..(354): n is a, c, g, or t
  modified_base (492)..(492): a, c, t, g, unknown or other
  misc_feature (492)..(492): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaagagccaccctctcctgcagggccagtcagagtcttagcggcaccttagcctggtaccagcagaaacctggccaggctcccaggctcctcatctatggtacatccaccagggtcactggtgttccagccaggttcagtggcagtgggtccgganagagttcactctcaccatccagcagcctgcagtctgaagtatttgcgtatttattactgtcacactataataatcgccctcgcgtgacgttcgccaaggaccaggtgaatcgaaacgactgtgctgcacatctgtctntac

SEQ ID NO: 235806 - DNA, 498 bp, Homo sapiens
  misc_feature: GYAE6OF02HMIHF.41.42.D09.1.454.CMB.1.raw
  modified_base (354)..(354): a, c, t, g, unknown or other
  misc_feature (354)..(354): n is a, c, g, or t
  modified_base (495)..(495): a, c, t, g, unknown or other
  misc_feature (495)..(495): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaagagccaccctctcctgcagggccagtcagagtcttagcggcaccttagcctggtaccagcagaaacctggccaggctcccaggctcctcatctatggtacatccaccagggtcactggtgttccagccaggttcagtggcagtgggtccgganagagttcactctcaccatcagcagcctgcagtctgaagtattttgcgtatttattactgtcacctactataataattgccctcgcgtgacgttcggcaagggaccaggtgaatcgaaacgactgtgctgcacatctgtctntac

SEQ ID NO: 235807 - DNA, 505 bp, Homo sapiens
  misc_feature: GYAE6OF02GWVUF.41.42.D09.1.454.CMB.1.raw
  modified_base (202)..(202): a, c, t, g, unknown or other
  misc_feature (202)..(202): n is a, c, g, or t
  modified_base (321)..(321): a, c, t, g, unknown or other
  misc_feature (321)..(321): n is a, c, g, or t
  modified_base (354)..(354): a, c, t, g, unknown or other
  misc_feature (354)..(354): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaanagccaccctctcctgcagggccagtcagagtcttagcggcaccttagcctggtaccagcagaaacctggccaggctcccaggctcctcatctatggtacatccaccagggtcactggtnttccagccaggttcagtggcagtgggtccgganagagttcactctcaccatcagcagcctgcagtctgaagtatttgcgtatttatacttgtcactactataataattggccctcgcgtggacgttcggccaagggaccaaggtgaatacgaaacgaactgtgctgcaccgatctgtcttctac

SEQ ID NO: 235808 - DNA, 508 bp, Homo sapiens
  misc_feature: GYAE6OF02ISO94.41.42.D09.1.454.CMB.1.raw
  modified_base (319)..(319): a, c, t, g, unknown or other
  misc_feature (319)..(319): n is a, c, g, or t
  modified_base (351)..(351): a, c, t, g, unknown or other
  misc_feature (351)..(351): n is a, c, g, or t
  modified_base (354)..(354): a, c, t, g, unknown or other
  misc_feature (354)..(354): n is a, c, g, or t
  modified_base (391)..(391): a, c, t, g, unknown or other
  misc_feature (391)..(391): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaagagccaccctctcctgcagggccagtcagagtcttagcggcaccttagcctggtaccagcagaacctggccaggctcccaggctcctcatctatggtacatccacagggtcactggtnttccagccaggttcagtgcagtgggtccgganagngttcactctcaccatcagcagcctgcagtctgaagtntttgctatttattactgtcaccatataatattcgcctcgcgtcgacgttcgaccgaagggaccaaggtacggaactacgaaacgactggtacgactgacaccgatctgttcttctac

SEQ ID NO: 235809 - DNA, 639 bp, Homo sapiens
  misc_feature: GYAE6OF02GWYD3.41.42.D09.1.454.CMB.1.raw
  modified_base (223)..(223): a, c, t, g, unknown or other
  misc_feature (223)..(223): n is a, c, g, or t
  modified_base (396)..(396): a, c, t, g, unknown or other
  misc_feature (396)..(396): n is a, c, g, or t
tcagtctatactatcacgaccggtgctcgatttagacacatacgcagggaaagggggaggaactgggctcagttacggacccagacggaaccaatggaaggcccctagcgtcagcttctcttcctcctgctactctggctcccacgatggtctacgtggagaaatagttggtactgtacgctagttctccgaggccaccctgtctgtgtctccaggggaaagngccaccctcgtccgtggccgacgggccagtcgaacgacgtcttagcggcaccttagcctggtaccacgcagaaaccttggcctaggctcccgagctcctcatctatggtacactccacgacggtcacgtggtagttccaggccgtagggttcagtggctagtgggtaccgganagtagttacacgtactacaccagtcacgtcgagccgtgctacgtctagaacgtatttgacgtatttacgtacgtgtaccaacctataataattaacgttcggacccctttagaccgttacggtaccgtttaccggaccaaaggggtacccgaaagggttacgaaacgttaccgaaacggtaacgttggttacggtcgtacgaccgtaaccgtaccgttcccgtacggtaccttacccgtaccg

SEQ ID NO: 235810 - DNA, 495 bp, Homo sapiens
  misc_feature: GYAE6OF02F1PUJ.41.42.D09.1.454.CMB.1.raw
  modified_base (202)..(202): a, c, t, g, unknown or other
  misc_feature (202)..(202): n is a, c, g, or t
  modified_base (320)..(320): a, c, t, g, unknown or other
  misc_feature (320)..(320): n is a, c, g, or t
  modified_base (433)..(433): a, c, t, g, unknown or other
  misc_feature (433)..(433): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaanagccacctctcctgcagggccagtcagagtcttagcggcaccttagcctggtaccagcagaaacctggccaggctcccaggctcctcatctatggtacatccaccagggtcactggtnttccagccaggttcagtggcagtgggtccgggacagagttcactctcaccatcagcagcctgcagtctgaagtattttgcgtatttattactgtcacatataatatgcctcgngtgacgttcgcaaggaccaaggtgaatcgaaacgaactgtcgctgcacatctcgtcttctac

SEQ ID NO: 235811 - DNA, 530 bp, Homo sapiens
  misc_feature: GYAE6OF02GYGJH.41.42.D09.1.454.CMB.1.raw
  modified_base (202)..(202): a, c, t, g, unknown or other
  misc_feature (202)..(202): n is a, c, g, or t
  modified_base (321)..(321): a, c, t, g, unknown or other
  misc_feature (321)..(321): n is a, c, g, or t
  modified_base (359)..(359): a, c, t, g, unknown or other
  misc_feature (359)..(359): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaanagccaccctctcctgcagggccagtcagagtcttagcggcaccttagcctggtaccagcagaaacctggccaggctcccaggctcctcatctatggtacatccaccagggtcactggtnttccagccaggttcagtggcaggtgggtccgggacagngttcactctcaccatcagcagcctgcagtctgaagtattttgcgtatttattacttgtaccacctactataattaattcggccctccgcgtcggtacgttcgggccaaagggaccaagggtaggaaactacgaaacgtaacgtggtggctgacacctatctgttcttctac

SEQ ID NO: 235812 - DNA, 498 bp, Homo sapiens
  misc_feature: GYAE6OF02FU4R7.41.42.D09.1.454.CMB.1.raw
  modified_base (203)..(203): a, c, t, g, unknown or other
  misc_feature (203)..(203): n is a, c, g, or t
  modified_base (321)..(321): a, c, t, g, unknown or other
  misc_feature (321)..(321): n is a, c, g, or t
  modified_base (356)..(356): a, c, t, g, unknown or other
  misc_feature (356)..(356): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaagngccaccctctcctgcagggccagtcagagtcttagcggcaccttagcctggtaccagcagaaacctggccaggctcccaggctcctcatctatggtacatccaccagggtcactggtnttccagccaggttcagtggcaggtgggtccggacnggagttcactctcaccatcagcagcctgcagtctgaagtattttgcgtatttattactgtcacactataatatgccctcgcgtgacgttcgcgaaggaccaaggtgaatcgaaacgactgtgctgacacatctgtcttctac

SEQ ID NO: 235813 - DNA, 539 bp, Homo sapiens
  misc_feature: GYAE6OF02GGTFO.41.42.D09.1.454.CMB.1.raw
  modified_base (202)..(202): a, c, t, g, unknown or other
  misc_feature (202)..(202): n is a, c, g, or t
  modified_base (359)..(359): a, c, t, g, unknown or other
  misc_feature (359)..(359): n is a, c, g, or t
  modified_base (403)..(403): a, c, t, g, unknown or other
  misc_feature (403)..(403): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaanagccaccctctcctgcagggccagtcagagtcttagcggcaccttagcctggtaccagcagaacctggccaggctcccaggcctcctcatctatggtacatccacgagggtcacgtggtcgttccagccaggttcaggtggcaggtgggtccggganaggagttcactctacaccatcagcagcctgcagtctagaacgtntttgacgtattttactactgtacacctattataattacgttcggccctcgcgtcgtacgttcggaccgaagggaccaagggtagaaactacgaaacgtacgtggtacggactagaccactatcgtcgtccttctac

SEQ ID NO: 235814 - DNA, 566 bp, Homo sapiens
  misc_feature: GYAE6OF02GPQ0N.41.42.D09.1.454.CMB.1.raw
  modified_base (203)..(203): a, c, t, g, unknown or other
  misc_feature (203)..(203): n is a, c, g, or t
  modified_base (368)..(368): a, c, t, g, unknown or other
  misc_feature (368)..(368): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaagngccaccctctcctgcagggccagtcagagtcttagcggcaccttagcctggtaccagcagaaacctggccaggctcccaggcctcctcatctatggtacatccaccagggtcacgttggtcgtccagcctaggttcaggtggcgaggtcggggtccgggacaggngttcactctcaccatcagcacgcctgcagtctagtaagtatttgacgttatttattacttgtacactactataatagttcgccctcgcgtcggtaccgttcggaccaaacgggtaccgaagggtacggtaaagtaccgaaaacgtaacgttaggtacggtcgtacggccaaccgtactccgtcgttccttacgtaccg

SEQ ID NO: 235815 - DNA, 644 bp, Homo sapiens
  misc_feature: GYAE6OF02H8B1M.41.42.D09.1.454.CMB.1.raw
  modified_base (202)..(202): a, c, t, g, unknown or other
  misc_feature (202)..(202): n is a, c, g, or t
  modified_base (292)..(292): a, c, t, g, unknown or other
  misc_feature (292)..(292): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctccagatgtcactggagaaatagtgatgacgcagtctccagccaccctgtctgtgtctccgaggggaaangcccaccctctcctgcagggccagtcagagtcttagcggcaccttagcctggtaccagcaagaacctggccaggctcccgaggcctcctnactctatggtacactccaccgagggtcacgtggtgttccagcctaggttcaggtcggctagggtcggggtaccgggataggacgtttcaacttctaccaccatcagcacgcctgcagtctagaagtatttgacttaattttacttacttgtacctaactactaattaaactttaacgttccgggtaccccttaccgggtcggttacgggtaccgtttacccgggaaccggtaaaccggggtaacctaacggggttacgggtaaaaccttaccggaaaaccggtaacgttagggtaccggtactacggtacccaacccgtagtttacccttacggttaccctttacgtacccg

SEQ ID NO: 235816 - DNA, 567 bp, Homo sapiens
  misc_feature: GYAE6OF02HHETC.41.42.D09.1.454.CMB.1.raw
  modified_base (202)..(202): a, c, t, g, unknown or other
  misc_feature (202)..(202): n is a, c, g, or t
  modified_base (408)..(408): a, c, t, g, unknown or other
  misc_feature (408)..(408): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaangccaccctctcctgcagggccagtcagagtctagcggcaccttagcctggtaccagcagaacctggccaggctccaggctcctcatctatcggtacactcccaccgagggtcacgtggttcgttccagcctaggttcagtcggctaggtcgggtccgggataggacgttccactctccaccatcagcagcctgcagtctgaagttnttttgcgttaatttattacgtgtccaactacttaattaaattaagttccggtcccttccgtcggttacggtaccggtttcggacccgaagggaccgaagggtacggaaatacggaaacgtaacgtgtacggtctacgcctacgtattctcgttctctac

SEQ ID NO: 235817 - DNA, 814 bp, Homo sapiens
  misc_feature: GYAE6OF02J1O68.41.42.D09.1.454.CMB.1.raw
  modified_base (118)..(118): a, c, t, g, unknown or other
  misc_feature (118)..(118): n is a, c, g, or t
  modified_base (138)..(138): a, c, t, g, unknown or other
  misc_feature (138)..(138): n is a, c, g, or t
  modified_base (169)..(169): a, c, t, g, unknown or other
  misc_feature (169)..(169): n is a, c, g, or t
  modified_base (172)..(172): a, c, t, g, unknown or other
  misc_feature (172)..(172): n is a, c, g, or t
  modified_base (191)..(191): a, c, t, g, unknown or other
  misc_feature (191)..(191): n is a, c, g, or t
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (235)..(235): a, c, t, g, unknown or other
  misc_feature (235)..(235): n is a, c, g, or t
tcagtctatactatcacgaccggtgctcgatttagacacatacgcagggaaagggggaggaactgctcagttaggacccagacggaaccatggaagccccagcgcagcttctcttccnctgctactctggctcccagntcgtcatggaagaaatgtgatgacgcagtcnccngcctacctgtctgtgttcnccgaaggggaancgccaccgtctccgngcgacgggcacgtnagngttctaacggccgtcctaacgttcgccgtcgtaccgacgacgacgtaaccgtcggaccgacggcctacccgtacggtaccttccgactactcgtacgtacggtaccacctaccgaaccggtacgggttaccgtaccggttacggttccggtaccgtacggtaccggtaacggttccggatttcggggaccgtacggggtcgggttacccgggggaactacgggacgttttccgaaccgttccggtcctaacccgagtttacccgaacgggttccaagggcccctttagggtcccctaagggtcccttaggttaacggtagtttttacggacggtttaacttttacggttaaccttacggtttaccaaccgttaacgttactttaaaccggttaacctttacgggaccctttccgggccggtttaccgggaaaccgttttcggggaaaccctaacgggggtacctaaaggggtacccgggtaaaacgttaccggtaaaaccgggtaccttaagggtaacggtaccgttaggtacccgtacgtaccgtttaccgttacggttacccgtttccgttaacccg

SEQ ID NO: 235818 - DNA, 827 bp, Homo sapiens
  misc_feature: GYAE6OF02JSQLG.41.42.D09.1.454.CMB.1.raw
  modified_base (153)..(153): a, c, t, g, unknown or other
  misc_feature (153)..(153): n is a, c, g, or t
  modified_base (211)..(211): a, c, t, g, unknown or other
  misc_feature (211)..(211): n is a, c, g, or t
  modified_base (296)..(296): a, c, t, g, unknown or other
  misc_feature (296)..(296): n is a, c, g, or t
tcagtctatactatcacgaccggtgctcgatttagacacatacgcagggaaagggggagggaacgtagcgtcagttaggaccagacggaaccatggaagcccagcgcagcttctcttcctcctgctactctggctcccagactgtcactgganaatagtgatgacgcagtctccagccaccctgtcctgtacgttctaccgaggggaaacncggcccaccctcgtcctcgcctacgggccctagtccaagtacgtcttacggccggtactacccgttagtcccgtgggtaaccccnggaccaaaggtaaaccccgttgggaccctaacggggccccttacccccggaagggccctttcccctacgtaagtttcccgaagtttcccgggttaaacacggtttcccaaaccccgtacgggggtttcccaaacgtttccggggttccggtttacccaacggttaccccgtaagggttttacccgaacggtttcggggaccgttaacgggttccgggggggttaacccggagtaaacggggttaccggttttaccctaacgtcccggtttaaccgtaaccggactttacccgggaacgtacgaaccgtccgtacggtccgtacgttaccgtgtaaacgttcgttttcggtacggtactttttacgttacttcgtataccctaacgttattaacttacgttcggtacctacccgtggtccgttaacgttcgggaaaccgtaacggaaccgtaagtacggtaaacgttccgaaacggttaactacggtacgtacgttacgacctacgtacttaccgtcgttacttacgtaccc

SEQ ID NO: 235819 - DNA, 745 bp, Homo sapiens
  misc_feature: GYAE6OF02H2DLN.41.42.D09.1.454.CMB.1.raw
  modified_base (186)..(186): a, c, t, g, unknown or other
  misc_feature (186)..(186): n is a, c, g, or t
  modified_base (200)..(200): a, c, t, g, unknown or other
  misc_feature (200)..(200): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctccagatgtcactggagaaatgtgatgacgctagtctccagccacctgtctgtntctccgagggaacncgccctacctctcctgccgacgggccagtcagacgtcttagccggctaaccgttgccgtaggtaccagaccaacgaaccgtcggacccaggccctacccgacggtccttccgtacaacgttcttaacggtcggtaacctaccgtcccaaccggtacgggttactacggttggtcttacccgaggtcccgtaggtttacgacggtcggtcgtaacggggttccggggtccgggtaaactcgggtaaccgtttccgtaacccgttctaacccgtaccgtacgttaaccgacgtccgaacggtcccgtacggtacgtaacggttacgttaacgggtaaagtttcgtttttaccgggaacgttttaaatttttaacgtttaccgtacgttaaccctaagtaactttaattaaacgttacgtccgtaccccgtcggtacgtacgggtaccgttccgggaaacgtaacgggacgtaaggtacgaactacggtaaacgtcgttgtaccgtctaccggaaccttaccgacgttccgtacgttcctactacccg

SEQ ID NO: 235820 - DNA, 720 bp, Homo sapiens
  misc_feature: GYAE6OF02FQR66.41.42.D09.1.454.CMB.1.raw
  modified_base (200)..(200): a, c, t, g, unknown or other
  misc_feature (200)..(200): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctcaggggaanacgccacctctcctgcagggccagtcagagtcttagcgcacttgcctggaccagcagaaacctggccaggctcccgaggcctcctcatctagtggtacactccaccgtagggtcacgttggttcgttaccgaggcctagggttcaggttggcgtagggttcggggtccgggactacggtacgttaccacgttcctacaccgtactcgacgcgacgccgtagcgtaagttccgtaggtaacgttacgtttttacgggacgtttaactttttaacgttacgttaccgttacctaacccttaactttaaagttaaacgtttaaacgtttccgggttacccccgttacgggttccggttaccgggttaaccggtttaccgggaacccggtaacgggggtaacccgtaaacggggttaccggaaaacgttaacccggtaaaaaccggtaacggttaccgggttacgggtaaccgtacggtaccttaacccgtagttacccgtacggtttccctttacgtaccccg

SEQ ID NO: 235821 - DNA, 635 bp, Homo sapiens
  misc_feature: GYAE6OF02FWI38.41.42.D09.1.454.CMB.1.raw
  modified_base (205)..(205): a, c, t, g, unknown or other
  misc_feature (205)..(205): n is a, c, g, or t
  modified_base (430)..(430): a, c, t, g, unknown or other
  misc_feature (430)..(430): n is a, c, g, or t
tcagtctatactatcacgaccggtgctcgatttagacacatacgcaggggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccgaggggaaagngccaccctctcctgcagggccagtcagagtcttagcggcaccttagcctggtaccagcaagaacctggccaggcctccgaggcctcctcatctatggtacactccaccgagggtcacgtggtcgttccagtcctaggttcaggtggcagggtcggggtaccgggacaggtacgttccacgtcctaccaacctagtccagccacgcctgactgtctaggtaagttntttcggacttattttactacttcgtaccaacctattaataaattaacgttccgtaccccgtcggtcggttacgggtaccgtttcggacccggtaaaggggacccgtaagggttacgggaaacttaccggtaaaaccgtaacggttcgggtacggtacttacggaccctaccgttacgttaccgttcgtttaccttccttaacccg

SEQ ID NO: 235822 - DNA, 574 bp, Homo sapiens
  misc_feature: GYAE6OF02GD16T.41.42.D09.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (232)..(232): a, c, t, g, unknown or other
  misc_feature (232)..(232): n is a, c, g, or t
  modified_base (255)..(255): a, c, t, g, unknown or other
  misc_feature (255)..(255): n is a, c, g, or t
  modified_base (264)..(264): a, c, t, g, unknown or other
  misc_feature (264)..(264): n is a, c, g, or t
  modified_base (269)..(269): a, c, t, g, unknown or other
  misc_feature (269)..(269): n is a, c, g, or t
  modified_base (288)..(288): a, c, t, g, unknown or other
  misc_feature (288)..(288): n is a, c, g, or t
  modified_base (367)..(367): a, c, t, g, unknown or other
  misc_feature (367)..(367): n is a, c, g, or t
  modified_base (557)..(557): a, c, t, g, unknown or other
  misc_feature (557)..(557): n is a, c, g, or t
tcagtctatactatcacgaccggtgctcgatttagacacatacgcagggaaagggggaggaactgctcagttaggacccagacggaaccatggaagccccagcgcagcttctcttcctcctgctactctggctcccagatgtcactggagaaatgtgatgacgcagtctccagccaccctgtctgtgtctccgaaggggaaangcccaccctntcctgcagggccagtcagntctagcgctacttgcctggaccngcagaaccnggccnggcctcccgaggcctcctnatctagtcggtacactccaccgtaggtccacgttggtcgttccgagcctaggttcaggtcgcgtagggtcgggcggganaggtgtccactcgcacgtatcgacgctagcctgctaggtctagtaagttctttcgacgttattttactgtctacctactaactttaataacttaacgttcggtcccgtcgtacgggtcggtaccgttccggacgaaacgggtacctaagggtacgaaataccgaaaggtactggtacgcgtagcctactntccgtatccgttatacc

SEQ ID NO: 235823 - DNA, 1031 bp, Homo sapiens
  misc_feature: GYAE6OF02GQ5VE.41.42.D09.1.454.CMB.1.raw
  modified_base (173)..(173): a, c, t, g, unknown or other
  misc_feature (173)..(173): n is a, c, g, or t
tcagtctatactatcacgaccggtgctcgatttagacacatacgcagggaaagggggaggaactgctcagttaggacccagacggaaccatggaagccccagcgcagcttctcttcctcctgctactcgtggctcccagatgtcacgtggaagaaatagtgatgacgcagtcnccagccaccctgtctgtcgtctccgaggggaaagcgcccaccctctcctggcgacggccagtcgagtacgtcttagccggacctaccgttacgccgttcggtaacccgaagaccgaacgtaaaacccggtcgggacccgtacgggacccttacccccggaacgggtccccttaccccgttacctaacgtttacctaggtttaaccgggtaacctaccgttaccccgaacccggtaccggggttcctaaccggttcggggttaccgtttacccgacggtaccccggttacgggttaccggtaacgggttcggggaccggttaacgggggtttaccggggggtacccgggggtaacttaacggggttaccggtttaccgtaacccgtttcccgtacccgtaacccgttaacgttcccgtaagggtacccgaaccggtcccggttaccgtaccggttacggttacccgtagggtttaaacggtttaacgttttttcccggaaacggtttttaaccgttttttaaccggtttttaaaccgtttacccggggttaacccgtttaaaaccccttaaagtttttaaaccgttttaaaaaccggtttaaccggttttacccgggtcccccgttttacccggggttacgggtttaccgggttaaccccggggttttcccggggaaaccccggttaaaaccgggggtaaacccgggttaaacgggtttaaccggggtaaaaccggttaacccggaaaaacgggttaaccccggtttaacggggtaccgggttaacccgtttacggtaacccgggtaaccctttaagtttcccggtttaccgtttacccgttttacccggtaaccccgg

SEQ ID NO: 235824 - DNA, 902 bp, Homo sapiens
  misc_feature: GYAE6OF02GSKW0.41.42.D09.1.454.CMB.1.raw
tcagtctatactatcacgaccggtgctcgatttagacacatacgcagggaagggggaggaactgctcagttaggacccagacggaaccatggaagccccagcgcagcttctcttcctcctgctactctggctcccagatgtcagtggagaaataggtgatcgacgctacgtcctccagccctacctgtctgtcgtacctccggaaggggaaacacgccctacccttcctcctaggaccgacgggccctagtaccgaaggtacgttccgttaggcccggactaccctttaacggcccgttccggtaaccaacgaaccgaaacggtaaacccgtcggacccaacgggtacccctaccccggaggtccccttaccctccttactacgttaccgttacgtacctacccgtacccgtaaccgtacgggtaccttccgggtaccggttaccgttacccgaccggtacccggtaacgggtttcgggacgtacggggtcggtaacggggtaccggggtaccgaacgtaggttacccgttactacttcccgtaaccaccgtacgttaccgacgaccgtaacgtcccgtaggccgtaacggttacccggttaagtaacggtttacggttttaccgtaaggttttaacttttacggttacgttaaccttaaccccggttaactttaaactttaaccgggtttaaacttaaccgggtttcccgacccccggtttaggggttacccgggttaccgggttaacccggtaacccggggtaacccggtaaagggggaaccccggttaagggttaaccgggtaaaccggtaaccgtaaaacgggtaccggttacggggaccggttccgtaaccgtaccctaaccgtacggtttcccttagtttacccctcgttaacccg

SEQ ID NO: 235825 - DNA, 751 bp, Homo sapiens
  misc_feature: GYAE6OF02GEGTO.41.42.D09.1.454.CMB.1.raw
  modified_base (112)..(112): a, c, t, g, unknown or other
  misc_feature (112)..(112): n is a, c, g, or t
  modified_base (202)..(202): a, c, t, g, unknown or other
  misc_feature (202)..(202): n is a, c, g, or t
  modified_base (388)..(388): a, c, t, g, unknown or other
  misc_feature (388)..(388): n is a, c, g, or t
tcagtctatactatcacgaccggtgctcgatttagacacatacgcaggggaaagggggaggaactgctcagttaggacccagacggaaccatggaagccccagcgcagctcncttcctctgctactctggctccagatgtcacgtggagaatagtgatcgacgcagtcctccagcctacctgtctgtgtctccgagggaaancgccacccttcgtctcgacgagggtccaggtcgacgtacgtaccgttacggcggtaccaacccgtttagccgtacggtaccgacgtacaacggtaaaccgtggaccaacggtcccgtacccgagggtcctaccgtactacgtactagtcggtacactccgaacgtggtcctaacgtggtcgtaccncgtacgtcggttagacggtcggtctaagggtccggggtaaccgtcgaaagttcgttaccgaaccgttgaacccaaccttgtacgacgtacgacgtaccgtacggtactaacgtcgtaacgtaaggttaacgtttcgtacgttaacgtttaacgttacgttacgtacctacccgttaactacgttaaagtttaacgtacgtacccgttaccgtacgggtaccgtttaacccgggtacgtaaccggtaaccgggtaacggtaaccggttaacggtaaaccttaacgggtaaacccgtaaacgttcggtaacggttacgttacgaccggtaacctaacgttcggttaaccgtacttacccggtaac

SEQ ID NO: 235826 - DNA, 531 bp, Homo sapiens
  misc_feature: GYAE6OF01C7ED7.10.12.B01.1.454.CMB.1.raw
tcagcatagtagtgcacgaccggtgctcgatttagtagtgtagattccgcgggggcctggggagcctagctgtgctgtgggtccaggaggcagaactctgggtgtctcaccatggcctggatccctctacttctcccctcctcactctctgcacagggtccgaggcctcctatgagctgacacagccaccctcggtgtcagtgtccccaggacagacggccaggatcacctgctctggagatgctttgccgaagcaatatgcttactgtacatcagagccaggccaggccctgtggaacttgtatataaggacactgacgacggccccagggactcccgtgagcgattctctggcctccagctcgagggacaagagtgacgttgaccatcgagcggagcccgggcaggaggacgaggctagactattactgtacaatcaacaagactattacgtggttacttaggttgggttgttcgggaggtagggtccaaggtcgtacggtaccgttacgtaggcacggccctaacggg

SEQ ID NO: 235827 - DNA, 504 bp, Homo sapiens
  misc_feature: GYAE6OF01E5S2A.10.12.B01.1.454.CMB.1.raw
  modified_base (405)..(405): a, c, t, g, unknown or other
  misc_feature (405)..(405): n is a, c, g, or t
  modified_base (467)..(467): a, c, t, g, unknown or other
  misc_feature (467)..(467): n is a, c, g, or t
tcagcatagtagtgcacgaccggtgctcgatttagtagtgtagattccgcgggggcctggggagcctagctgtgctgtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctggagatgctttgccgaagcaatatgcttactggtaccatcagaagccaggccaggcccctgtggaacttgtatataaggacactgagaggcccccagggactccctgagcgattctctggctccagctcagggacaacagtgacgttgaccatcagcggagcccgggnagaggacgaggctgactatactgtcaatcacaagacatactggtacttagtgggtgttcggnggagggtccaagctagccgtacaggtcagcccaacgg

SEQ ID NO: 235828 - DNA, 686 bp, Homo sapiens
  misc_feature: GYAE6OF01CI5ES.10.12.B01.1.454.CMB.1.raw
  modified_base (179)..(179): a, c, t, g, unknown or other
  misc_feature (179)..(179): n is a, c, g, or t
  modified_base (257)..(257): a, c, t, g, unknown or other
  misc_feature (257)..(257): n is a, c, g, or t
  modified_base (265)..(265): a, c, t, g, unknown or other
  misc_feature (265)..(265): n is a, c, g, or t
  modified_base (286)..(286): a, c, t, g, unknown or other
  misc_feature (286)..(286): n is a, c, g, or t
  modified_base (310)..(310): a, c, t, g, unknown or other
  misc_feature (310)..(310): n is a, c, g, or t
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgcttcttttaagnggtgtccagtgtcaggtgcaggttggaggatcgtgggggagcgtggtccaggccgagggagtccctgagactctctgngcagcctntggattggagttcaataactntgactagtcgctacgtgggtcccncgagggcctaccgaaggggaagggctaggaagtgggatggaactaggtttattacacgacggtatacgaccaaaacaaaactactaacgtacggacggtagtttcggagggacggggcctcgtacgctacgtcccgttacctaccgtaaggaacgtaaccgtaacgttaaccgaaacggtaaacctaccgttacgtaacgttaacccgtagtaaaccaaaagttacgaaaccgtacgttacgtacggaagaccggaccggaaacggaccgtaacccgggtcccgtttacgttacgtttttacggacggtccggtaaacgtaaacgggtacgggtacggggtaacgacggttaaggttaaggggggtctttacgggg

SEQ ID NO: 235829 - DNA, 755 bp, Homo sapiens
  misc_feature: GYAE6OF01CW649.10.12.B01.1.454.CMB.1.raw
tcagcatagtagtgcacgaccggtgctcgatttagtagtgtagattccgcgggggcctggggagcctagctgtgctgtgggtccaggaggcagaactctgggtgtctcaccatggcctggatccctctacttcctcccctcctcactctctgcacagggtccgagcctcctatgagctgacacacgccaccgtcggtgtcagtcgtccccaggacaggaccggcaggatcacctgctcgtggagtatcgtctttcgaccgaagctaatatgtacttactggtaccatacagaacgccgacggtaccgacggtacccgtggtacggtaacttacgtaataacgtaaacggactacgtaggaacggaccggaccccgaaggtacctacccgtaggacgtacggtacttcgtccgttacggtcctaccgacggtaccgttaccgaacgggtaaccaaacggtacggtacggttaaccggtttacggaacccgtaacgtaccggaacgggacccgggtaaccgggaccccggggaacgaaacgggaaccgggaacggtacgggtaccgtacggtaaccgtttaacgttacgtacgtaccgtaaagtaccaaactaaacggtaacttaacgtttacggttacggttaacgtttacggttacggggttacggtttcgggaacgggttacgggttaccgtaaacggtccggttaccggtacccggttacgtaacggtaccgtaccggtaacccggtaccggg

SEQ ID NO: 235830 - DNA, 568 bp, Homo sapiens
  misc_feature: GYAE6OF01BOTXA.10.12.B01.1.454.CMB.1.raw
tcagcatagtagtgcacgaccggtgctcgatttagtagtgtagattccgcgggggcctggggagcctagctgtgctgtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctggagatgctttgccgaagcaatatgcttactggtaccagcagaagccaggccacggcccctggtggaacttgtatagtaaggacactgaggacggcccccgagggactccctggacgcgattctctggctccagctcgagggacaacagtgacgttgacatcaggcggacggcccggggcaggacggacgacggctcgacttagttactggtacaatcaacgaacgactattaacgttggttactttagttggggttggttcgggtcgggtacgggtccgaaggtcgtcggtacccggttaccgttaacgggtcgtacggcccgtaacggg

SEQ ID NO: 235831 - DNA, 795 bp, Homo sapiens
  misc_feature: GYAE6OF01AOW2O.10.12.B01.1.454.CMB.1.raw
  modified_base (455)..(455): a, c, t, g, unknown or other
  misc_feature (455)..(455): n is a, c, g, or t
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgctcttttaagaggtgtccagtgtcaggtgcagttggaggaatcgtgggggagcgtggtccaggccaggggacgtccctgagacctctccgtgtgcacgtcctctggatttggaggtttacaaataactatcgctatgccacgttcggggtcccgccgaggtccgtaccggaagggggaagggcctagggaagtgggaatggaactagtttacttacgaacgacgaatcggaaccaaaaccaaaacagttaaccgtacggacgggtaagtttccgggagggacggggtcccncgtacggactacgttccggtcctaccggaaggtacgtaaacctaaagttaccgggaaaaccgtaacctaccgttcgtacgttaacccgtaggaacctaaaagttcggaaaaccgttacggttccgtaacgggtaacgggacccggtaacccgggaacgggtaaacccccggtaccggggttcccccgttttaaacgttttaacccggtttttcggggtacggaacccggttaaacggttaaggggtaaaccgggggttcggggttaaacggttaacccggggtttaagggtttaacggggggtttactttttaaccggggacgggttttacccccggggg

SEQ ID NO: 235832 - DNA, 742 bp, Homo sapiens
  misc_feature: GYAE6OF01BD12G.10.12.B01.1.454.CMB.1.raw
  modified_base (130)..(130): a, c, t, g, unknown or other
  misc_feature (130)..(130): n is a, c, g, or t
  modified_base (156)..(156): a, c, t, g, unknown or other
  misc_feature (156)..(156): n is a, c, g, or t
  modified_base (170)..(170): a, c, t, g, unknown or other
  misc_feature (170)..(170): n is a, c, g, or t
  modified_base (179)..(179): a, c, t, g, unknown or other
  misc_feature (179)..(179): n is a, c, g, or t
  modified_base (181)..(181): a, c, t, g, unknown or other
  misc_feature (181)..(181): n is a, c, g, or t
  modified_base (185)..(185): a, c, t, g, unknown or other
  misc_feature (185)..(185): n is a, c, g, or t
  modified_base (202)..(202): a, c, t, g, unknown or other
  misc_feature (202)..(202): n is a, c, g, or t
  modified_base (219)..(219): a, c, t, g, unknown or other
  misc_feature (219)..(219): n is a, c, g, or t
  modified_base (429)..(429): a, c, t, g, unknown or other
  misc_feature (429)..(429): n is a, c, g, or t
  modified_base (481)..(481): a, c, t, g, unknown or other
  misc_feature (481)..(481): n is a, c, g, or t
tcagcatagtagtgcacgaccggtgctcgatttagtagtgtagattccgcggggctgggagacgagcccagcactggaagtcgccggtgtttccattcggtgatcatcaactgaacacagaggactcacntgggagttgggctgagcgtggtttcncgtgctctttaagngtgtcagtncnggtncgtagttggaggatcgngggggactcgtcggacnggtccgagggtctaccgtgacggccttctccgtgtaccgacgtacgtccgtacgtagggtaactttcggaaggttttaccaaaacggttctacgtgaccgttagtcgaaccgtacggttcgggcccactgggtcctaacggaggggttaacgcttaggaagtgagttcggaactgtttacgacacggtactggtaaccacgttaaaacgntcgtaaacgccggttagggtaacttcggaaggtcccggtcgcgtcggtaacnccgttagtcctaacgtagaaccgttacgtaacgtaccgaacggtaactaccttaccggtagttacccgaggaaccctaacggttccgaaaacgtcggttttaaccggaacgaccggtacgggtaaccctaacggggcccttaacgggtcccgttaaaccggttttccgtttacggacccggttaggaacccggtttaaggaccggtacgggtaaagttcggaacggggtttagggttacttacccgggtaccgttcggggg

SEQ ID NO: 235833 - DNA, 826 bp, Homo sapiens
  misc_feature: GYAE6OF01DGNVX.10.12.B01.1.454.CMB.1.raw
  modified_base (157)..(157): a, c, t, g, unknown or other
  misc_feature (157)..(157): n is a, c, g, or t
  modified_base (164)..(164): a, c, t, g, unknown or other
  misc_feature (164)..(164): n is a, c, g, or t
  modified_base (171)..(171): a, c, t, g, unknown or other
  misc_feature (171)..(171): n is a, c, g, or t
  modified_base (175)..(175): a, c, t, g, unknown or other
  misc_feature (175)..(175): n is a, c, g, or t
  modified_base (188)..(188): a, c, t, g, unknown or other
  misc_feature (188)..(188): n is a, c, g, or t
  modified_base (209)..(209): a, c, t, g, unknown or other
  misc_feature (209)..(209): n is a, c, g, or t
tcagcatagtagtgcacgaccggtgctcgatttagtagtgtagattccgcggggctgggagacgagcccagcactggaagtcgccggtgtttccattcggtgatcatcactgaacacagaggactcaccatggagttgggctgagctgggttttccngttgctntttaagnggtntcagtgtcaggtncagttggagatcgtggggagngtgccagccgaggggacgtccctgacgtcctctccgtggtcgccgacgtcccttcgtaggtaagttggtaaggttaacaaagttactagtcgacttagcgactacggttcgggtccaccgtaggtcctaccggaagggggtacgggctagggtaagtcggatacggacttagtttaacttccgacgtaacgctaacggaaccctaaaactaaaaccgtcttaaccggtaacggtcgggttaacggtttcgggagggtaacccggggtcctacggtactacccgtaacggtttccggtaccgtaccgaagggtaaccgttaaaccttaacggttaacccggaaaacgtaaccccgtaccgtttaccggttaaccgttacccgtaaaggtaacccgttaaaacggtacggttaaacccgaagggtttaccgtaaggggaaccgtaaccgggtaacccgggacggtaacccggtacccgggttacccctttaaggtttttaacggttcgggtaacccgtaacgggttaacgttaaacggggtaacggggttacgggaaccgtttacggtttaaaggggttagggttttaacgttcggttaacccggggtttacccggggg

SEQ ID NO: 235834 - DNA, 887 bp, Homo sapiens
  misc_feature: GYAE6OF01C07OV.10.12.B01.1.454.CMB.1.raw
tcagcatagtagtgcacgaccggtgctcgatttagtagtgtagattccgcggggctgggagacgagcccagcactggaagtcgccggtgtttccattcggtgatcatcactgaacacagaggactcacatgggaggttggggctgagtcgttgggtttttcctcgttgcttcttttaaggaggtgtccagtgtcaggtgctaggtggaggatcggtgggggagtcgtggtccaggccgaaggggtcgtccctaggacgtaccttccttccgtggtcgccaacgtcccttcgtaggtaatttggaacggtttactaaaacttaaacttagtgtctagtcgtacacggttccggggtcccgaccgtacgggtacctaccggggaaaggggggtaagggggtcgtaaggggtaacggtaggggtaacgttcggtaaaccgtttaaggttttaacgtttaccgaaaccgtaacggtaacgttaccggaaaaccaaaaacccgtaaaaacaaccgttaaaccggtaccgggtacgggtagggtttaccgggtcggggaaccggggtcccgtcgtacgggtactaccggttaccgtacccgttacgaaaggtaaccgtaaacttaacggttacgaaaacgtaacctaaccgttacgtaaccggttacgtaacgtaactaaaacggtaacgaacgtacggttcgtaaagggaacggtaccggaaccggggtaacggaacccgggttacccggttacccggtttccgttttaggttacccggtagggttacccggtaaacgggttaaagggtaacgggggttaacgggacgttaaacggttaaacgggggtttaggggtttaaaccgtttggggttacccgttaccccggggggg

SEQ ID NO: 235835 - DNA, 767 bp, Homo sapiens
  misc_feature: GYAE6OF01D21FC.10.12.B01.1.454.CMB.1.raw
  modified_base (193)..(193): a, c, t, g, unknown or other
  misc_feature (193)..(193): n is a, c, g, or t
tcagcatagtagtgcacgaccggtgctcgatttagtagtgtagattccgcggggagctctgggagacgagcccagcactggaagtcgccggtgtttccattcggtgatcatcactgaacacagaggactcaccagtggagttggggctgagtcgttgggttttcctcgttgcttacgttttaagaggtgtccngtgtcgaggtgcaggttggaggtaagtcggtgggggagcggtggtccaggccgagggacgtccctgacgtactctccgtgtagcgagccctgtggtagttggtacgttactaaattaccgtatcgtctagtcgccgtacggttccgggacccgccgaggcccgtacgggaaggggtacgggcgtaaggtagtacgagtcgtaacgttacgtttacttacgaaccagtacgtaacgaaacctaaaacctaaactacgtaaccggtaccggacgggttacgtttcggggacgggtaccgggccgtcgtacggtcctaacggttcccgtaccgtaaccgaaaggtaaccgttaacgtaacgttaacccggaaaataacccgtacttacggtacccgttaccgacgaaaccgtaagtaacacgtagttaacgaggaacgtaccggacggtaaaccggtaacccgggtccgtttaaccggttaccgttttacggtttacggacggtaaccgggtaaacgttaaggggtaacgttacggggtaacgtagtttaacggggttaacgggttgttaacccggg

SEQ ID NO: 235836 - DNA, 725 bp, Homo sapiens
  misc_feature: GYAE6OF01CHTX7.10.12.B01.1.454.CMB.1.raw
  modified_base (183)..(183): a, c, t, g, unknown or other
  misc_feature (183)..(183): n is a, c, g, or t
  modified_base (657)..(657): a, c, t, g, unknown or other
  misc_feature (657)..(657): n is a, c, g, or t
  modified_base (673)..(673): a, c, t, g, unknown or other
  misc_feature (673)..(673): n is a, c, g, or t
tcagcatagtagtgcacgaccggtgctcgatttagtagtgtagattccgcggggctgggagacgagcccagcactggaagtcgccggtgtttccattcggtgatcatcactgaacacagaggactcaccatgggagttggggctgagtcgttgggttttccctcgttgtcttacttttaaggnggtgtccagtgtcaggtgcaggttggaaggtaatcggtgggggagcgtggtccgagccgaggggacgtcctgacgtacttctccgtgtcgcacgtcctgtggacttggaggttacaaattaacttatcgacttatcgaccgtacggtccggggtccccgacgacggtcccgtaccgggaaaggggggtaacgggtcgttaagggaacggtaggtagtagaaccgttaaggttttacttaccaacgtaaacgagtacccgaaaccaaaaacctaaactactaccggtaacggacgggttagtttaccggagggtaccggggctacgtcggtactacgttcgtacctaccggaagtaacggaactaacgttaccgaaaagtccctacgttacgtaacgttacccgtaagaactaaaggtcaaaacgtcgtaacgtacgaaggccgaaccgggacgaccgtacggtccttacgtttnttacgggctacggtanaagggtgtagggacgttacgtagggtagggttcttagggtccgttccggggg

SEQ ID NO: 235837 - DNA, 816 bp, Homo sapiens
  misc_feature: GYAE6OF01EM1KW.10.12.B01.1.454.CMB.1.raw
tcagcatagtagtgcacgaccggtgctcgatttagtagtgtagattccgcgggggcctggggagcctagctgtgctgtgggtccaggaggcagaactctgggtgtctcaccatggcctggactccctctacttcctccccctcctcactctctgcacgagggtccgaggccctcctatgagctacgacacacgcccacccgtcggtcgtcacggtccgtaccccgaaggacgacggaccggaccgaaggacttaccaccgttcgccgttcgtagggagtacgttcgtccgttttacggaccggaaacgactaaattagtacgtacctttacgtacggtaaccgagacgaacggaacgaccgacgggacccgaccgggaccccgtaggttacggtaacgttacggtaagtaacgtaaacggaacacgtacggacggaaccggccccggtaacgggaccgtaccgtaggacgacgtacttcgtcgtcgtccgtaccacgtaccgtacggaacggtaaccaacggtacgttacggtaaccggttacggaacccgtacgtaccggaacgggaccgggtaacccgggacccgggacggtaacgggaaccgggaacgggtaccgggacggttacggtaacgtttaacgttaaccgttacgtaacgtaactaaccgaaagtaacgtaaccttaacgttaacgttacggttaacgtttacggtttacggggttacggttacggggtacgggttacgggtaccgtaccggtacgttaccggtaccggttaccggtacggttaccgaaccggtccggtaacccggg

SEQ ID NO: 235838 - DNA, 846 bp, Homo sapiens
  misc_feature: GYAE6OF01CTH8G.10.12.B01.1.454.CMB.1.raw
tcagcatagtagtgcacgaccggtgctcgatttagtagtgtagattccgcgggggcctggggagcctagctgtgctgtgggtccaggaggcagaactctgggtgtctcacagtcggcctggactcctctacttcctccccctcctcactctctcgcacgacggtccgacggtcctcctagtgacgctacgacacgacgcccacccgtcggtgtcacggttccgacccgaaggacgacggaccggaccgaaggacttaccgaccttggccttaccgaggaagtacgttacggttccgtttacggaaccggtaaacgtacgtaaacgttaacgtcgttacccgttaacgtaccggtaaccgacgtaacgaacggaaccgaccgacggtacccgaccggtcccgttaggttaagtaaccgtttagtaacgttaaagtaaacgacctacggtacggaaccggtaccggtaccccggtaacgggtacctaccgtaggtaacgtaccgttacttccgttcggtaccggtaccgtaccgtacggtaaccggacggaaacccggtaaccgaaacgtcggttaacggtaaccgttacgtaacccgtagtaaccggcgggaccggaacgggacccggaacggaacgggaacgggtacgtaacggtccgtttaacgtaccgttaacgttacgtacggtaacgtaaacctacggtaaactaaacggtacgttaaccgttaacggtttacgttacggtttaccggttagggttaccggttaccggggacggttaacggtacccgttaggtacccgttaccggtacgttacccgtaggaccgttcccggaccgttaccgg

SEQ ID NO: 235839 - DNA, 844 bp, Homo sapiens
  misc_feature: GYAE6OF01BNJS2.10.12.B01.1.454.CMB.1.raw
tcagcatagtagtgcacgaccggtgctcgatttagtagtgtagattccgcggggctgggagacgagcccagcacgtggaagtcgccggtgtttccattcggtgatcatcactgaacacagaggactcacatggagttgggctggagtcgttgggttttcctcgttgtcttacgttttaaggacggttgtccgaggttgtacgagggttcgcgtaggttgggaaggtaacgtcgggtaggggggagtccggtacggtaccgaggtaccggtaggggtaccggtcccgtaggacgtaccttccgtccgttagtcggacacgtccttaggtaggtagttggtaacggtttaacgaaaacttaaaccgtagtcggtacttagtacggacctaaccggttcgggggtacccaccggtacggtaccgtaccgggaaggggtacgggacgttaaggaagtcgggacttaaggtaacgttaggtttacctacgaacgagtactacggaacctaaaaaccgtaaaagtccgtaaaccgtcggggaaccgggtttaggtttaccggggaggggtaacccgggggttccgtaacgtccgggtacgttaaccgttacccgtaccgtaacggaaacgtaacggtaaactaaacggttacgaaaccgttaaacgtaccgttacgtaccggtaaccctaaggtaaccgtaacgtaacggtaacgtacgttacggacggaaacggtacggacggtaacccggacgtaaccgggtccttacgttaacgttcggcgtaacgtacggtaaggtacggtagggaacttcggtaagggtaggttacgttcggaggttacccgggg

SEQ ID NO: 235840 - DNA, 670 bp, Homo sapiens
  misc_feature: GYAE6OF01CQEYH.10.12.B01.1.454.CMB.1.raw
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (311)..(311): a, c, t, g, unknown or other
  misc_feature (311)..(311): n is a, c, g, or t
  modified_base (555)..(555): a, c, t, g, unknown or other
  misc_feature (555)..(555): n is a, c, g, or t
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggtttttcctcgttgtcttcgttttaagaggtgtccagtgtcaggtgcgaggttggaggagtcggtgggggagcgtggtccagccgagggacgtccctgacgctctctgngcngcctntggattgagttanaatactagtgactatgctacgtcgggtccnccgacggccgtaccggagggggaacgggtgtagggtaagttggagtcggtaactaagtttacttacacgaacgagtacgaacaaaaccaaaactactacgtacggtacggtaggtttcggacgggaccggggctacgtcgcgtaccgttccgtaccgtacctaaggaactaaccgtaaagttacgaaaccgtactacgttacctccgttaaccgagaaacctaataacggaatacgtgtacggngaaccgacggacgaccgtccggtacgttactttacggtttggacgtacgtaacggtaggtaaggtgggtagtacggttaagggttaagggtcgtttacggtcgtttacccggggg

SEQ ID NO: 235841 - DNA, 863 bp, Homo sapiens
  misc_feature: GYAE6OF01DPLA2.10.12.B01.1.454.CMB.1.raw
tcagcatagtagtgcacgaccggtgctcgatttagtagtgtagattccgcggggagctctgggagacgagcccagcactggaagtcgccggtgtttccattcggtgatcatcactgaacacagagactcaccatggagttgggctgagtcgttggttttcctcgttagtcttcttttaagaggttcgtaccaggttgtacgaggtgacgtaggtttaggacggtaattcggtgggggaggtccgttggtccaaggtcccgtaggggtacgtcccgtaggacgtaccttcgtacctggtcgacgtacgtcccgttgtaggtacttggtaagttactaaacgttaactagttcgaccttaagtcgtacctacgtcggggtaccaccgaggtccgtaccggagggtaaacgggtctaggtaagtggaacgtgaacgttagtttacgttacaaccgtacggataccgaaacctaaaaccgtaaaacgtctttaaaccgtacggtaccgggttacgttaccgggttacgggaaccggggtacccctacgttaacggtaccgttaaccgttaccggtttacccgtaaacccgtaaagggtaaccggtaaaccgttaacggtttaaacccggaaacggtaaaccctaacccgtttccgtaaccggtttaaccgaacggtaaaccttaaacgtaccggtaaacgtacgggtttaccaacgggtaaccgccggaaaccgggttaccggaacccgtacccggttaccgtttaccgtttaaacgttttcgggaaccggttaacgggtaaaccgttagggaaacggttaccgggacgtttagttaaaccggggttgggttaacgtttaacccggg

SEQ ID NO: 235842 - DNA, 712 bp, Homo sapiens
  misc_feature: GYAE6OF01BKCLW.10.12.B01.1.454.CMB.1.raw
tcagcatagtagtgcacgaccggtgctcgatttagtagtgtagattccgcgggggcctgggggagcctagctgtgctgtgggtccaggaggcagaactctgggtgtctcaccatcggcctggactccctctacttcctccccctctcactctctgcacgagggtccgaggcctctatgagctgacacacgccctaccgtcggtgtcacgtcgtcccaggacagacggcaggctcactgctctggagatcgtcttggaccgaagactaaatatagtaccttactacggtaactactacgaacgaacgaccgacggaccgacggtccccgtaggtacgtacttagtaataacgtaaaggactacgtacggaacgaccggaccccgaaggtacctccgtaggacgtcgtacttccgtcgtacggtcccgtacgacggtaccgtaacgggaacggaacgtaacgtacggtacggttaaccgtacgaaccgtaacgtacggacggacccgggaccgggacccgggacgaacgggaacgggtacggacgacgttaacgtaacttacgtacgttaacgactaaacgacctaacgaacgtaacgttacgttaacgttacggttacgtttagggttacgggtcgggttacgggcgggtaacgggtcctaacgggtcggtaaccgtaccggtacgttacgggacctaccggtacctaaccgg

SEQ ID NO: 235843 - DNA, 506 bp, Homo sapiens
  misc_feature: GYAE6OF02GQI38.10.12.B01.1.454.CMB.1.raw
  modified_base (404)..(404): a, c, t, g, unknown or other
  misc_feature (404)..(404): n is a, c, g, or t
tcagcatagtagtgcacgaccggtgctcgatttagtagtgtagattccgcgggggcctggggagcctagctgtgctgtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctggagatgctttgccgaagcaatatgcttactggtaccagcagaagccaggccaggcccctgtggaacttgtatataaggacactgagaggcccccagggatccctgagcgattctctggctccagctcagggacaacagtgacgttgaccatcagcggagcccgggnaggaggacgaggctgactattactgtcaatcacaagacattactgtacttattgggtgttcggcggtagggtccaagctgaccgtcctaggtcagcccaagg

SEQ ID NO: 235844 - DNA, 584 bp, Homo sapiens
  misc_feature: GYAE6OF02HBFP0.10.12.B01.1.454.CMB.1.raw
  modified_base (303)..(303): a, c, t, g, unknown or other
  misc_feature (303)..(303): n is a, c, g, or t
  modified_base (363)..(363): a, c, t, g, unknown or other
  misc_feature (363)..(363): n is a, c, g, or t
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccagggagtccctgagactctcctgtgcagcctctggattgaggttcaataactatgctatgcacgtgggtccnccaggctccgaggggagggctggaatggatgacagttattcacacgatcgacaaccaaantactacgcggtagttcgtaggacgggccgctgctatcgtctccgagacgacaagttacgaagaacactctacgtaccagacaaatagaacgtagtctaggacgtacggaccggaacggaccgaccgggtacccgttacgttaacggttttcggtacggtcgtaacgttaaggtaagggttacggggacggtaccgtttaagggtacggggttatttacggg

SEQ ID NO: 235845 - DNA, 541 bp, Homo sapiens
  misc_feature: GYAE6OF02FG5FW.10.12.B01.1.454.CMB.1.raw
  modified_base (301)..(301): a, c, t, g, unknown or other
  misc_feature (301)..(301): n is a, c, g, or t
  modified_base (368)..(368): a, c, t, g, unknown or other
  misc_feature (368)..(368): n is a, c, g, or t
  modified_base (388)..(388): a, c, t, g, unknown or other
  misc_feature (388)..(388): n is a, c, g, or t
  modified_base (397)..(397): a, c, t, g, unknown or other
  misc_feature (397)..(397): n is a, c, g, or t
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggaggcgtggtcccagccaggggaggtcccctgagactctcctgtgcagcctctggattgaggttcaatactatgctatgcactgggtccnccaggcctccgaggggaaggggctggaatggatgacagtttattcacacgatgaccaaaccaaaacntaactacgcggtagttcggngaggggccnctgcatcgtctccgagacgacaattccgaaagaacactctgtacctgacaaatgaacagtctgagagccgaaggcaccggtccgttctacttttggcgcgacgtaggtagtgggagtcgtagtaggggtactttggacttccgg

SEQ ID NO: 235846 - DNA, 568 bp, Homo sapiens
  misc_feature: GYAE6OF02J2KAY.10.12.B01.1.454.CMB.1.raw
  modified_base (354)..(354): a, c, t, g, unknown or other
  misc_feature (354)..(354): n is a, c, g, or t
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
  modified_base (428)..(428): a, c, t, g, unknown or other
  misc_feature (428)..(428): n is a, c, g, or t
  modified_base (554)..(554): a, c, t, g, unknown or other
  misc_feature (554)..(554): n is a, c, g, or t
tcagcatagtagtgcacgaccggtgctcgatttagtagtgtagattccgcggggccgtggggagcctagctgtgctgtgggtccaggaggcagaactctgggtgtctcaccatggcctggatccctctacttctcccctcctcactctctgcacagggtccgaggcctcctatgagctgacacagccaccctcggtgtcagtcgtccccaggacagacggccaggtactcacctgcctctggagatgctttgccgaagcaatatgcttactggtaccagcaagaagccaggccacggcccctggtcggaacttggtaatagtaaggacacgtgagacggaccccaggactccgngacgcgattctcgnggcctcngctagagggacaactgcgtacgttcgaaccatccgaggcgggacgcccggganacgggacgacgtagggacctggaacttattacgtcgtacaactcaactaacgacttagtacttgtaacttagttgggtcgtcgggacggtaggtacccagtcctcggtaaccctcgtaggtacccncggaccctaacggg

SEQ ID NO: 235847 - DNA, 543 bp, Homo sapiens
  misc_feature: GYAE6OF02ITAMJ.10.12.B01.1.454.CMB.1.raw
  modified_base (236)..(236): a, c, t, g, unknown or other
  misc_feature (236)..(236): n is a, c, g, or t
  modified_base (243)..(243): a, c, t, g, unknown or other
  misc_feature (243)..(243): n is a, c, g, or t
  modified_base (310)..(310): a, c, t, g, unknown or other
  misc_feature (310)..(310): n is a, c, g, or t
  modified_base (348)..(348): a, c, t, g, unknown or other
  misc_feature (348)..(348): n is a, c, g, or t
  modified_base (369)..(369): a, c, t, g, unknown or other
  misc_feature (369)..(369): n is a, c, g, or t
  modified_base (389)..(389): a, c, t, g, unknown or other
  misc_feature (389)..(389): n is a, c, g, or t
  modified_base (399)..(399): a, c, t, g, unknown or other
  misc_feature (399)..(399): n is a, c, g, or t
  modified_base (409)..(409): a, c, t, g, unknown or other
  misc_feature (409)..(409): n is a, c, g, or t
  modified_base (418)..(418): a, c, t, g, unknown or other
  misc_feature (418)..(418): n is a, c, g, or t
  modified_base (428)..(428): a, c, t, g, unknown or other
  misc_feature (428)..(428): n is a, c, g, or t
  modified_base (445)..(445): a, c, t, g, unknown or other
  misc_feature (445)..(445): n is a, c, g, or t
  modified_base (464)..(464): a, c, t, g, unknown or other
  misc_feature (464)..(464): n is a, c, g, or t
  modified_base (476)..(476): a, c, t, g, unknown or other
  misc_feature (476)..(476): n is a, c, g, or t
  modified_base (485)..(485): a, c, t, g, unknown or other
  misc_feature (485)..(485): n is a, c, g, or t
  modified_base (497)..(497): a, c, t, g, unknown or other
  misc_feature (497)..(497): n is a, c, g, or t
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctctttaagaggtgtccagtgtcaggtgcagttggaggaatcgtgggggagcgtggtccagccaagggnggtcccngagctctcctgtgacagcctgtggattgacggttcaatactatgctatgcactggccgaccaggccnccaggggagggctgggaatcggatgacagttattccanacgtatcgactaaaccgaaanagtactaacgcggaattcgnggacgggccntgcattcgcnccaggacanacttcgaaanaacactccgtgtacccnggacaacttgaaactcgtngaagtacgccgngttaaccgngaccccggtttnttcgttgcgagactaggacggtcggtactcgtaaggtaggtattcg

SEQ ID NO: 235848 - DNA, 706 bp, Homo sapiens
  misc_feature: GYAE6OF02H9PZD.10.12.B01.1.454.CMB.1.raw
tcagcatagtagtgcacgaccggtgctcgatttagtagtgtagattccgcggggctgggagacgagcccagcactggaagtcgccggtgtttccattcggtgatcatcactgaacacagaggactcaccatggagttgggctgagctgggttttcctcgttgctcttttaagaggtgtccagtgtcaggtgcagttggaggaatcgtgggggagcgtggtccagccgagggaggtccctgacgactctcctgtgcagcctctggattgaggttcaataactatgctatgcacgtgggtcccgcgaggcctccgaaggggaagggctaggaatggatgactaggtttattcaacacgatacgacctaaaaccaaaactactaacgtaacgacgggtaacggttcggtagggacggggtcccgtacgtacggacctacgttccgtctaccgaacggaacgtaaacgtaacgttaaccgaaacggtaactaccgttacgtacgttaacctacgaacctaaagttaacgaaaccgtacgtacgtacggaacggacggtaccgggaaacggtaacccgtaaccgggtacccttaccgtttaacgttttccggtacggtaccggtaacgttaagggtaaacgggttcggggtaacgtaccggttaaagggtttaacgggggttaacttttacgggtacgtttaccccggggg

SEQ ID NO: 235849 - DNA, 573 bp, Homo sapiens
  misc_feature: GYAE6OF02HD5B9.10.12.B01.1.454.CMB.1.raw
  modified_base (303)..(303): a, c, t, g, unknown or other
  misc_feature (303)..(303): n is a, c, g, or t
  modified_base (375)..(375): a, c, t, g, unknown or other
  misc_feature (375)..(375): n is a, c, g, or t
  modified_base (392)..(392): a, c, t, g, unknown or other
  misc_feature (392)..(392): n is a, c, g, or t
  modified_base (403)..(403): a, c, t, g, unknown or other
  misc_feature (403)..(403): n is a, c, g, or t
  modified_base (435)..(435): a, c, t, g, unknown or other
  misc_feature (435)..(435): n is a, c, g, or t
  modified_base (470)..(470): a, c, t, g, unknown or other
  misc_feature (470)..(470): n is a, c, g, or t
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggaggcgtggtccagccagggaggtccctgagactctcctgtgcagcctgtggattggagttcaataactatgctatgcacgtcggggtccnccgaggcctccggaagggggacgggctagggaatggatgactagtttattcacacgatcgacaaaccaaaantacacgcggtagttcgnggacggggccngtgctatcgtctacgagacaactaagtcgaanaacctacttcgtcgtacctagaccaatcgtaaacngtactaggagacgccggaaggaccgacggtccgtcttacgtttcggcgtacgtacgtaaggtaggtgggagtcgtaaggttagggtatttagtagttcccggg

SEQ ID NO: 235850 - DNA, 598 bp, Homo sapiens
  misc_feature: GYAE6OF02GRSSS.10.12.B01.1.454.CMB.1.raw
  modified_base (243)..(243): a, c, t, g, unknown or other
  misc_feature (243)..(243): n is a, c, g, or t
tcagcatagtagtgcacgaccggtgctcgatttagtagtgtagattccgcgggggcctggggagcctagctgtgctgtgggtccaggaggcagaactctgggtgtctcaccatggcctggatccctctacttctccccctcctcactctctgcacagggtccgaggcctcctatgagctgacacagccaccctcggtgtcagtgtccccaggacaggacggccaggactcacctgctctgganatgctttgccgaagcaatatgcttactggtaccagcagaagccaggccacggcccctgtcggaacttgtatataaggacactgagacggccccagggactcccgtgacgcgattctctcggctcccagctcgagggacaagagtcgacgttagacctatcacggcgggacggcccgggacgaggacggacggaggcgtagacttattacgtacgtcaagtccgaacgaagtactaagttaaccgttaggttaaccgttttagttcgggtttcggttccggggtacggtacgggggttaccaaggtccgttacggacccggttaccgtacgggttaccaccggaccccgtaacggg

SEQ ID NO: 235851 - DNA, 584 bp, Homo sapiens
  misc_feature: GYAE6OF02HVJF0.10.12.B01.1.454.CMB.1.raw
tcagcatagtagtgcacgaccggtgctcgatttagtagtgtagattccgcgggggcctggggagcctagctgtgctgtgggtccaggaggcagaactctgggtgtctcaccatggcctggatccctctacttctcccctcctcactctctgcacagggtccgaggcctcctatgagctgaccacagccaccctcggtgtcagtgtccccaggacagacggccaggatcacctgctctggagatgctttgccgaagcaatatgcttactggtacatcagaagccaggccaggcccctgtggaacttgtatataaggacactgagacggcccccagggactccctgacgcgattactcgtcggctccagctacgagggaacaacgagtcgacgttcgacgatcacgcggacggcccgggcgaggacgggaacgagggactgtactagttactcgtacaacgtacacgaaagtacgtaattaacgttaggtactttacgtttgggttacggtttacgggcgggtaacggggtccaacggtcgtacggtaccggttaccgtacgggtacctacggacccgtaaccggg

SEQ ID NO: 235852 - DNA, 617 bp, Homo sapiens
  misc_feature: GYAE6OF02JCH3W.10.12.B01.1.454.CMB.1.raw
tcagcatagtagtgcacgaccggtgctcgatttagtagtgtagattccgcgggggcctggggagcctagctgtgctgtgggtccaggaggcagaactctgggtgtctcaccatggcctggatccctctacttctccccctctcactctctgcacagggtccgaggcctcctatgagctgacacagccaccctcggtgtcagtcgtccccaggacagacggccaggatcacctgctctggagatgctttgccgaagcaatatgcttactggtaccagcagaacgccgaggccacggcccctgtcggacttgtatataaggacacgtgacgacggccccgaggtactcccgtaggacgcgtacgttctacgtggtctccgagctacgaacgggacaacgacggtacgtacggttacggaacctacgtcgacggtacgggacggacccgggtacgaagggaacgggacggagggtcgtacggtacgttaacttacgtagttacaacgtaccgaacaacgtactaatttaccgtaggttactttacgtgggttcggttacgggcgggtaggtccgtaacgtccgttacggacccgtcgtacggtcgtacgacccgtaacgg

SEQ ID NO: 235853 - DNA, 680 bp, Homo sapiens
  misc_feature: GYAE6OF02F3ZI4.10.12.B01.1.454.CMB.1.raw
  modified_base (382)..(382): a, c, t, g, unknown or other
  misc_feature (382)..(382): n is a, c, g, or t
tcagcatagtagtgcacgaccggtgctcgatttagtagtgtagattccgcgggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccaggggagtccctgagactctcctgtgcagcctcgtggattggaggttacaataactatgctatgctacgtgggtccgcaggcctccggaggggacgggctgggaagtggatgaactagtttattcacacgtatacgaccaaaccaaaacnctaaccgtacgggcggtaacggtttcggacggacggggtaccgcgtagacctacgttcgtccgtaccgtaacggaacgtaacctaaacgtttacgaaagtaacctacgttctacgttaccgtagaaacctaagtacgaaactacgtaccgtagtaacgaccggtaccggaacggaacccgtaccgggtacccggtttaccgtttaacggttttcggtacggtaccggttaacgtaacgggtaacgggttacggggtaacggttaccggttaaggggttacggggttaacgtttacggg

SEQ ID NO: 235854 - DNA, 581 bp, Homo sapiens
  misc_feature: GYAE6OF02GE7Q1.10.12.B01.1.454.CMB.1.raw
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggagcgtggtccagccagggagtccctgagactctcctgtgcagcctctggattgaggttcaagtactatgctatgcacgtgggtccgcaggctccgaggggagggctggaatggatgactagttattcactacgatgaccaaccaaaacactaactacgcgtagttcgtggacgggcgctgcactcgtcctccgagaacgactaacgtacgaaagaactacgtactcgtaacctcgacaaatagaacagtcgtagacgacgaccggacgacgaccggtccgtacttacgtttcggtagtaccgtacgtaaggaaggttcgggaacgtccgttaaggtagggggtaacttttacggtacgtttacccgggg

SEQ ID NO: 235855 - DNA, 670 bp, Homo sapiens
  misc_feature: GYAE6OF02JX3EZ.10.12.B01.1.454.CMB.1.raw
  modified_base (345)..(345): a, c, t, g, unknown or other
  misc_feature (345)..(345): n is a, c, g, or t
  modified_base (409)..(409): a, c, t, g, unknown or other
  misc_feature (409)..(409): n is a, c, g, or t
  modified_base (422)..(422): a, c, t, g, unknown or other
  misc_feature (422)..(422): n is a, c, g, or t
tcagcatagtagtgcacgaccggtgctcgatttagtagtgtagattccgcgggcgtgggagacgagcccagcactggaagtcgccggtgtttccattcggtgatcatcactgaacacagagactcaccatggagttgggctgagctgggttttcctcgttgcttcttttaagaggtgtccagtgtcaagtgcaactggtggagtcgtgggggagcgtagtccagccgtgggaggtcacgagacgactcctcctgtcgcagcctcgttcgggttcacctttcaaggtacgctaccggcacgtgcgacgttcgggtcccacgaaacctccgaaggaccaaaggggtnttagggacggttgggtacggacgttagtttggttacagttccgtggaggggcctagtacggttnaaacgtcggttancggctaggacctcggtaggacgggtccgagtttaccacccgtactacctccgaacgacgaacctaaacgtaccgaacggtaacaacgtaactgtacgttacgtaccgtagtaaccacgtaccttaacgtccgttacgaacgtacggaacggttattacgtacgtacgtacggtaacggaagggtacggggaacgtaccggtacgggtacgttaccgaacgttacggtaccgtttacggaccgtacggg

SEQ ID NO: 235856 - DNA, 837 bp, Homo sapiens
  misc_feature: GYAE6OF02JFLTE.10.12.B01.1.454.CMB.1.raw
  modified_base (267)..(267): a, c, t, g, unknown or other
  misc_feature (267)..(267): n is a, c, g, or t
tcagcatagtagtgcacgaccggtgctcgatttagtagtgtagattccgcggggctgggagacgagcccagcactggaagtcgccggtgtttccattcggtgatcatcactgaacacagaggactcaccatggagttgggctgagctgggtttcctcgttgctcttttaagaggtgtccagtgtcaggtgcgagttggaggaatcgtgggggagcgtggtccaggccgagggacggtccctgacgacctcgtccgtgtcgaaaacgngtcctcgtggacttggaggtttcaaattaaccgtatcggtctaatcgccaacgttcgggttccccgccgaaggccgttaccggaagggggaacgggcctagggtaatgggatcggtaaccgtaggtttactttcccgaagtaccggtataccggtaaccaaaaacccgtaaaaacgtactttaaaccgaccggtaccggggttaaagtttcccggggtacgggaaccggggggccccttaccggtacgtaccgtaacgtttcccggtacccgttacccgaaaggtaaccggtaaacctaacgtttaaaccgggaaacggtaaaccctaccgtttacgtaacgttaacccgtacgggaaacctaaagttaccgaaccgttacgtaccgtaacgaagggtaccgaccgggaaacggtaacccgacccgggttacccttagttttaacccggttttagggaacccggttaaccggtaacccggtttaaaggaaaccggggttagggtaaccgttaaccggtttaaacgggtaacgggggtttaatttttaccgggaaacggttttccccgggg

SEQ ID NO: 235857 - DNA, 609 bp, Homo sapiens
  misc_feature: GYAE6OF02GUKG1.10.12.B01.1.454.CMB.1.raw
  modified_base (244)..(244): a, c, t, g, unknown or other
  misc_feature (244)..(244): n is a, c, g, or t
tcagcatagtagtgcacgaccggtgctcgatttagtagtgtagattccgcgggggcctggggagcctagctgtgctgtgggtccaggaggcagaactctgggtgtctcaccatggcctggatccctctacttctccccctcctcactctctgcacagggtccgaggcctcctatgagctgacacagccaccctcggtgtcagtcgtccccaggacagacggccaggatcacctgctcgtggagntgctttgccgaagcaatatgcttactggtaccagcaagaagccaggccacggcccctggagacttgtatagtaaggacactgagacggccccgaggactcctgagcgtacttctcgtcggcctccgacgctcgaagggaccaacgtagtcggtaacgttacgaaccagtcgacgggtcggaccggcccggagtacggacgggacggcgggactagacttaacgttacgtacgttacaactacgaactaagaactagttacgtcgttaactttacgggttggttcggttacgggacgggtacgggttacctaggtaccgttacgggtaccgttaccgttacgggtaccaccggtaccgtaacccgg

SEQ ID NO: 235858 - DNA, 688 bp, Homo sapiens
  misc_feature: GYAE6OF02JTVMS.10.12.B01.1.454.CMB.1.raw
  modified_base (248)..(248): a, c, t, g, unknown or other
  misc_feature (248)..(248): n is a, c, g, or t
  modified_base (320)..(320): a, c, t, g, unknown or other
  misc_feature (320)..(320): n is a, c, g, or t
  modified_base (659)..(659): a, c, t, g, unknown or other
  misc_feature (659)..(659): n is a, c, g, or t
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggaggcggtggtccaggccaggggaggtccccnggacgacgtctcctgtgcagcctcgtggattggaggttcaaagttactagtcgctatgctacgtcgggtccnccgtaggcctaccggaggggaagggcgtaggaatcgggatggaacgtagtttacgttacgaacgacgtatacggaaccaaaccaaaacctagtaccgtaaccggccggggtaagtttccggaggggacgggtcccggaccgttaggccgtaacgttccggtaccgtaccgaacggtaacgtaaaccgtaagttaccggaaacgttaacaccgttacttcgaaccgttagtaaccctaaagtaccgtaactacgtacgtagacgtacggaccgacggtaaccgacggtacccgttcgtaaccgttttcggacgtaccggtacgtaacgtagggtaccggngtaacggtaacggttgggtaatttaccgg

SEQ ID NO: 235859 - DNA, 677 bp, Homo sapiens
  misc_feature: GYAE6OF02HNSUK.10.12.B01.1.454.CMB.1.raw
  modified_base (248)..(248): a, c, t, g, unknown or other
  misc_feature (248)..(248): n is a, c, g, or t
tcagcatagtagtgcacgaccggtgctcgatttagtagtgtagattccgcgggggcctggggagcctagctgtgctgtgggtccaggaggcagaactctgggtgtctcaccatggcctggatccctctacttctccccctcctcactctctgcacagggtccgaggccctcctatgagctgacacagccacccgtcggtgtcagtcgtccccaggacaggacggccaggatccacctgcctcgtgganatgtctttgaccgaagacaattatgtacttactggttaacctatcaaggaacgaccgacggacccacgggccccccttgggtacgtaacgtttaggtaattaagtaaacggaactacgtaggtaaggaccgggaccccgacgggacctcccgtaggacgcgtactttccgtcgtcggtcctaccgacgtcctacggacgggaacaacgtagtcgtacgttcgaccagtacgacggcgggacggcccgggagaacgggacggacggacggcgtacgtacttaacttacgttacgtacgaatacaacgaataactattaacgttacgttaacgttagtttgggttagggttccgggacgggttacgggtaccgtaacggtcggttaccggtaccggttaccgttacggaccgtaccggacccgtaaccggg

SEQ ID NO: 235860 - DNA, 603 bp, Homo sapiens
  misc_feature: GYAE6OF02FJN6Y.10.12.B01.1.454.CMB.1.raw
  modified_base (262)..(262): a, c, t, g, unknown or other
  misc_feature (262)..(262): n is a, c, g, or t
  modified_base (302)..(302): a, c, t, g, unknown or other
  misc_feature (302)..(302): n is a, c, g, or t
  modified_base (368)..(368): a, c, t, g, unknown or other
  misc_feature (368)..(368): n is a, c, g, or t
  modified_base (399)..(399): a, c, t, g, unknown or other
  misc_feature (399)..(399): n is a, c, g, or t
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggagaatcgtgggggagcgtggtccagccagggagtccctgagactctcctgtgcagcctntggattgaggttcaataactatgctatgcactgggtcccncagggctaccgaggggaagggctaggaatggatgacagtttattcacacgatcgacaaaccaaacntaacacggcggtagttcgaggacggggcccngtgctagtccgtactccgaagacgaataacgttaccgaaagtaacctaccttacgtacgttaacccgtagaaccgtaaaagttcggaaaacctgttaccgttagaacggacgtccggaagggtaccgaccgggtcctactttacggtttggcgtacgtaacgtaggaagggtcgggaactacgtaggttaggggtatttaacgg

SEQ ID NO: 235861 - DNA, 874 bp, Homo sapiens
  misc_feature: GYAE6OF02GFMQ6.10.12.B01.1.454.CMB.1.raw
  modified_base (183)..(183): a, c, t, g, unknown or other
  misc_feature (183)..(183): n is a, c, g, or t
tcagcatagtagtgcacgaccggtgctcgatttagtagtgtagattccgcgggggcctggggagcctagctgtgctgtgggtccagggaggcagaactctgggtgtctcaccatggcctggatccctctacttcctccccctcctcactctctgcacgagggtccgaggccctccgtatggancctgaccacacgccctacctcggtcgtacaggtacgtccccaggacaacggaccggccaaggactcaccgtagcctacgtggacgtatcgtactttacggacgaaagtctaaagttagtacgttaccgttaacgcggttaacctaacgttacgaaacggaaccgtaccgaaccgggaccccgtaccgggtacccccgttaggtaacgggtaaaccgtttgttaaacgtaaggtaaaacggactaccggtaaggacggaacccgggtaccccgtaagggtacccttacccggtaaggacgtaccgttaagtttccggtacggttacggacccttacccgaaacgggtccgttaacccggaagggaaacctaaccggtaacggtacgtaaccgggttaaccgtaacctacgtaccgagggaaccccccggagggaccccgggaacggaacggtaaccggggaaccgttagggacccgtttaaggtaccgttaaagttttaccgcgttaaacctaacgtaacccgtaacgaaacgtacctttaaacggttaaaccgtttcggttttaaacgtttcgggttacggggtttacgggttcccggggtaacgggtaccggggtaacccgttaaccggtacgttacccggttaacggttacccggtaccggttaacggaacccggtacccgggtaacgg

SEQ ID NO: 235862 - DNA, 528 bp, Homo sapiens
  misc_feature: GYAE6OF02FY8BU.10.12.B01.1.454.CMB.1.raw
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
tcagcatagtagtgcacgaccggtgctcgatttagtagtgtagattccgcgggggcctggggagcctagctgtgctgtgggtccaggaggcagaactctgggtgtctcaccatggcctggatccctctacttctccccctcctcactctctgcacagggtccgaggcctcctatgagctgacacagccaccctcggtgtcagtcgtccccaggacagacggccaggatcacctgctctggagatgctttgccgaagcaatatgcttactggtaccagcagaagccaggccaggcccctgtggaacttgtatagtaaggacactggagaggccccccgagggactcccgtgacgcgattcgtctggctccgagctcgagggacaacgagtgacgttgaccatcagcggcgcccggnaggngacgaggctgactnttacgngtacaatacgacaagactattacgtgttattagttgggtggttcggcggtaggtccaagtcgagaccgtctaggtcacggcctaaccgg

SEQ ID NO: 235863 - DNA, 766 bp, Homo sapiens
  misc_feature: GYAE6OF02H0U87.10.12.B01.1.454.CMB.1.raw
  modified_base (182)..(182): a, c, t, g, unknown or other
  misc_feature (182)..(182): n is a, c, g, or t
  modified_base (591)..(591): a, c, t, g, unknown or other
  misc_feature (591)..(591): n is a, c, g, or t
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcgttgggtttttcctcggttgcttactttttaaggnggttcgtccagtgtcaggtgcgaggttggaaggtaatcggtgggggagcgtcggtccgagccggaggggacgtccctaggaacgccttctccgtggtcgacgcgtcctcgtaggttagtttggagtttacaaaagtaactattcgacttagtcggactacggtccgggtacccgcgtacggcctaccggaagggggacgggtcgtagggaagtcggtagtacgtacgttacggttttaattaccgtaaccgtagtacggtaccaaaccaaaaacccgtaaaaacctaacgttaacccgtaacgggtacggttaggtttacggaacgggggtaccggccgtagtacgctacgttccgacgtacgaagaacgactaacgtaccgaaagtaaccgtgtaccttacgtaaacncgaaacttaaaggtaccaatagggtttaccaagggacgtaccgtaacgggaccgtaaccggttaccgggttaccttaccggtttacttttcggaaccggtacgtaacggtaagggttacgggtacggtaacttcgggttaaggtaacgggttttcgtttacggacccgttcgggg

SEQ ID NO: 235864 - DNA, 770 bp, Homo sapiens
  misc_feature: GYAE6OF02FSVUW.10.12.B01.1.454.CMB.1.raw
tcagcatagtagtgcacgaccggtgctcgatttagtagtgtagatttaggtttggggagagctctggggaggaactgctcagttaggacccagacggaaccatggaagccccagcgcagcttctcttcctcctgctactcaggctcccagaaaccactggagaaatcgcgatgacgcagtctccagccacctgtctgcgtctccagggacaaacagcctaccctctcctgcctcgggcctagtccgagtggttcggcacgccgtcttacgccgtggtaaccaagacctaaaaaaccgtcggaccgacgccccttacccgaggacccttcccgttcggtcctagtacggtcgtaccgtaactcccgtaaccggaaacggggtaccctaacggttacgggtaaccttaccccgacggacccgtaacgggttacgaacggttcggggtaccgtaagggtcggggttccgtagggggtaacgtaacgggtacggtttccgtcctcgtaccgacctacgttacgacgacctaacggtcttacggcgtaacggttacgtaggtaaacgtttggttttacgacgtttaacggttttaactttacgtttacggtaacgttaaaggggttaaacttacgttacggttaagttcgggtacgttaccggttacccgttaccggtaacgtttaaccgtttcgggtaaccgtaacgggtaacgttaaggttacggtaaactacgtacggtaaaccgttacgttaggtctacgtacctcgtacg

SEQ ID NO: 235865 - DNA, 659 bp, Homo sapiens
  misc_feature: GYAE6OF02GVE07.10.12.B01.1.454.CMB.1.raw
  modified_base (505)..(505): a, c, t, g, unknown or other
  misc_feature (505)..(505): n is a, c, g, or t
tcagcatagtagtgcacgaccggtgctcgatttagtagtgtagattccgcgggggcctggggagcctagctgtgctgtgggtccaggaggcagaactctgggtgtctcaccatggcctggatccctctacttctccccctcctcactctctgcacagggtccgaggcctcctatgagctgacacagccaccgtcggtgtcagtcgtccccaggacaggacgccaggtactcacctgctctggagtatgtctttcgaccgaagcaatatcgtacttacgtggtacctagacgtacggaacgccgaacgggccgaccggtacccccgttaggtcggtaaacgtttcgtaagttaacgtaaacggaacctaacgtacggacggaaccgggccccgagggtactacccgtggacgacgttacttcgtcgtcgtctaccgacgtcgtacgaggaacacgtagtcggtaccgttcgaacctacgtacgacggcgggaacggccccgggtanaacgggacggaacggcggtacgtacgacttacttaccgacggttaccagttaccaacgtaacgtaactaagttacgtacgttacgttagttcgggttagtcgggacggtacgtaccgagtcgtacgtccgtacgtggtaccgacgtccgaacgg

SEQ ID NO: 235866 - DNA, 738 bp, Homo sapiens
  misc_feature: GYAE6OF02JZZQ3.10.12.B01.1.454.CMB.1.raw
  modified_base (659)..(659): a, c, t, g, unknown or other
  misc_feature (659)..(659): n is a, c, g, or t
tcagcatagtagtgcacgaccggtgctcgatttagtagtgtagattccgcggggagctctgggagacgagcccagcactggaagtcgccggtgtttccattcggtgatcatcactgaacacagaggactcaccatggagttgggctgagcttgggtttcctcgttgctcttttaagaggtgtccagtgtcaggtgcaggttggagatcgtgggggagcgtaggtccagccgaggggacgtccctgacgtactctcctgtcgcagcctcgtaggattggtaacgttactaaagtactagtcgacttaagtcgaccgacggttcgggtccccagtacggtccgtaccggaagggggtacgggcgtagggtaacgtggtatacgtacgttaggtttacttaccgacgaacgtactacgtaaaccaaaacaaacgtacgtaaccgttaaccgggacggtttacgttacggcggggaacggttcccgagttacgcgttacggtacctacggtaaccaagggtactaaacgtacgttaaacgaaccgtaacctacggttactacgttaacccgtgaaacgtaacgtacttaaaacgggcttaccgggaagaacggaacccggaagggaaccgggttaacccggaccggtaccttttaaccggttnttttaacggacgttaaccggtaacgttaagggtaacggtcggggtaaacttacggggtacggttaagggtctttaacgg

SEQ ID NO: 235867 - DNA, 709 bp, Homo sapiens
  misc_feature: GYAE6OF02H8H10.10.12.B01.1.454.CMB.1.raw
  modified_base (179)..(179): a, c, t, g, unknown or other
  misc_feature (179)..(179): n is a, c, g, or t
  modified_base (187)..(187): a, c, t, g, unknown or other
  misc_feature (187)..(187): n is a, c, g, or t
  modified_base (196)..(196): a, c, t, g, unknown or other
  misc_feature (196)..(196): n is a, c, g, or t
  modified_base (441)..(441): a, c, t, g, unknown or other
  misc_feature (441)..(441): n is a, c, g, or t
  modified_base (569)..(569): a, c, t, g, unknown or other
  misc_feature (569)..(569): n is a, c, g, or t
tcagcatagtagtgcacgaccggtgctcgatttagtagtgtagattccgcggggctgggagacgagcccagcactggaagtcgccggtgtttccattcggtgatcatcactgaacacagaggactcacatggagttgggctgagcttgggttttcctcgttgcttcgttttaagaggtntccagttntcgaggtgngtaggttggaggtatcggtgggggagtcggtcggtccaggcccgaaggggtacgttccaggacgtactcgtccgtgtcgcgacgtccttgtggtattggagttacaattaacgtatgtactagtcgactcgtcggtcccgacgtggtcctacggaggggtacggtctaaggacgtgatcggaattagttactcgacgtaacgtatacgacaaacaactagtaccggaacgtcggtagttaccggnggtaacgggtcctacgtcgacgtacgttcgtacgttacgagtaacgtaacgttaagtaaccggtaacgaacgttaccgttcgtaacgttacgtacgtaaccgtaaacgttacggaacttacggtacgnggtaaccgcgaccggtaacgtaccgccggttaccgtaccgtttacggttgtaaccggtacgtaacggttaagggtaccggtacggttaacgtacgttaacggggttaacgggtttagtttacgggtaccgtttaccgggg

SEQ ID NO: 235868 - DNA, 824 bp, Homo sapiens
  misc_feature: GYAE6OF02HONW0.10.12.B01.1.454.CMB.1.raw
tcagcatagtagtgcacgaccggtgctcgatttagtagtgtagattccgcgggggcctggggagcctagctgtgctgtgggtccaggaggcagaactcgtgggtgtctcaccatcggcctggactcctctacttcctcccctctcactctctgcacgaggtccgaggtcctactatggcgtctcgaacacgcgccctaccgttcggtcgtcgacgtccggtacccaaggaccgaacggaccggacgacggctaccaccgtcgtcctaggtacggatgtcgttacgttacgaccggaagactaagtacgtcgttaccgttaacgtacggtaactaccgttacgaaacggtaaccgaccggaccggtaccggtacccgggtcccgtaagggtcggtttaaaccttagtaacggtaacggtaaacgaccgttaacggtaacggaaccgggacccggtaccccgaaacgggttccctccggtaggaaccggtcgtttaaccttccggtaccggttcgtacccgtaccggacgttaccggtaaccgggtaacgggtaactaacggtaacgtttaccgggtaaccgttcggaaaccgtaccggtacggtaacggggccggtacccggggtaccggaacggtacgggacggtacggacggtacgtactacgtttacgtcgtacgtaacgtaacaacgtaacgaacgtaacgttacgtacggtttacgttagtttacgggtcggttacgggtacgggtaccgggtacggtaccggtaagtccggtaccgttaccggtccggtttaacggaccgtacccggtaccgtacccgg

SEQ ID NO: 235869 - DNA, 709 bp, Homo sapiens
  misc_feature: GYAE6OF02GXDPL.10.12.B01.1.454.CMB.1.raw
  modified_base (471)..(471): a, c, t, g, unknown or other
  misc_feature (471)..(471): n is a, c, g, or t
  modified_base (480)..(480): a, c, t, g, unknown or other
  misc_feature (480)..(480): n is a, c, g, or t
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgcttcttttaagaggtgtccagtgtcaggtgcagttggaggagtcgtgggggaggcgtggtccagccgagggacggtcccgtgacgactctcctgtcgcagcctcgtggattcgaggttacaaagtaactagtgtactatgtaccgtaccggtacggggtcccgaccggaacggtcccgtaccgggaaggggtacggggctaagggaacggtgggtagtacggaacgttaggttttacttaccaacggacgtatacgaacaaaacaaacgtataacgaccggtacgtaggttcggtaggacggggccgngtcggtacncgtccgtctacgagtacgaacgtaacgtacgaagtacctacgtcttacggacctcggaaactaacgtagtaaccgtagtaccgaggacggtacgacccggaacggtaccgaaccgggttcccgttactttaaccggtttcggaacggtaacgtaaggttaaccggagggttacggtaaggttaccgttaacggggttagggtttacgtttaggtaccggttacccgggg

SEQ ID NO: 235870 - DNA, 806 bp, Homo sapiens
  misc_feature: GYAE6OF02JKHIZ.10.12.B01.1.454.CMB.1.raw
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggtttcctcgttgctctttaagaggtgtccagtgtcgaggtgcgaggttggaggaatcggtgggggacgtcgtggtccgaggccgaggggacggttccctgagtaccgttctccgtggtcgccgacgcccttacgtggtagtttggacggtttacaaacgttaacgtatccggactatacggtcctacggtccgggtccgccggtagtcccgtaccgggaagggggagggtccgttacgggtaaggtcgggacgtacggactttaaggtttacgttcaacgacggtagtacgaacctaaacccgaaaacgtacgtaacggtaccgtaccggtaacggttcggtacgggacgggtcctacgtacgtacgtacgttccccgtaccgtaaccgaggtaaccgtaacgttaaccgtaaccgtaaaccggtaccttaacgttccgttaaaccgtacccgtaagtaaccgtaaacgtacgtaaaccgttaaggttaccgtaaggacggtaccgaaccgggtaacggttaacccggtaccggttacccgtttaccgttaaggttttccggtaaacgggtccgtaaaaggtaaccgggtaaggttcgggacgttaacggttaaccgggttagggtaacctttacgggtacggtttaacccgggg

SEQ ID NO: 235871 - DNA, 776 bp, Homo sapiens
  misc_feature: GYAE6OF02F1NKM.10.12.B01.1.454.CMB.1.raw
  modified_base (209)..(209): a, c, t, g, unknown or other
  misc_feature (209)..(209): n is a, c, g, or t
tcagcatagtagtgcacgaccggtgctcgatttagtagtgtagattccgcgggggcctggggagcctagctgtgctgtgggtccaggaggcagaactctgggtgtctcaccatggcctggactccctcttacttcctccccctcctcacttctctgcacgacgggtccgaggccctcctatgagctgacacagaccctaccgtcggtcncagttcgtccccaggacacggaccggcgaggactcaccgtgtctcgaggctagtcgtcgttgaccgaacgactaatactctacttacgtacgtaccctagttaccaacggaacgaccggaccggtaccctaccgggccccgttaggtacggttaacgttagtaacgttaagtaaccgtaacgaccgttacggaacggaccccggacccggtacggtaccgtaccggttacgacggtaccgtacgttcgttcgtcgtccgtccgaccgtccgttacggaacggaaccaacggtttacggacggttaccgtacgtaaccgtgtaaccgggacgggaccgggccccgggaaccggtacggaaacgggtacggaaacccgggttaggaccggtttataaccgttacgttacgttaccgtacgtaactaaccggaaactaacgtaaccgttaacgttaacgtttacgtagttttacgggttacggttcgggtcgggtaccggtacgggtacgtaacggttccggtaaccggaccgttacgggtaccgtacggtacccggtaccggtacccgg

SEQ ID NO: 235872 - DNA, 872 bp, Homo sapiens
  misc_feature: GYAE6OF02HGUPJ.10.12.B01.1.454.CMB.1.raw
  modified_base (165)..(165): a, c, t, g, unknown or other
  misc_feature (165)..(165): n is a, c, g, or t
  modified_base (411)..(411): a, c, t, g, unknown or other
  misc_feature (411)..(411): n is a, c, g, or t
  modified_base (706)..(706): a, c, t, g, unknown or other
  misc_feature (706)..(706): n is a, c, g, or t
tcagcatagtagtgcacgaccggtgctcgatttagtagtgtagattccgcggggagctctgggagacgagcccagcactggaagtcgccggtgtttccattcggtgatcatcactgaacacagaggactcacagtggagttgggctggagcgttcgggttttccncggttgtcttacgtttttaaaggagggttcgtacctaggttcgtcgtaagggtgacgtagggttgggaaggaacttcggggtggggggacggtcggttcgggacccacgggcccggaaagggggtcgttcccctaggaccggtaccttcctccgttggtcgaccgccgcccttcggtggttagttaggtcggttaacctaaagttaacttagttcgtccttatccgactaccggtcggggtccccnccggacgccggtaccgggagggggaacggggtcgtagggaagtcggacgtacgtacgttagtttacttccgaacgtacgtagtaccgaaaactaaaaccgtaaacgtaccttaaacggtccggtaggttacgggtttcggaaccgggggcgggtccctcggtaagtcccgtacgttaccggtcccgtaagtaaccgggtaaccgtaaaaccggttacggttaaccgaaacccggtaaaaactttccccgggtaactttttacccggaaaccgtaacccgtttaagggttaaaaanaccgggtaaacccgttggttaccgaacggaacggtaccggaaaccggtacgggttaacccggacccgggttacgtttttacccgttaacggggtttcaccgggtacctaaacgggttacgggtaaggtcggtaaccgttagggtaaggttacggttagttaccggg

SEQ ID NO: 235873 - DNA, 639 bp, Homo sapiens
  misc_feature: GYAE6OF01EYCTL.6.43.D10.1.454.CMB.1.raw
tcagatatcgcgagcacgaccggtgctcgatttagactagcagtaagggggctttctgagagtcatggacctcctgtgcaagaacatgaagcacctgtggtttttcctcctgctggtggcagctcccagatgggtcctgtcccaggtgcagctgcaggagtcgggcccaggactggtgaagcctttggagaccctgtccctctcctgcgttgtctctggttactctctcagagatggttattagttggggctggattcggcagcccccgggaaggctggagtggattgtcttttagttatcattacgtgggagccacccactaccaacccgtccctacgaggagtcgagtcatcatatcagtacgacccgtacaagtaaccctagtttcctcccgtagaacgctagaacgttcgtgtcgtacccctgaccaacggactaccggccgtacgtacttacgtggtcggcgaggacgctcgtgaccgtaggtagtagttcggttcgtcggtcccgggttataacgttcgtaaactttaccgttaagttaccgtaacgggttaacgttaacgggaacgggtttccgggtacggggggacccgtaaaaccgggggtaccctaaccggggttcccttaaccccggg

SEQ ID NO: 235874 - DNA, 655 bp, Homo sapiens
  misc_feature: GYAE6OF01ACCXN.6.43.D10.1.454.CMB.1.raw
  modified_base (320)..(320): a, c, t, g, unknown or other
  misc_feature (320)..(320): n is a, c, g, or t
tcagatatcgcgagcacgaccggtgctcgatttagactagcagtaagggggctttctgagagtcatggacctcctgtgcaagaacatgaagcacctgtggtttttcctcctgctggtggcagctcccagatgggtcctgtcccaggtgcagctgcaggagtcgggcccaggactggtgaagcctttggacgaccctgtccctctcctgcgttgtctctggttactctctcagagatggtttattagttggggctggattcggcacggcccccgggaagggactggagtggattgtcttttagttatacatacgtgggacnccaacccactaaccaaccccgtccctacgaggacgtcgagtcatcaatactcagtacgacccgtacaaacgaaccctagttcctcccgtagaacgtctagtaacgtctagtaccgacccctgacctaacggaccgaccgggcccgtacggttaattaccgtgtacggccggtaagacggtccttcgacgacgtaaggttacgagtttcggttaccgtcggtaccccgggttataacgttacggtaacttttaacgagttacccgtaacgggtaagtacgggtacgggttccgtacgggggaccctaaacggggccctaacgggtccgtaaccccg

SEQ ID NO: 235875 - DNA, 592 bp, Homo sapiens
  misc_feature: GYAE6OF01BAU0Q.6.43.D10.1.454.CMB.1.raw
  modified_base (421)..(421): a, c, t, g, unknown or other
  misc_feature (421)..(421): n is a, c, g, or t
  modified_base (436)..(436): a, c, t, g, unknown or other
  misc_feature (436)..(436): n is a, c, g, or t
tcagatatcgcgagcacgaccggtgctcgatttagactagcagtaagggggctttctgagagtcatggacctcctgtgcaagaacatgaagcacctgtggtttttcctcctgctggtggcagctcccagatgggtcctgtcccaggtgcagctgcaggagtcgggcccaggactggtgaagcctttggagaccctgtccctctcctgcgttgtctctggttactctctcagagatggttattatggggctggattcggcacgcccccgggaagggactggagtggattgtcttttagttatcatacgtgggacgcacccactaccaaccccgtccctcgaggagtcgagtcatcatatcagtacgaccctacaagaaccagttcctcctgaacgtctagaacgtctgtcaccctgcagacncggccgcgtatctgngcgagcggtctcgtagctaggtacgtagttcggttcctcggtacccggtactaagttcgttaactttacgtaacgttacgtaacggtagttacgggtacgggttcggtacgggggaccgtaaacggggacccgtaaccgggttcccgtaaccccgg

SEQ ID NO: 235876 - DNA, 644 bp, Homo sapiens
  misc_feature: GYAE6OF01C0BZL.6.43.D10.1.454.CMB.1.raw
tcagatatcgcgagcacgaccggtgctcgatttagactagcagtaagggggctttctgagagtcatggacctcctgtgcaagaacatgaagcacctgtggtttttcctcctgctggtggcagctcccagatgggtcctgtcccaggtgcagctgcaggagtcgggcccaggactggtgaagtccgtttggacgaccctgtcccgtctcctgcgttgtctcgtgttactctctcgagagtatggttattagttggggctggtagttcggccgacggaccccccgggaagggaccgtgggtaggtggtagttgtcgttttagttatactagtacgtgggacgaccgaacccaactaccaaccccgtcccgtacgacggagtcgagtcagtacatatacgacgtacgacccgtacaacgaacctagttccaccgtagacgtcgtagaacgtctacgtccgacccgtgacgaacgacgaccggaccgtcgttaacgttacgtggtcgacgacggacgctcgtcgacgtagtacgtagttcggttcgtcggtcccgtatagtacgttaacttacgtaacgtacgtaggtaacgtaggtacggttacggtacggggaccgtaacgggacccgtacggttccgtaacccgg

SEQ ID NO: 235877 - DNA, 622 bp, Homo sapiens
  misc_feature: GYAE6OF01A42G2.6.43.D10.1.454.CMB.1.raw
tcagatatcgcgagcacgaccggtgctcgatttagactagcagtaagggggctttctgagagtcatggacctcctgtgcaagaacatgaagcacctgtggtttttcctcctgctggtggcagctcccagatgggtcctgtcccaggtgcagctgcaggagtcgggcccaggactgggtgaagcctttggagaccctgtccctctcctgcgttgtctctggttactctctcagagattggtttattagttggggcttggtattcgggccacggccccccgggaagggtacgtggagtggagtttgtcttttagttatctatacgtgggacgccacccactaccaacccgtcctacgaggcgtcgagtcatcatatacgagtaccgaccgtaccaaagaacctagttaccgtaccctagaacgtctaggaacgtcgtacgtacgaccccgtgacgacgacgaccggtcctacgtattacgtgtcgcgaggacgctacgtcgcgtaacgtagtacgttcggttcgtcggtacccgtctaagttgttaactttagtacgtacggtaacggttataacgggtcggttacgtcggggaacgaaccggaccgtaccggtcgtaaccccg

SEQ ID NO: 235878 - DNA, 676 bp, Homo sapiens
  misc_feature: GYAE6OF01D3THE.6.43.D10.1.454.CMB.1.raw
tcagatatcgcgagcacgaccggtgctcgatttagactagcagtaagggggctttctgagagtcatggacctcctgtgcaagaacatgaagcacctgtggtttttcctcctgctggtggcagctcccagatgggtcctgtcccaggtgcagctgcaggagtcgggcccaggactggtgaagcctttggagaccctgtccctctcctgcgttgtctctggttactctctcagagatggttattagttggggctggattcggcacggcccccgggaagggactggagtggtattgtcttttagtatctatacgtgggacgccacccactaccaaccccgtccctcaggagtcgagtcatcaatatcaagtaacgacccgtacaaacgaaccctagttcctccctaggaacgtctacggtaaacgttccgtacgtaccgtaacccccgtggaccgtaacggaaccgacccggggcccgtacgtttaacgtttacgtaggtcggacggtaaggacggtccttacgtggacgtaaggttagaggtttcggttctccggacccgggtctaaagttcgttaactttacgtaacgttacggtaacggttaggtaaacgggtcgggttaccggtacggggggaacccgtaaagggggaaccccgtacgggttcccgtaaccccgg

SEQ ID NO: 235879 - DNA, 602 bp, Homo sapiens
  misc_feature: GYAE6OF01CZ37P.6.43.D10.1.454.CMB.1.raw
tcagatatcgcgagcacgaccggtgctcgatttagactagcagtaagggggctttctgagagtcatggacctcctgtgcaagaacatgaagcacctgtggtttttcctcctgctggtggcagctcccagatgggtcctgtcccaggtgcagctgcaggagtcgggcccaggactggtgaagcctttggacgaccctgtccctctcctgcgttgtcttctggttactctctcagagattggttattagttggggctggtattcggcacggcccccgggaagggactggagtggattgtcgttttagttatctagtacgtgggacgccacccactaaccaaccccgtccctacgaggacgtcgagtcatcatactcagtacgacccgtacaacgacctagttcctcctagaacgtctagacgtctgtccgacccgtgacacgacgaccggccgtacgttattacgtgtcgacgaggacgtctctaggctagtagtactcggttcgtcgtcccggtatacgttcgttaattacgtactacgtaacggtagtacggtacggttacggacggggtaaccgaacgggtacccgtcggtcctaccccgg

SEQ ID NO: 235880 - DNA, 745 bp, Homo sapiens
  misc_feature: GYAE6OF01C0HTU.6.43.D10.1.454.CMB.1.raw
tcagatatcgcgagcacgaccggtgctcgatttagactagcagtaagggggctttctgagagtcatggacctcctgtgcaagaacatgaagcacctgttggtttttcctcctgctggtggcagcctccagagtgggtcctgtcccgaggtgcagctgcgaaggaggtccgggcccaggactgggtgaacgtccgtttggacgtccctcgtccctctcccgtgtcgtttgtcctcgttggttacctctctacgagagtagttggtttaagttggttcggggcgttaggtacgttccggaccgaccgggacccccggggtaaggtacgtaggtaggtggtaagttcgttacgttttagtactactaacgttacggtggacgaccaaccctaacgtacccaaccccgtccctacgacggacgtacgagtacactacgatacgtcgaacgtaaccgacccgtaacaaacgtacctacgttacctaccgtaggaactccgtaagtaaccgttcctacggtacccgacccgtacgaccgaacggaaccgacccgggtacgttacggtttaacttcgacgtacggtaacggaacggtcggtaccctcgtaggtaccgtaagttacgttcggttcggttaccgtccggtaaccggttaattaaccgtagtttaacccttagtaccgtacgttaaggtagttacggacgggtacgtaccggggaaacgaccggaacccgtcggtcccgtacccg

SEQ ID NO: 235881 - DNA, 916 bp, Homo sapiens
  misc_feature: GYAE6OF01CRDCY.6.43.D10.1.454.CMB.1.raw
tcagatatcgcgagcacgaccggtgctcgatttagactagcagtaagggggctttctgagagtcatggacctcctgtgcaagaacatgaagcacctgtggttttcctcctgctggtggcagctcccagatgggtcctgtcccaggtgcagctgcgaggagtcgggcccaggactggtagaagtcctttggacgaccctgtccctctcctgtcgttgtctcttcggttactcctctcaagtagtagttggttaagttagttcggggcttagggtacgttcggaccgaccggaccccccgggggtaaagggtaccgtgggtaggttaggtacgtttggttacctttttaaggttaactaccgtaagttaccgtaggggaaccgtaccctaaacccgtaaccgttaacccgtaaaccccccggttcccgtaccggtaagggtaccggttacggaacgtacctaacttactaaacgttaactaccgtaaacggttaacccgtaaccccggtaaaccgtaaacgtaaacccgttacgtttacccgttacccgtaaggtaaaccgtcgttaacggtaacggttccgtacggttacccggaacccccgttaggaccgtaaacggaacccggaccggttacccggtaacggtttaacgttaaccggtggttacggaaccgggttaacgtaccgggtaaccgtttcgtacgggtaacggtaaggtttaaacggttcgggtttaccgggttaccggttacccgggtaccccggtttaaagtaaaccggttaacgtttaaaccgtttaaccgtaaaccgttaccgttaaacgggtttaacggtaccgggttaacgggttaccggggtaccgggggtaaacccgaaacggggttaaccccgtaacccgggttacccgtaaacccccgg

SEQ ID NO: 235882 - DNA, 805 bp, Homo sapiens
  misc_feature: GYAE6OF01CDMZR.6.43.D10.1.454.CMB.1.raw
  modified_base (147)..(147): a, c, t, g, unknown or other
  misc_feature (147)..(147): n is a, c, g, or t
  modified_base (657)..(657): a, c, t, g, unknown or other
  misc_feature (657)..(657): n is a, c, g, or t
  modified_base (663)..(663): a, c, t, g, unknown or other
  misc_feature (663)..(663): n is a, c, g, or t
tcagatatcgcgagcacgaccggtgctcgatttagactagcagtaagggggctttctgagagtcatggacctcctgtgcaagaacatgaagcacctgttggtttttcctcctgctggtggcagctccagatgggtcctgtccaggtncagctgcagggacgtccggccaggtactggtagaacgtcctttgggacgtacccttcgtcccctctccgtggtcgtttcgtccttcgttcggttactccgttctacgagtagttacggttggtttaagtttggttcgggggcgttaggttacggttcccgggaccgaacccggggtacccccgggggaaagggtccggttaggggacggtttagggttagtttacggtttacgtttttaaggtttactactaacggtttacgggagggtaccgtacccctaaaccccggttaactaacccccgtaaccccggtcccgtacgggtaacggtaccggttacgaacgttacctattaccgtaacttaacgtacgtaacgtaacccgtaaccccgtaacgaaaccgtaacccgttaacgttccgtaacccgtaaggtacgggtaccttaggtacgttaccgttccggtaacctcccgacgaaccacggaccgtaccgacgttacgtacttacgngtacgngtacggtacggcttcgaagtggaacgtagtcggttacgtccggtacggtacccgtattaacgtacgtttaataccgtactaggtagtacgacggtagggtcggtacggaaccgggttaaggacccgtaggtaccccgtaccg

SEQ ID NO: 235883 - DNA, 886 bp, Homo sapiens
  misc_feature: GYAE6OF01BD5UM.6.43.D10.1.454.CMB.1.raw
tcagatatcgcgagcacgaccggtgctcgatttagactagcagtaagggggctttctgagagtcatggacctcctgtgcaagaacatgaagcacctgtggtttttcctcctgctggtggcagctcccagatgggtcctgtcccaggtgcagctgcgaggaggtccgggcccgaggacgtgggtagaaggtccgttttgggacgtacccgttcggtcccctcttcccgtgtcgtttgtccgttcgttcggttaccttctcttacgaggtagtagttaggtttagtttaggttggggtcgttaggtacgtttcccgggaccggacccgggtacccccgggggaaggggtaccggtggggtacggtcggttagtttcggttacgtttttagttacgttacgtaacgttacggtaggggtaccgacccgtaacccctaaccgtaacccccgtaacccccgttccccgtaccgggtaacggtaacggtaccgaacggttacctaagtaacctaacttaacgttaccgtaaacggtaacccggtaacccccggttaaacgaaaacccggtaacccgttaccgtttaccccgttacccgtaagtaaaccggtacgttaacgggtaaccgttcgtacggtcccgtaaccccgtggacgtaaccgggaaccggaccgggtaccgttacgttaacgtttacgtcgggtacgacggtaacggcggttccgtagtcgggacgttaacggtaggtacggttttccgtccggtaccgtaaccccgttagttaacgttacggtttaacgtaacgtcgtaacccggttaaaggtagtaacggggttacggttaccgggtacggggacccgtaacggggtacccgccgggttacccctacccg

SEQ ID NO: 235884 - DNA, 822 bp, Homo sapiens
  misc_feature: GYAE6OF01CI5T8.6.43.D10.1.454.CMB.1.raw
tcagatatcgcgagcacgaccggtgctcgatttagactagcagtaaggggctttctgagagtcatggacctcctgtgcaagaacatgaagcaccttgttcggtttttcctcctgcgtggtggcagcctccagtgtcggtcctcgtccgaggtgcgagctggacgacggacggtccgggcccgaggtacgttggtacgtaacgtccgtttaggaccgtacccttccgttccctctccgtcgttcgttcgtccgttcgttgttacctctcgtacgagtaagttagttaggtttagttagggttcgggtacgttcggtacggttacccgggaccggaaccccggggtaaccccgggtaaggggtaccgttaggggtacggtttaggttacgttttacgtttacggtttttaacgttaagttccgtaaggttaccggtacggaacccacccgtaacccctaacccgttaaccccgtaaccccggttccgaccggtaacggtaccggtaccgtaacgtaccaacgttaacgtaacttaacgtacgttaaccgaaccgttaaccccgtaacgtaaaccgtaccgttaccgttaccctacgtacgaacgttacgtaacgtaccgttcgtaccggtaccccgtaaccgtatacccggaacgtcccggtaccggtcggttaaacgttcgttacgcggtaaacggcgggtacgtaccgtagtagtacgtagtacgttagtccgttacgttcgtcgacgtatcttagtactaacgtcggtacaagttcggtcacgggtaccgtacgggacacggtaaccgtcgtccgtacccg

SEQ ID NO: 235885 - DNA, 912 bp, Homo sapiens
  misc_feature: GYAE6OF01CK4HO.6.43.D10.1.454.CMB.1.raw
tcagatatcgcgagcacgaccggtgctcgatttagactagcagtaagggggctttctgagagtcatggacctcctgtgcaagaacatgaagcacctgtggttttcctcctgctggtggcagcctcccagagtgggtcctgtcccaggtgcagctgcaggagtcgggcccaggtacgtgggtgaagtcccgttttgggacgtaccccgttcggtccccctacttccgtcggtcgtttcgttcgttcgttcggttactcctcgtacgaggtagtattggtttaatttaggttgggggtacttgggacgtttaccgggaccgtaacccgggaccccccgggggtaaggggtaccgtaggggtaggttacgggtacgtttcggttacgtttttaaggttacgttactaacggttaccggtaggggaaccgtaccccaaccccgtaacctaaccccgtaaccccgttccccgtacgacgggtacggtaccggtaacgtacctaacttacgtaattacgtacgtaacggttacccggtaaaccccgtaccgtaaaacgtaacccgttaccgttacccgttacccgttaaggtaacggtaccttaagggttaaaccgttccgtaccgttaccccggtacccgttacgaccggtaacgaacccggaccggtacccgtacgttttaacgttaccgtacggttccggtaacggcggttaacggtcttacggtacggtacggtaacgggtttaaggtacggttacgggttaccgtccgggttaacccgttacgtaaagtttcgttaaaccgtttaacgttacggttaacgtaacgggtttaacggtaaggtttacccgggggtacggtacccggggtaaccggaaccggggttacccgttaaaccgggtcccggttaaccccg

SEQ ID NO: 235886 - DNA, 674 bp, Homo sapiens
  misc_feature: GYAE6OF01AKFOU.6.43.D10.1.454.CMB.1.raw
tcagatatcgcgagcacgaccggtgctcgatttagactagcagtaagggggctttctgagagtcatggacctcctgtgcaagaacatgaagcacctgtggttttcctcctgctggtggcagctcccagatggtcctgtcccaggtgcagctgcgaggacggtccgggccaggacgtgggtgaagtccgtttggacgaccctgtcccctctcctgtcgttgtctctggttactctcacagagtattggttattagttgggactggtacgtcggcaccggaccccgggtaaggcgtggaggtggtacgttggttacgttttagtactacgtatacggtggacgtccaccgacctaacctaccccgtacctacgaacggtacgtacgaacgtctactaccaatacgtacgtaacgtacgaaccccgtaacgaaacgtaaccgtaccgttcctaacccgaaggtaactacgtaagtaaccgttgtaccgtaccgtaccccgtgaaccgacggtaccgtacggccctagttacgtcgtacggtagacggaacgtcggtcctctaggactaggtagttacgttcggtaccgtcgtaccggtatacgttatacgttagaccgtagtacggttgaacggtacggtcggtacgggaccgtacgggacccttgtcccgtacccg

SEQ ID NO: 235887 - DNA, 528 bp, Homo sapiens
  misc_feature: GYAE6OF02F3PXR.6.43.D10.1.454.CMB.1.raw
  modified_base (468)..(468): a, c, t, g, unknown or other
  misc_feature (468)..(468): n is a, c, g, or t
tcagatatcgcgagcacgaccggtgctcgatttagactagcagtaagggggctttctgagagtcatggacctcctgtgcaagaacatgaagcacctgtggtttttcctcctgctggtggcagctcccagatgggtcctgtcccaggtgcagctgcaggagtcgggcccaggactggtgaagcctttggagaccctgtccctctcctgcgttgtctctggttactctctcagagatggttattattggggctggattcggcagcccccgggaagggactggagtggattgcttttagttatcatactgggagcacccactacaacccgtccctcaggagtcgagtcatcatatcagtagacccgtcaaagaaccagttcctccctgaagctagaagtctgtcgacccctgcagacacggccgcgttatactgtgcgagaggctctgcagtagattggttctgcccggtnaagtgtattactatccacggtataggaggtcgtggggaccaagggaccacggtctacccg

SEQ ID NO: 235888 - DNA, 558 bp, Homo sapiens
  misc_feature: GYAE6OF02I66SZ.6.43.D10.1.454.CMB.1.raw
  modified_base (472)..(472): a, c, t, g, unknown or other
  misc_feature (472)..(472): n is a, c, g, or t
tcagatatcgcgagcacgaccggtgctcgatttagactagcagtaagggggctttctgagagtcatggacctcctgtgcaagaacatgaagcacctgtggtttttcctcctgctggtggcagctcccagatgggtcctgtcccaggtgcagctgcaggagtcgggcccaggactggtgaagcctttggagaccctgtccctctcctgcgttgtctctggttactctctcagagatggttattattggggctggattcggcacgcccccgggaaggactggagtggattgcttttagtatcatactgggagcaccactaccaacccgtcctcaggagtcgagtcatcatatcagtacgaccgtcaaagaaccagttcctacctagaacgtctagaacgtctgtacgacccctgccagacacggccgtgtaacttactgtgcgagacggctcgtgcgtagtagtacttggttcncggtcccggtataagtgttaacttactacgtctacggtatacggaggtcgtacggggacctaacgggaccgtacggtcctacccgg

SEQ ID NO: 235889 - DNA, 585 bp, Homo sapiens
  misc_feature: GYAE6OF02G4IL9.6.43.D10.1.454.CMB.1.raw
  modified_base (478)..(478): a, c, t, g, unknown or other
  misc_feature (478)..(478): n is a, c, g, or t
tcagatatcgcgagcacgaccggtgctcgatttagactagcagtaagggggctttctgagagtcatggacctcctgtgcaagaacatgaagcacctgtggtttttcctcctgctggtggcagctcccagatgggtcctgtcccaggtgcagctgcaggagtcgggcccaggactggtgaagcctttggagaccctgtccctctcctgcgttgtctctggttactctctcagagatggttattagttggggctggattcggcacggccccccgggaagggactggtagtggattgctttttagttatcatacgtgggagccacccactaccaaccccgtccctacaggagtcgagtcatcatatcagtacgacccgtacaacgaaccacgttcctacccgtgaacgctaggaacgttctcgtacgacccctgaccacggacaccggccgtcggttacttacgtgtgcgagacggctcgngcgagtagtattggttctcggcccgtataagttgttaacttacgtagtaccgtaggtataggacggttcggacggggaccgaacggggaccctacggtactacccgg

SEQ ID NO: 235890 - DNA, 612 bp, Homo sapiens
  misc_feature: GYAE6OF02I9TGM.6.43.D10.1.454.CMB.1.raw
  modified_base (381)..(381): a, c, t, g, unknown or other
  misc_feature (381)..(381): n is a, c, g, or t
tcagatatcgcgagcacgaccggtgctcgatttagactagcagtaagggggctttctgagagtcatggacctcctgtgcaagaacatgaagcacctgtggtttttcctcctgctggtggcagctcccagatgggtcctgtcccaggtgcagctgcaggagtcgggcccaggactggtgaagcctttggagaccctgtccctctcctgcgttgtctctggttactctctcagagatggttattattggggctggattcggcacggcccccgggaaggactggagtggattgtcttttagtatctatacgtggagcaccactacaacccgtcctcaggagtcgagtcaatcatatcagtagacccgtcaaagaaccagttccnccgtagaagctagaacgtctgtcgacccctgacagacacgggcccacggttacttactcgttcgcgtaggacgggtccttcgtcggaccgaaggttacggactttcggggtttacctcggtcccgggttacttaagttcggttaatttacctagttaccgtacgggttaacttagggtacggttcggttacgggggtaccctaaggggacccctacgggtacctacccggg

SEQ ID NO: 235891 - DNA, 662 bp, Homo sapiens
  misc_feature: GYAE6OF02GB69H.6.43.D10.1.454.CMB.1.raw
  modified_base (320)..(320): a, c, t, g, unknown or other
  misc_feature (320)..(320): n is a, c, g, or t
tcagatatcgcgagcacgaccggtgctcgatttagactagcagtaagggggctttctgagagtcatggacctcctgtgcaagaacatgaagcacctgtggtttttcctcctgctggtggcagctcccagatggggtcctgtcccaggtgcagctgcaggagtcgggcccaggactggtgaagcctttggagaccctgtccctctcctgcgttgtctctggttactctctcagagatggttattagttggggctggattcggcacggcccccggggaagggactggagtggattggtcttttagttatcatacgtgggacncacccactaccaacccgtcctcaggagtcgagtcatcatatcagtacgacccgtaccaacgaacctacgttcctccctagaacgctagaacgtcgtacgtcgacccctgaccaaggacctaccgggcccgtacgttaacttacgtggttcggacgtaggtacgggtcctcgtcggaccgtaaggttacggtagtttcgggtttaccgtcgggtaccccgggttactaaggtttacgtttaactttaaccgttaacgttaccggtaaacgggttataacgggtacgggttcgttacgggggggacccaaacgggggtccccgtaccgggtaccctaccccggg

SEQ ID NO: 235892 - DNA, 633 bp, Homo sapiens
  misc_feature: GYAE6OF02IRQLI.6.43.D10.1.454.CMB.1.raw
tcagatatcgcgagcacgaccggtgctcgatttagactagcagtaagggggctttctgagagtcatggacctcctgtgcaagaacatgaagcacctgtggtttttcctcctgctggtggcagctcccagatgggtcctgtcccaggtgcagctgcaggagtcgggcccaggactggtgaagcctttggagaccctgtccctctcctgcgttgtctctggttactctctcagagatggttattagttggggctggattcggcacggccccccgggaagggactggagtggattgtcttttagttatcatacgtgggagccaccactaccaacccgtccctcaggagtcgagtcatcatatcagtacgacccgtaccaacgaacctacgttacctccctagaacgtctagaacgttcctacggtcgtacccccgtgtaccaacgaccgaccgggacccgtcggttaactttacgtggtcgcggagacgggtcttccgtcgcgtagtagagttcggttcgtcggtcccggtactaagttcgttaactttaccgtattaccgtaacgggttaagttacgggtaggttcggttacgggggacccgtaaacggggacccgtaccgggtcctaaccccgg

SEQ ID NO: 235893 - DNA, 640 bp, Homo sapiens
  misc_feature: GYAE6OF02HM26L.6.43.D10.1.454.CMB.1.raw
tcagatatcgcgagcacgaccggtgctcgatttagactagcagtaagggggctttctgagagtcatggacctcctgtgcaagaacatgaagcacctgtggtttttcctcctgctggtggcagctcccagatgggtcctgtcccaggtgcagctgcaggagtcgggcccaggactggtgaagcctttggagaccctgtccctctcctgcgttgtctctggttactctctcagagatggttattagttggggctggattcggcgacggaccccccgggaagggacgtgggagtggtagttgtcgtttttagttatcatacgtgggacgccaacccactaaccaaccccgtccctacgaggacgtcgacgtcatcatatcagtacgacccgtacaacgaacctacgttcctacccgtagaacgtctaggtaacgttcgtacgtaccgacccctagcaacgaccgaccggccgtacgttaattcgtggtacgcggagacggtctacgtcgacgtagtagtacgtttggttccgtcggcccggttatagttagttaacttacgttactaccggttaacggtagtacggtacggttccggtacggggtaaccgaacggggtacccgtaccgggtaccctaccccgg

SEQ ID NO: 235894 - DNA, 629 bp, Homo sapiens
  misc_feature: GYAE6OF02G3VSD.6.43.D10.1.454.CMB.1.raw
  modified_base (544)..(544): a, c, t, g, unknown or other
  misc_feature (544)..(544): n is a, c, g, or t
tcagatatcgcgagcacgaccggtgctcgatttagactagcagtaagggggctttctgagagtcatggacctcctgtgcaagaacatgaagcacctgtggtttttcctcctgctggtggcagctcccagatgggtcctgtcccaggtgcagctgcaggagtcgggcccaggactggtgaagcctttggagaccctgtccctctcctgcgttgtctctggttactctctcagagattggttattagttggggctggtattcggcacggccccccgggaagggacgtggagtggtattgtcgtttttagttatctatacgtgggacgccacccactacctaaccccgtccctcgaggacgtcgagtcatcatatcaagtacgacccgtacaaacgaacctacgttcctaccgtagaacgtctagaacgtcctgtaccgtaccccgtgaccgaacggaccgaccgggcccgtacggttaacttacgtgtcggacggaggtacggtctcgtgacgtaggttagtgtttcggttcgtccgcccggttanaacgttagtaacttacgtaacttccgtaaggttagtacgtagggtcggtacggggaaccgaacgggaccgtacggtccgtacccg

SEQ ID NO: 235895 - DNA, 867 bp, Homo sapiens
  misc_feature: GYAE6OF02HKEO9.6.43.D10.1.454.CMB.1.raw
tcagatatcgcgagcacgaccggtgctcgatttagactagcagtaagggggctttctgagagtcatggacctcctgtgcaagaacatgaagcacctgtggtttttcctcctgctggtggcagctcccagatgggtcctgtcccgaggtgcagctgcagggagtccgggcccaggacgtggtgaagcctttggacgaccctgtccctctcctgtcgttgtctcttcggttactctctacgagagagttggttaattagttgggggctggtacgtttcggaccgaccgggacccccccgggggaaggggaccgttaggggtacggtagggtacgtttggttaccgttttttaagtttactaccgtaagttaccggtaggggaaccgacccgtaaccccctaaccgttaaccccgtaaacccccggttccctaccggtaacggggtacggttaccggtaacggttacctaactaccgtaacttaacgtaccgtaacggtaaacccggtaacccccgttaaccgaaaaccggtaaccccgttaccggtttacccgtaccccgtaacgggtaaacgtccgttaacggtaacgtttaccggtaccggttacccggtacccccggttagaccggaccgaaccgggacccgggtacccggttacgtttaacgtttaccgtcggtacggtccgggtaacggtacgggtcttaccggtcggtaacgtaggtaacggttcgtttaccgggttcgtacccgggtaccgttaacgtagtttacgttaacgtttaaccttagtaccgtaacggttaagtacggttagggttccggaccgggtaaccggaacggtacccgttaccggtacccgtaaccccgg

SEQ ID NO: 235896 - DNA, 625 bp, Homo sapiens
  misc_feature: GYAE6OF02G170R.6.43.D10.1.454.CMB.1.raw
tcagatatcgcgagcacgaccggtgctcgatttagactagcagtaagggggctttctgagagtcatggacctcctgtgcaagaacatgaagcacctgtggtttttcctcctgctggtggcagctcccagatgggtcctgtcccaggtgcagctgcaggagtcgggcccaggactggtgaagcctttggagaccctgtccctctcctgcgttgtctctggttactctctcagagtatggttattagttgggggtctgggtagttcggcgtacggcccccccggggaagggaccgtgggaggtggattcgtctttttagttactctatacgtgggagccacccactaaccaacccgtccctcacggagtcgagtcatcatatacagtacgacccgtacaacgaacctagttcctaccctagaacgctagaactctgtaccgcccctgcagaccaccggccgtacgtacttacgtcgtcgacgaggacgctcgtacgcgagtagtacgttgggttacgtcgtcccggtactaagttcgtaactttaccgtaagttaccgtaaggttaagtaggtacggttcggtacggggacccggtaacgggacccgtaccgggtaccctaccccgg

SEQ ID NO: 235897 - DNA, 783 bp, Homo sapiens
  misc_feature: GYAE6OF02H1UEV.6.43.D10.1.454.CMB.1.raw
  modified_base (216)..(216): a, c, t, g, unknown or other
  misc_feature (216)..(216): n is a, c, g, or t
  modified_base (220)..(220): a, c, t, g, unknown or other
  misc_feature (220)..(220): n is a, c, g, or t
tcagatatcgcgagcacgaccggtgctcgatttagactagcagtaagggggctttctgagagtcatggacctcctgtgcaagaacatgaagcacctgtggtttttcctcctgctggtggcagcctccagatgggtcctgtcccaggtgcagctgcaggagtccgggcccaggactggtgaagcctttggacgtaccctgtccctctcctgtcgttntctntcggttactctctacagagtagttggttattaggtggggcgtggtacgttcggccgaccggtaccccccggggaagggtaccgtgggtaggtcggtagtttcgttacgttttagttactactaagttacggtagggacgacccaaccctacctaaccgtaaccccgtcccgtacgacggtacgtacgagtactactacctattacgtacgtacgtaacccggtacccgtaacccgtaaaacgtaacccgtaccgttacccgttacccgtaggtaaacggtcctaaggtacgtttaccgttccggtacccgtaaccccgtggaccgaacgacccggaccgtaccgtacggttacttacgtcggttacggacggtaacggtcggtcgttcgtacgtcggtaacggttacgtacgtttccggttccggtaccgggtacccgttacgttaacgttcggtttaaccttagtaaccggtacggttaacgggttaacgttaagggtccgggttacggtaccgggggacccggtaaccggggtaacccgtcccgggttaccgtacccccgg

SEQ ID NO: 235898 - DNA, 687 bp, Homo sapiens
  misc_feature: GYAE6OF02IUF71.6.43.D10.1.454.CMB.1.raw
tcagatatcgcgagcacgaccggtgctcgatttagactagcagtaagggggctttctgagagtcatggacctcctgtgcaagaacatgaagcacctgtggtttttcctcctgctggtggcagctcccagatgggtcctgtcccaggtgcagctgcaggagtcgggcccaggactggtgaagcctttggagaccctgtccctctcctgcgttgtctctggttacctctctcagagattggttattgttgggctggattcggcacggcccccgggaagggactggagtggattgtcgttttagtatcatacgtgggacgtccaaccctactaaccaacccgtccctacgaggagtcgaagtcatcatactcagtacgacccgtacaaacgtaacctacgttcctaccctaggaacgtactacggtaacgttcgtcggttaccggtaccccttacggacgaaccgggtaaccgtaacccgggccccggtacgtttaacggtttaccttgggtcgaccggtacgtacgggccttcggtacgacgtagtacggtacgttacggtttccgtacggcccgggttactaacgttacgtttaataccgttacgttaccgtaacgggttacgtaacggtaggttaccggttacggggaccggtaacggggtaacccgtacgggtccgtaaccccggg

SEQ ID NO: 235899 - DNA, 818 bp, Homo sapiens
  misc_feature: GYAE6OF02HQ7RW.6.43.D10.1.454.CMB.1.raw
  modified_base (353)..(353): a, c, t, g, unknown or other
  misc_feature (353)..(353): n is a, c, g, or t
tcagatatcgcgagcacgaccggtgctcgatttagactagcagtaagggggctttctgagagtcatggacctcctgtgcaagaacatgaagcacctgtggttttcctcctgctggtggcagctacccagatgggtcctgtcccaggtgcagctgcaggacgtcggcccaggactggtagaagcctttggacgaccctcgtcccctctccgtgtcgttcgtctcgttacggttacttcctctcgagagtattgttattagttggggcgtggtagttcggccgaccgggtacccccgggaagggtacgtcggtaggtggtagttgtcgttttagttactctagttacgtaggacncctaaccgtacctaaccgtacccccgtaccgtacgacggtacgtacgacgtcgactaccgtaatactaccgtaacggtaaccgtacccgtaaccgtaaacgtaacccgtacgtttaccctcccgtaggaaccgtacgtacgtaacgtttcggtacgttacccggtaacccctgtaccgaacggaacccggtaccggtaccccggtaacgtttaactttacccgggtaggttacccgggacgtaacgggtccgggtaccgttacggtacgtaccgtaaaagggtcgttacggtttacgggtttacccggttccggtaccccgggttaacttaaccggttacgtttaactttaaccgtcgttaaccgggttaaggtaaccggtttaacgggtccgggtaaccggggtacccggggtaaccccggtaaacgggggtaccccgtttaccgggtacccccgttaacccgg

SEQ ID NO: 235900 - DNA, 802 bp, Homo sapiens
  misc_feature: GYAE6OF02H39ZY.6.43.D10.1.454.CMB.1.raw
  modified_base (178)..(178): a, c, t, g, unknown or other
  misc_feature (178)..(178): n is a, c, g, or t
tcagatatcgcgagcacgaccggtgctcgatttagactagcagtaagggggcgtttctgagagtcatggacctcctgtgcaagaacatgaagcacctgtggtttttcctcctgctggtggcagctcccagatgggtcctgtcccaggtgcagctgcaggagtccgggcccaggctggngaagcttaggagaccctcgtccctctccgtgcgttgtctcgtcgttactctctcagagattggttattagttggggctggtacgttcggccaccgggtaccccccggggaaggggtaccgtagggtacggtgggtaagtttggttacgtttttagttaacgtactaagttaaccggtggggtacacccgtaaccccctaaccgtaacccgtaacccccgttacccgtacgtaacgggacgtacgtaacgtacaactacgtaactatactacgaccgtaacccgtaaccgaacgtaaaccgtacgtttccacccgtagaacgtacgtagtaacgtccttcggtacccgtacccgtgtaaccgacggaacccgccgggtacccgtcgttaacgtttacgacggtaccggtacgaacgggtaccgtcgttccgtaggttaccgaagggtttcggtaacgtttttccgggtaaccgggttcccggttaacccccggttaagtaaccggttacgtttaaactttccgtaacggtttaccggtaccgggttaaagttacggggtaacggttaccgggtaccgggggaaccggtaaaccgggacccgtaaccgggtaccgttaacccccgg

SEQ ID NO: 235901 - DNA, 600 bp, Homo sapiens
  misc_feature: GYAE6OF02FS7QS.6.43.D10.1.454.CMB.1.raw
  modified_base (505)..(505): a, c, t, g, unknown or other
  misc_feature (505)..(505): n is a, c, g, or t
tcagatatcgcgagcacgaccggtgctcgatttagactagcagtaagggggctttctgagagtcatggacctcctgtgcaagaacatgaagcacctgtggtttttcctcctgctggtggcagctcccagatgggtcctgtcccaggtgcagctgcaggagtcgggcccaggactggtgaagcctttggagaccctgtccctctcctgcgttgtctctggttactctctcagagtatggttattattggggctggtacttcggctacgccccccgggaagggacgtggagtggtattgtcttttagtatcatacgtgggagcacccactaccaacccgtccctcgaggtacgtcgagtcatcatatcagtacgacccgtaccaaacgaacctagttacctccctagaacgtcgtacgaacgtctgtacgtacccctgacacgaccgaccggccgtacgttacttacgtgtacgcgagacggctcgtgctaggtacgtacgtgttcncggtcccgtagtagttcgtacttacgtaacgtacgtaacggtaatacggtaggtcgtacgggaacccgtaacgggaccgtacggtcctaacccgg

SEQ ID NO: 235902 - DNA, 697 bp, Homo sapiens
  misc_feature: GYAE6OF02JXM6D.6.43.D10.1.454.CMB.1.raw
  modified_base (159)..(159): a, c, t, g, unknown or other
  misc_feature (159)..(159): n is a, c, g, or t
  modified_base (251)..(251): a, c, t, g, unknown or other
  misc_feature (251)..(251): n is a, c, g, or t
  modified_base (305)..(305): a, c, t, g, unknown or other
  misc_feature (305)..(305): n is a, c, g, or t
  modified_base (387)..(387): a, c, t, g, unknown or other
  misc_feature (387)..(387): n is a, c, g, or t
  modified_base (394)..(394): a, c, t, g, unknown or other
  misc_feature (394)..(394): n is a, c, g, or t
  modified_base (482)..(482): a, c, t, g, unknown or other
  misc_feature (482)..(482): n is a, c, g, or t
  modified_base (517)..(517): a, c, t, g, unknown or other
  misc_feature (517)..(517): n is a, c, g, or t
tcagatatcgcgagcacgaccggtgctcgatttagactagcagtaagggggctttctgagagtcatggacctcctgtgcaagaacatgaagcacctgtggtttttcctcctgctggtggcagcctccagatgggtcctgtcccaggtgcagctgcaggngtcgggcccaggtactggtgaagtcctttggagacccctgtccctctccgtgcgttgtctcgtaggtcctctctcagagtagtgttacgttnttggggtcgtgtgttccgtcgaccgacccccgggacggagtgaggtcgtagttnttcgtttagtttacgctacgtagtaccggtaggcctaaccccaccttaactaaccccgtccccgtctagggaacgtcgtacnctaactnacgttagtctaggtaaccgtacccgaccgtaacaaaccgtcttcctcccgagtagacgttgaacgtcgtctaccggaccccctggtanaaaccggccgaaccgtccggggtcttaacggtttntacgggtaccggcgaaacggtccgtacggttctcgggaaacgttcgttaaaggtcgggttttacgccccgtttagggaccccgttattaatcggtttaaatttaccgaagtttcggaaccggtttgtaacgggtgttacccgggtcgggaacccgaggggtacccctaggcccgttaccg

SEQ ID NO: 235903 - DNA, 880 bp, Homo sapiens
  misc_feature: GYAE6OF02G9BJ6.6.43.D10.1.454.CMB.1.raw
  modified_base (160)..(160): a, c, t, g, unknown or other
  misc_feature (160)..(160): n is a, c, g, or t
  modified_base (691)..(691): a, c, t, g, unknown or other
  misc_feature (691)..(691): n is a, c, g, or t
tcagatatcgcgagcacgaccggtgctcgatttagactagcagtaagggggctttctgagagtcatggacctcctgtgcaagaacatgaagcacctgtggtttttcctcctgctggtggcagctcccagatcgggtcctgtcccaggtgcagctgcaggnggtcgggccaggactgggtgaagtccgtttggacgacccttgtccctctcctgcgttgtctcgtcggttactctctcagtagtacgttggtttattaggttgggggtactgggtagtttcgggaccaccgggtaccccccggggaagggaccggtaggtaggtggtagtttggttaccgtttttagttacgttactagttaccggttggggtaccgccctaaccccgtaactaaccccgtaaccccggttccccgacggtaacgggtacgtaccggtaacgtcctacggtacctaagttaacttccggaaaggttaacccgtaccccgtaaccggtaaaacgtaacccctaaggtttaccccttaaccggtacgtaaaccggtcctacgggttaaaccttccggttacggttaaccccggaccccgtttcggaacgaaccggtaacccggtacccgggtacccggtacgtttaaacgtttaccttaggggtaccggtaacggaaaccgggtcgggttcccttggggtaccncggtaaacggttacggggttaactttccgggggttactccccgggtttaaccgtactttaaggttacgtttagtttaccgttaacgtaccgggttaaaccgggttattaaccggggggtacggtttaccgggtaacggggggtaaccccgttaaggggaccccgttaccggtaccccgttaaccccggg

SEQ ID NO: 235904 - DNA, 181 bp, Homo sapiens
  misc_feature: GYAE6OF01BD2PQ.46.5.A05.1.454.CMB.1.raw
  modified_base (179)..(181): a, c, t, g, unknown or other
  misc_feature (179)..(181): n is a, c, g, or t
tcagactagcagtacacgaccggtgctcgatttagatagatagacagggcaccaagggcccatcggtcttccccctggcaccctcctccaagagcacctctggggcacagcggccctgggctgcctggtcaaggactacttcctacgtgagctctgagcgggctggcaaggcgcatagnnn

SEQ ID NO: 235905 - DNA, 254 bp, Homo sapiens
  misc_feature: GYAE6OF02FNM22.46.5.A05.1.454.CMB.1.raw
  modified_base (250)..(254): a, c, t, g, unknown or other
  misc_feature (250)..(254): n is a, c, g, or t
tcagactagcagtacacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgcatctgaacgcactcgtctgagcgggctggcaaggcgcatagnnnnn

SEQ ID NO: 235906 - DNA, 425 bp, Homo sapiens
  misc_feature: GYAE6OF01CORIE.45.53.E09.1.454.CMB.1.raw
  modified_base (421)..(425): a, c, t, g, unknown or other
  misc_feature (421)..(425): n is a, c, g, or t
tcagacgcgatcgacacgaccggtgctcgatttagagagagtgtgatgggatggatcaacgctggcactggttacacagaatattcacagaaattccaggacagagtcaccatttctagggacatattcgcgaacacagcctacatggacctgagcagtttgagatctgacgacacggctgtctattactgtgcgagagacggggggaggatattgcactaatgattatactgtgtgccatgggttgagctcctggggccagggaacccctggtcaccgtctcctcagcctccaccaagggcccatcggtcttccccctggcgccctgctccaggagcacctcgagagcacagcggccctgggctgcctggtcaaggactacttctcgatcgcgtctgagcgggctggcaaggcgcatagnnnnn

SEQ ID NO: 235907 - DNA, 320 bp, Homo sapiens
  misc_feature: GYAE6OF01BKWQX.45.53.E09.1.454.CMB.1.raw
  modified_base (282)..(320): a, c, t, g, unknown or other
  misc_feature (282)..(320): n is a, c, g, or t
tcagacgcgatcgacacgaccggtgctcgatttagagagagtgtggttgggggagggatattgcactaatgattatactgtgtgcctatgggttgagctcctggggccagggaaccctggtcaccgtcgtcctcagcctccaccaagggcccatcggtcttcccctggcgccctgctccagggagcaccgtccgagagcacagcggccctgggctcgcctggtctaaaggactacttcctcgaatcgcgtactgagcgggtctggcaaaggcgacaataggnnnnnnnnnnnnnnnnnnnnnnnnnnnnnnnnnnnnnnn

SEQ ID NO: 235908 - DNA, 279 bp, Homo sapiens
  misc_feature: GYAE6OF01CD6Q7.45.53.E09.1.454.CMB.1.raw
  modified_base (272)..(279): a, c, t, g, unknown or other
  misc_feature (272)..(279): n is a, c, g, or t
tcagacgcgatcgacacgaccggtgctcgatttagagagagtgtgttgggtttgggagggatattgcactaatgattatactgtgtgccatgggttgagctcctggggccagggaaccctggtcaccgtctcctcagcctccaccaagggcccatcggtcttccccctggcgccctgctccaggagcacctccgagagcacagcggccctgggctgcctggtcaaggactacttcctcgatcgcgtctgagcgggctggcaaggcgcatagnnnnnnnn

SEQ ID NO: 235909 - DNA, 176 bp, Homo sapiens
  misc_feature: GYAE6OF01BC9YM.45.53.E09.1.454.CMB.1.raw
  modified_base (175)..(176): a, c, t, g, unknown or other
  misc_feature (175)..(176): n is a, c, g, or t
tcagacgcgatcgacacgaccggtgctcgatttagagagagtgtgttgggtttgggggaagaggaagactgacggtcctgctccaggagcacctccgagagcacagcggccctgggctgcctggtcaaggactacttcctcgatcgcgtctgagcgggctggcaaggcgcatagnn

SEQ ID NO: 235910 - DNA, 270 bp, Homo sapiens
  misc_feature: GYAE6OF01BNVK4.45.53.E09.1.454.CMB.1.raw
tcagacgcgatcgacacgaccggtgctcgatttagagagagtgtgttgggtttgggagggatattgcactaatgattatactgtgtgccatgggttgagctcctggggccagggaaccctggtcaccgtctcctcagcctccaccaagggcccatcggtcttcccctggcgccctgctccaggagcacctccgagagcacagcggccctgggctgcctggtcaaggactacttcctcgatcgcgtctgagcgggctggcaaggcgcatag

SEQ ID NO: 235911 - DNA, 150 bp, Homo sapiens
  misc_feature: GYAE6OF01BTGZT.45.53.E09.1.454.CMB.1.raw
  modified_base (142)..(150): a, c, t, g, unknown or other
  misc_feature (142)..(150): n is a, c, g, or t
tcagacgcgatcgacacgaccggtgctcgatttagagagagtgtggttgggtttgggggaagaggaagactgacggccctgggctgcctggtcaaggactacttcctcgatcgcgtctgagcgggctggcaaggcgcatagnnnnnnnnn

SEQ ID NO: 235912 - DNA, 503 bp, Homo sapiens
  misc_feature: GYAE6OF01BYREU.45.53.E09.1.454.CMB.1.raw
tcagacgcgatcgacacgaccggtgctcgatttagagagagtgtgttgggtttggggacccaacaaccacatccctcctcagaagccccagagcacaactcctcaccatggactggacctggaggatcctcttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtgcgccaggcccccggacaagggcttgagtggatgggatggatcaacgctggcactggttacacagaatattcacagaaattccaggacagagtcaccatttctagggacatattcgcgaacacagcctacatggacctgagcagtttgagatctgaccgacacggtctgtctattactgtgcgagaggacgggggggaggagtagttgcactaatgattatactgtgtcg

SEQ ID NO: 235913 - DNA, 224 bp, Homo sapiens
  misc_feature: GYAE6OF01D2HV1.45.53.E09.1.454.CMB.1.raw
  modified_base (223)..(224): a, c, t, g, unknown or other
  misc_feature (223)..(224): n is a, c, g, or t
tcagacgcgatcgacacgaccggtgctcgatttagagagagtgtgttgggtttgggtgccgaagttgctggaggtcaccgtctcctcagcctccaccaagggcccatcggtcttcccctggcgccctgctccaggagcacctccgagagcacagcggccctgggctgcctggtcaaggactacttcctcgatcgcgtctgagcgggctggcaaggcgcatagnn

SEQ ID NO: 235914 - DNA, 445 bp, Homo sapiens
  misc_feature: GYAE6OF01EFQRE.45.53.E09.1.454.CMB.1.raw
  modified_base (403)..(403): a, c, t, g, unknown or other
  misc_feature (403)..(403): n is a, c, g, or t
  modified_base (414)..(414): a, c, t, g, unknown or other
  misc_feature (414)..(414): n is a, c, g, or t
  modified_base (434)..(434): a, c, t, g, unknown or other
  misc_feature (434)..(434): n is a, c, g, or t
  modified_base (436)..(445): a, c, t, g, unknown or other
  misc_feature (436)..(445): n is a, c, g, or t
tcagacgcgatcgacacgaccggtgctcgatttagagagagtgtgatgggatggatcaacgctggcactggttacacagaatattcacagaaattccaggacagagtcaccatttctagggacatattcgcgaacacagcctacatggacctgagcagtttgagatctgacgacacggctgtctattactgtgcgagaggacgggggggaggatattgcactaatgattatactgtgtgccatgggttgagctccgtggggccagggaccctggtcaccgtctcctcagcctccaccgaacgggcccagtccggtcttccccctggccgcccctgacctccgaggacgccacctccgagagcacagccggccctgggctgacctggtcaaggacctacttccncgatcgcgtcngagcgggctggcaggcgcangnnnnnnnnnn

SEQ ID NO: 235915 - DNA, 141 bp, Homo sapiens
  misc_feature: GYAE6OF01BQ7GZ.45.53.E09.1.454.CMB.1.raw
  modified_base (141)..(141): a, c, t, g, unknown or other
  misc_feature (141)..(141): n is a, c, g, or t
tcagacgcgatcgacacgaccggtgctcgatttagagagagtgtgttgggtttgggggaagaggaagactgacggccctgggctgcctggtcaaggactacttcctcgatcgcgtctgagcgggctggcaaggcgcatagn

SEQ ID NO: 235916 - DNA, 226 bp, Homo sapiens
  misc_feature: GYAE6OF01A5ANV.45.53.E09.1.454.CMB.1.raw
  modified_base (223)..(226): a, c, t, g, unknown or other
  misc_feature (223)..(226): n is a, c, g, or t
tcagacgcgatcgacacgaccggtgctcgatttagagagagtgtgttgggtttgggtgccgaagttgctggaggtcaccgtctcctcagcctccaccaagggcccatcggtcttcccctggcgccctgctccaggagcacctccgagagcacagcggccctgggctgcctggtcaaggactacttcctcgatcgcgtctgagcgggctggcaaggcgcatagnnnn

SEQ ID NO: 235917 - DNA, 272 bp, Homo sapiens
  misc_feature: GYAE6OF01CEXGE.45.53.E09.1.454.CMB.1.raw
  modified_base (272)..(272): a, c, t, g, unknown or other
  misc_feature (272)..(272): n is a, c, g, or t
tcagacgcgatcgacacgaccggtgctcgatttagagagagtgtgttgggtttgggagggatattgcactaatgattatactgtgtgccatgggttgagctcctggggccagggaaccctggtcaccgtctcctcagcctccaccaagggcccatcggtcttccccctggcgccctgctccaggagcacctccgagagcacagcggccctgggctgcctggtcaaggactacttcctcgatcgcgtctgagcgggctggcaaggcgcatagn

SEQ ID NO: 235918 - DNA, 611 bp, Homo sapiens
  misc_feature: GYAE6OF01B4X4Y.45.53.E09.1.454.CMB.1.raw
tcagacgcgatcgacacgaccggtgctcgatttagagagagtgtgttggggtttggggactgatcaggactcctcagttccaccttctcactaatgaggctccctgctcagctcctggggctggctaatgctctgggtctctggttccagtcggggatattgtgatgactcagtctccactctccctgcccgtcacccttggacagccgctcatctctgcagtctagtcaaagcctctatacaggatggaaacactcacttcgaattcggtttcaactagaggccaggccaaagtccgtccgaaggccgacctaatttataaggtttctaaccgggactcgtcgggtccagacagtatcagtcggacagtcggtcaggcacgtgactttacaactactagaaacgttagtaagggtaggtaggactagaggtaagtgttagggtagtttaatttcgttcgtctattcggtacgtaacgggtaaccaacgaacgtaggtacccgttaacgtacgttttacggaccgtacgggaccgtaagtccgtaggaaacgtacgtaaacgtaacgtacgttaggtacctacgtaccacctattcgtcgtctttaacccg

SEQ ID NO: 235919 - DNA, 224 bp, Homo sapiens; identical to SEQ ID NO: 235913
  misc_feature: GYAE6OF01DQJZM.45.53.E09.1.454.CMB.1.raw
  modified_base (223)..(224): a, c, t, g, unknown or other
  misc_feature (223)..(224): n is a, c, g, or t

SEQ ID NO: 235920 - DNA, 227 bp, Homo sapiens
  misc_feature: GYAE6OF01C3WNM.45.53.E09.1.454.CMB.1.raw
  modified_base (224)..(227): a, c, t, g, unknown or other
  misc_feature (224)..(227): n is a, c, g, or t
tcagacgcgatcgacacgaccggtgctcgatttagagagagtgtgttgggtttgggtgccgaagttgctggaggtcaccgtctcctcagcctccaccaagggcccatcggtcttccccctggcgccctgctccaggagcacctccgagagcacagcggccctgggctgcctggtcaaggactacttcctcgatcgcgtctgagcgggctggcaaggcgcatagnnnn

SEQ ID NO: 235921 - DNA, 141 bp, Homo sapiens; identical to SEQ ID NO: 235915
  misc_feature: GYAE6OF01DE1IT.45.53.E09.1.454.CMB.1.raw
  modified_base (141)..(141): a, c, t, g, unknown or other
  misc_feature (141)..(141): n is a, c, g, or t

SEQ ID NO: 235922 - DNA, 460 bp, Homo sapiens
  misc_feature: GYAE6OF01C9PW2.45.53.E09.1.454.CMB.1.raw
  modified_base (325)..(325): a, c, t, g, unknown or other
  misc_feature (325)..(325): n is a, c, g, or t
  modified_base (446)..(460): a, c, t, g, unknown or other
  misc_feature (446)..(460): n is a, c, g, or t
tcagacgcgatcgacacgaccggtgctcgatttagagagagtgtgatgggatggatcaacgctggcactggttacacagaatattcacagaaattccaggacagagtcaccatttctagggacatattcgcgaacacagcctacatggacctgagcagtttgagatctgacgacacggctgtctattactgtgcgagaggacgggggggaggatattgcactaatgattatactgtgtgccagtgggttgagctccgtggggccagggaacccctggtccaccgtctcctcagcctccaccaagggcccatccggtcttcccccnggccgccctgctccgaggcgccacctccgagacgcacgagccggccctgggcctgccgttggtacaaggacctaccttcctcgacgtcgcgcgtgacggcgggcgtggcaaggcgcatagnnnnnnnnnnnnnnn

SEQ ID NO: 235923 - DNA, 270 bp, Homo sapiens
  misc_feature: GYAE6OF01CBVTB.45.53.E09.1.454.CMB.1.raw
  modified_base (267)..(270): a, c, t, g, unknown or other
  misc_feature (267)..(270): n is a, c, g, or t
tcagacgcgatcgacacgaccggtgctcgatttagagagagtgtgttgggggagggatattgcactaatgattatactgtgtgccatgggttgagctcctggggccagggaaccctggtcaccgtctcctcagcctccaccaagggcccatcggtcttcccctggcgccctgctccaggagcacctccgagagcacagcggccctgggctgcctggtcaaggactacttcctcgatcgcgtctgagcgggctggcaaggcgcatagnnnn

SEQ ID NO: 235924 - DNA, 224 bp, Homo sapiens
  misc_feature: GYAE6OF01CL0RP.45.53.E09.1.454.CMB.1.raw
  modified_base (223)..(224): a, c, t, g, unknown or other
  misc_feature (223)..(224): n is a, c, g, or t
tcagacgcgatcgacacgaccggtgctcgatttagagagagtgtgttgggtttgggtgccgaagttgctggaggtcaccgtctcctcagcctccaccaagggcccatcggtcttcccctggcgccctgctccaggagcacctccgagagcacagcggccctgggctgcctggtcaaggactacttcctactgctagtctgagcgggctggcaaggcgcatagnn

SEQ ID NO: 235925 - DNA, 224 bp, Homo sapiens; identical to SEQ ID NO: 235924
  misc_feature: GYAE6OF01DW3SD.45.53.E09.1.454.CMB.1.raw
  modified_base (223)..(224): a, c, t, g, unknown or other
  misc_feature (223)..(224): n is a, c, g, or t

SEQ ID NO: 235926 - DNA, 225 bp, Homo sapiens
  misc_feature: GYAE6OF01BHXPB.45.53.E09.1.454.CMB.1.raw
  modified_base (223)..(225): a, c, t, g, unknown or other
  misc_feature (223)..(225): n is a, c, g, or t
tcagacgcgatcgacacgaccggtgctcgatttagagagagtgtgttgggtttgggtgccgaagttgctggaggtcaccgtctcctcagcctccaccaagggcccatcggtcttcccctggcgccctgctccaggagcacctccgagagcacagcggccctgggctgcctggtcaaggactacttcctcgatcgcgtctgagcgggctggcaaggcgcatagnnn

SEQ ID NO: 235927 - DNA, 224 bp, Homo sapiens
  misc_feature: GYAE6OF01EN05A.45.53.E09.1.454.CMB.1.raw
  modified_base (224)..(224): a, c, t, g, unknown or other
  misc_feature (224)..(224): n is a, c, g, or t
tcagacgcgatcgacacgaccggtgctcgatttagagagagtgtgttgggtttgggtgccgaagttgctggaggtcaccgtctcctcagcctccaccaagggcccatcggtcttccccctggcgccctgctccaggagcacctccgagagcacagcggccctgggctgcctggtcaaggactacttcctcgatcgcgtctgagcgggctggcaaggcgcatagn

SEQ ID NO: 235928 - DNA, 198 bp, Homo sapiens
  misc_feature: GYAE6OF01EKRM0.45.53.E09.1.454.CMB.1.raw
  modified_base (197)..(198): a, c, t, g, unknown or other
  misc_feature (197)..(198): n is a, c, g, or t
tcagacgcgatcgacacgaccggtgctcgatttagagagagtgtgttgggtttattactgcatgcaaggtctgcaaatgtcctggagttttggccagggaccaagctggagagcaaacgaactgtggctgcaccatctgtcttcatcttcccgccatctgatcgatcgcgtctgagcgggctggcaaggcgcatagnn

SEQ ID NO: 235929 - DNA, 583 bp, Homo sapiens
  misc_feature: GYAE6OF01BX1T7.45.53.E09.1.454.CMB.1.raw
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
tcagacgcgatcgacacgaccggtgctcgatttagagagagtgtgttgggtttgggggactgatcaggactcctcagttcaccttctcacaatgaggctccctgctcagctcctggggctgctaatgctctgggtctctggttccagtgggatattgtgatgactcagtctccactctccctgtccgtcacccctggagacgccggcctccatcctcctgcagggctagtcagacgcctcctgcatagtaatggatacaactatgtgtattcggtcccgnagaacgccgagggcagtctcacncgctcctgatctatcgtggatctagttccggccccgtccggggtccctggactaggttcaggtggctaggtggttcgaggcacagtatttacactaagaaatcagacgagaggtggagtcgtagaggtagttggtttgggtttattacgtgacgtagtgtacgtaaggtcgtagtacgtaaagttcggtaccgttagggttacggttttacgggaccggtaacggggtaaccgtaacggtcgtagggaacggacggaaccgtaaacggtaacgttacggg

SEQ ID NO: 235930 - DNA, 646 bp, Homo sapiens
  misc_feature: GYAE6OF01BRRB0.45.53.E09.1.454.CMB.1.raw
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtgggatattgtgatgactcagtctccactcctccctgtccgtcacccctggagacgccggcctccatctcctgcagggctagtcagacgcctctgcatagtaatggatacaatatgtggtattggttcctgacagaagccgagggcagtcctccacacgccttcctgtacttcgtacgtcgtagggtacttccgttacgttcccgggccccggttcccggggtacccctaggtaccgtaggtttcgagggttcggacgtagggttcggttaccgaggtactaacgtagttaacttttacgaacgtaagaaaactcgaacgacgtaagggtacggtagggacggtacgtagggtaaggttagtttagggttttacgggtttaattacgtgacgtagtcgacgtaggtactacgactaagttcgtcggttagggttacggtttacgggaccggtaacggggaccgtaaggtcggtaggaagaacggaacgaaacggtgtacggg

SEQ ID NO: 235931 - DNA, 659 bp, Homo sapiens
  misc_feature: GYAE6OF01CO036.45.53.E09.1.454.CMB.1.raw
  modified_base (347)..(347): a, c, t, g, unknown or other
  misc_feature (347)..(347): n is a, c, g, or t
tcagacgcgatcgacacgaccggtgctcgatttagagagagtgtgttgggtttggggacccaacaaccacatccctcctcagaagcccccagagcacaactcctcaccatggactggacctggaggatccttctttttggtggcagcagccacaggtgtccactcccaggtccagcatgtgcagtcgtggggctggaggcgaaagaacgccgtggggcctcgagtgaacggtctcctgcgaaggtcttcgtggactacaccttcaccggtctactatatacacgtgggtgcgacgacggcccctggacgaagggcttggagtggagtggatggatacaaaccctaanaagtggtagacaacgaaacttagcgacaagaagtaacgtttcgaggggacgacggggtaccaaccgtagtacgaacccggaagggaccacggtacccaagtaccgaacgaccaacacggtaccctaacagtacggagtcgacggagccgaggtcgtaggaagtacgttacgaggaccggtaaccgaccgggtaccgttagtacttacgtggtacggaggtaacgggagtacggtaaggtaatttacggttaaggtttttagggaaggtttcgggtttaagtaccggggttaacggttggtcgggtaaccggg

SEQ ID NO: 235932 - DNA, 274 bp, Homo sapiens
  misc_feature: GYAE6OF01DBK9X.45.53.E09.1.454.CMB.1.raw
  modified_base (237)..(237): a, c, t, g, unknown or other
  misc_feature (237)..(237): n is a, c, g, or t
  modified_base (248)..(248): a, c, t, g, unknown or other
  misc_feature (248)..(248): n is a, c, g, or t
  modified_base (270)..(270): a, c, t, g, unknown or other
  misc_feature (270)..(270): n is a, c, g, or t
  modified_base (273)..(274): a, c, t, g, unknown or other
  misc_feature (273)..(274): n is a, c, g, or t
tcagacgcgatcgacacgaccggtgctcgatttagagagagtgtgggggagggatattgcactaatgattatactgtgtgccatgggttgagctccgtggggccagggaaccctggtcaccgtctcctcacgcctccaccgaacgggcccatccggtccttccccctggccgccctgctaccgaggacgcacctccgagagcacagcggcctgggctgcctggcaaggactacttcncgatcgcgtcngaggcggctggcaaggcgctanagnn

SEQ ID NO: 235933 - DNA, 309 bp, Homo sapiens
  misc_feature: GYAE6OF01DJ2MU.45.53.E09.1.454.CMB.1.raw
  modified_base (208)..(208): a, c, t, g, unknown or other
  misc_feature (208)..(208): n is a, c, g, or t
  modified_base (247)..(309): a, c, t, g, unknown or other
  misc_feature (247)..(309): n is a, c, g, or t
tcagacgcgatcgacacgaccggtgctcgatttagagagagtgtgttgggtttgggtcgaccgaagttgctggaggtcaccgtctcctcagcctccaccaagggcccatcggtcttccccctggcgccctcgctaccaggagcacctcggagagcacgagcggccctgggctgcctaggtacaaggacctaacttcctacgagtcggnggtacgaggcgggcgtaggacgaacggcgtacgataggnnnnnnnnnnnnnnnnnnnnnnnnnnnnnnnnnnnnnnnnnnnnnnnnnnnnnnnnnnnnnnn

SEQ ID NO: 235934 - DNA, 227 bp, Homo sapiens; identical to SEQ ID NO: 235920
  misc_feature: GYAE6OF01BJQ0U.45.53.E09.1.454.CMB.1.raw
  modified_base (224)..(227): a, c, t, g, unknown or other
  misc_feature (224)..(227): n is a, c, g, or t

SEQ ID NO: 235935 - DNA, 460 bp, Homo sapiens
  misc_feature: GYAE6OF01E0MQT.45.53.E09.1.454.CMB.1.raw
  modified_base (438)..(438): a, c, t, g, unknown or other
  misc_feature (438)..(438): n is a, c, g, or t
  modified_base (443)..(460): a, c, t, g, unknown or other
  misc_feature (443)..(460): n is a, c, g, or t
tcagacgcgatcgacacgaccggtgctcgatttagagagagtgtgatgggatggatcaacgctggcactggttacacagaatattcacagaaattccaggacagagtcaccatttctagggacatattcgcgaacacagcctacatggacctgagcagtttgagatctgacgacacggctgtctattactgtgcgagagacgggggggaggatattgcactaaatgaattatactgtgtgccatgggttgagctccgtggggccagggaaccctggtcaccgtctcctcacgcctccaccaacgggcccatccggtccttccccctggccgccctgcctccaggacgccacctcccgagacgcacgacgccggccctgggctcgccgtggtcaaggctacttcctcgatcgcgtctggacgcgggctggcgaacggcncatgnnnnnnnnnnnnnnnnnn

SEQ ID NO: 235936 - DNA, 578 bp, Homo sapiens
  misc_feature: GYAE6OF01BAA6W.45.53.E09.1.454.CMB.1.raw
  modified_base (548)..(548): a, c, t, g, unknown or other
  misc_feature (548)..(548): n is a, c, g, or t
  modified_base (556)..(558): a, c, t, g, unknown or other
  misc_feature (556)..(558): n is a, c, g, or t
  modified_base (560)..(561): a, c, t, g, unknown or other
  misc_feature (560)..(561): n is a, c, g, or t
  modified_base (563)..(563): a, c, t, g, unknown or other
  misc_feature (563)..(563): n is a, c, g, or t
  modified_base (565)..(576): a, c, t, g, unknown or other
  misc_feature (565)..(576): n is a, c, g, or t
  modified_base (578)..(578): a, c, t, g, unknown or other
  misc_feature (578)..(578): n is a, c, g, or t
tcagacgcgatcgacacgaccggtgctcgatttagagagagtgtgatgggatggatcaacgctggcactggttacacagaatattcacagaaattccaggacagagtcaccatttctagggacatattcgcgaacacagcctacatggacctgagcagtttgagatctgacgacacggctgtctattactgtgcgagaggacgggggggaggatagttgcactaatgattatactgtgtgccagtgggttgagctccgtggggccagggaaccctggtcaccgtctcctcgacgccctccaaccgaacgggcccagttccggtccctttcccccgtggccccgtcccgtgcctccgaggacgcctacccgtccgagacgcaacgtacggcccgggtccctggggccttcggccgttcgggtaccgaaacgggtacccttaccgtttccccgtcgtaacgttccggtccgttcgtacgggacgggtccggggtaccgttacggggaccgtaacgggtcccggactaaacgggttaggcacgcgacgtgncgcgcgcnnngnngngnnnnnnnnnnnngn

SEQ ID NO: 235937 - DNA, 566 bp, Homo sapiens
  misc_feature: GYAE6OF01A4ORW.45.53.E09.1.454.CMB.1.raw
  modified_base (399)..(399): a, c, t, g, unknown or other
  misc_feature (399)..(399): n is a, c, g, or t
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcgagggctagtcagacgcctcctgcatagtaatggatacaactatgtgattggtcctgcagaagccgagggcagtcctccacagctcctgactctatcgtgggtatctacgttccggccccgtccggggtccctgactaggttcaggtggcaggttggttcgaggcacagtactttacactanaaactcagacagagtggagcgtggaggtagttgggtttagggtttattacgtgtactagtcgtacgtaaggtctaggtactaaagttcgttacgttagggttaggttttacgggaccgggtacgggaaccgtaaggcgtagggagaaggacgtaaaggtacgtacgg

SEQ ID NO: 235938 - DNA, 278 bp, Homo sapiens
  misc_feature: GYAE6OF01EXTNR.45.53.E09.1.454.CMB.1.raw
  modified_base (270)..(278): a, c, t, g, unknown or other
  misc_feature (270)..(278): n is a, c, g, or t
tcagacgcgatcgacacgaccggtgctcgatttagagagagtgtgttgggtttgggagggatattgcactaatgattatactgtgtgccatgggttgagctcctggggccagggaaccctggtcaccgtctcctcagcctccaccaagggcccatcggtcttcccctggcgccctgctccaggagcacctccgagagcacagcggccctgggctgcctggtcaaggactacttcctcgatcgcgtctgagcggctggcaaggcgcatagnnnnnnnnn

SEQ ID NO: 235939 - DNA, 229 bp, Homo sapiens
  misc_feature: GYAE6OF01AUK6K.45.53.E09.1.454.CMB.1.raw
  modified_base (216)..(216): a, c, t, g, unknown or other
  misc_feature (216)..(216): n is a, c, g, or t
  modified_base (222)..(229): a, c, t, g, unknown or other
  misc_feature (222)..(229): n is a, c, g, or t
tcagacgcgatcgacacgaccggtgctcgatttagagagagtgtgttgggtttgggtgccgaagttgctggaggtcaccgtctcctcagcctccaccaagggcccatcggtcttccccctggcgccctgctccaggagcacctccgagagcacagcggccctgggctgcctggtcaaggctacttcctgatcgcgtctgagcgggctggcaaggcncatagnnnnnnnn

SEQ ID NO: 235940 - DNA, 625 bp, Homo sapiens
  misc_feature: GYAE6OF01CWGOB.45.53.E09.1.454.CMB.1.raw
tcagacgcgatcgacacgaccggtgctcgatttagagagagtgtgttgggtttgggggactgatcaggactcctcagttcaccttctcacaatgaggctccctgctcagctcctggggctgctaatgctctgggtctctggttccagtggggatattgtgatgactcagtctccactctccctgtccgtcacccctggagacgcccggcctccatcctcctgcgaggctagtcagacgcctctgcatagtaatggataacaactatggtggtatttcggttcctgacaaggaacgccgagggcacgtcctaccacgacgtcctcctagactctatcgtggtacttcgttacgttcccggccccggttccggggtccctaggacgtacggttcaggtcggacgtaggttgttcgacggtacaacgtaagttaacttttaaccgaacttaaagtaaaactacgaacgacgaaggtagggtagggaggtcgtaggaggttaggtttgggtttagggtttacttacgtgactagtagacgtacgtcgtagactaagtcgttacggtggttaggtttcgggaccggacggggtaaccaggtcggtaaggagaacgacgtaaacggtacgg

SEQ ID NO: 235941 - DNA, 272 bp, Homo sapiens
  misc_feature: GYAE6OF01BDFTA.45.53.E09.1.454.CMB.1.raw
  modified_base (269)..(272): a, c, t, g, unknown or other
  misc_feature (269)..(272): n is a, c, g, or t
tcagacgcgatcgacacgaccggtgctcgatttagagagagtgtgttgggtttgggagggatattgcactaatgattatactgtgtgccatgggttgagctcctggggccagggaaccctggtcaccgtctcctcagcctccaccaagggcccatcggtcttcccctggcgccctgctccaggagcacctccgagagcacagcggccctgggctgcctggtcaaggctacttcctcgatcgcgtctgagcggctggcaaggcgcatagnnnn

SEQ ID NO: 235942 - DNA, 651 bp, Homo sapiens
  misc_feature: GYAE6OF01A39B6.45.53.E09.1.454.CMB.1.raw
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagacgccggcctccatctcctgcagggctagtcagacgcctcctgcatagtaatggaatacatatgtgtattggtctgcagacgccgaggcagtcctcacacgtcctccgtgacttctatcggtgggtacttccgttacgttcccgggccccgttcccggggttccctaggtacgtacggttcgaggtcggcgtaggttcggttcgacggtacgtacgtaagttactttaactacgtaagtaaactacgagacgaggtaggtgggacggtacgtaggacggttaggtttagggtttagggtttattacgtgtacgttagtacggtaacgtaggttacgtacgtaacgtaagttcggttacggttagggtttacgggtttacgggaccgggtaacgggtaaccgtaacggtacggttacgggaaacggtacgaaccgtaaacggtaacggttacggg

SEQ ID NO: 235943 - DNA, 547 bp, Homo sapiens
  misc_feature: GYAE6OF01CF8GW.45.53.E09.1.454.CMB.1.raw
  modified_base (293)..(293): a, c, t, g, unknown or other
  misc_feature (293)..(293): n is a, c, g, or t
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcatttgggtgcgccaggcccccgganaaggggcttggagtggatgggatgggatcaacgctggcacgtggtacacagaatatcacaagaattccgaggacagacgtcacctatttcgagggactatattcgacgaacacacgcctaacagtacggacctagacgctagtttagagtatactgaacgacgacggtctgttctattcgtagtcggcgaggagggacggggggtaggtagtaggttcgactaagttaagttagtattagttactggtgtacgg

SEQ ID NO: 235944 - DNA, 759 bp, Homo sapiens
  misc_feature: GYAE6OF01CEZSB.45.53.E09.1.454.CMB.1.raw
  modified_base (250)..(250): a, c, t, g, unknown or other
  misc_feature (250)..(250): n is a, c, g, or t
tcagacgcgatcgacacgaccggtgctcgatttagagagagtgtgttgggtttgggggactgatcaggactcctcagttcaccttctcacaatgaggctccctgctcagctcctggggctgctaatgctctgggtctctggttccaggtgggatattgtgatgactcagtctccactcctccctgtccgtccacccctggagacggcccggccctccatcctcctgcgacgggctagtcagacgccctcngcatagtaatgataacaactatgtgtattcggttctgcagaacgccgagggcacgtccgtccgcgacgtcctccgtagtacttacgttagtcgtaggggtacttccgttaacgtttccccgggcccccgggttcccggggtaccccgttacggtaaccggttacgggtttaccgagggttcggtaccgttaacgggtttcggttaccggaagggtaccctaacgttaacggtttaactttttaaacccgaaacgttaaaacggaaaaacgttaccgaacggtacgaaacgggtaggggttaaggggacgggttccggttaagggtaagggttaaggttttacgggttttaggggtttaactttacgtcgtacgtagtacggtacgtacggttcgtacgtaacgtacgtcggttaccggttggtttacgggtttacggggaacggtaaccggggtaaccgaacgggtacggtacgggaaggtaaacggaaaccgtaaagggtaacccggg

SEQ ID NO: 235945 - DNA, 188 bp, Homo sapiens
  misc_feature: GYAE6OF01DQYS8.45.53.E09.1.454.CMB.1.raw
  modified_base (175)..(188): a, c, t, g, unknown or other
  misc_feature (175)..(188): n is a, c, g, or t
tcagacgcgatcgacacgaccggtgctcgatttagagagagtgtgttgggtttgggggaagaggaagactgacggtcctgctccaggagcacctccgagagcacagcggccctgggctgccgtggtcaaggctacttcctactgctagtctgagcgggctggcaaggcgcatagnnnnnnnnnnnnnn

SEQ ID NO: 235946 - DNA, 703 bp, Homo sapiens
  misc_feature: GYAE6OF01EQME6.45.53.E09.1.454.CMB.1.raw
tcagacgcgatcgacacgaccggtgctcgatttagagagagtgtgttgggtttggggacccaacaaccacatccctcctcagaacgcccccagagcacaactcctcaccatggactggacctggaggatcctctttttggtggcagcagccacaggtgtccactcccaggtccagcatgtgcagtctggggctgaggcgaagaagccgtggggcctcagtgtaaggtttcctgcaaggcttcgtggatactacgtttcgctcgcccatgccattcagttggggtgccgccacgggccccccggaacgaacggggtcctttggaggtcgggtagtggggatgggatcgaaacgctgggcacgttaggttacaacaaggaacttagttcaactaagaaacttccgaaggacaaggtacgtacaacctatttacgagggaactagttacttcgacgtaacacgaacgacctaacgatacggaccttaggacgtacttacggtttgaacgtacgtacgttacggaaccgtaaccggtaccggtacgtttacggttacgttaagttttaccggttaggttacggacgggttaaacggggaacggggggtaaccgggggggggtaagggttaaaggttacggttagggaccgttaaacggtaaagttacggttaacgtttaaacgtacggttaggttcggttaaccggg

SEQ ID NO: 235947 - DNA, 635 bp, Homo sapiens
  misc_feature: GYAE6OF01E2OBA.45.53.E09.1.454.CMB.1.raw
tcagacgcgatcgacacgaccggtgctcgatttagagagagtgtgttgggtttgggggactgatcaggactcctcagttcaccttctcacaatgaggctccctgctcagctcctggggctgctaatgctctgggtctctggttccagtggggatattgtgatgactcagtctccactctccctgtccgtcacccctggagagcccgctccatctcctgcagggctagtcagagcctcctgcatagtaatggatacaactatgtgattggtcctgcagagccaggcagtctccacagctcctgacttctatcgtgggatcgttacttcccggccccgttcccggggtccctgaccgtacgggttctaggtggacctaggttcgggttaccacgggacctaacgtaagtaactttttaaccgaacttaagaaaactcgaagacgaaggaggtagggagggactaggaggtacgttagggttttacggggtttaacgttacgttcgtacgtagttacggacgtaacgggttctacgacgtaaaacgttcggttaccggttgggttaggtttaccggccgggtaacggggtaccgaaacggtcggtagggaacgtacggtaaccgaaaacgtaaccggg

SEQ ID NO: 235948 - DNA, 583 bp, Homo sapiens
  misc_feature: GYAE6OF01A0LHY.45.53.E09.1.454.CMB.1.raw
  modified_base (387)..(387): a, c, t, g, unknown or other
  misc_feature (387)..(387): n is a, c, g, or t
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctcgcccatcgccattcattgggtgcgccgacgggcccccggacaacggggctttggagtcggagtggggatgggatcgaaacgctggcacgtggtacacagaatattcacagtaaactcagacagagtcactntttacgaggtacatactcgacgaacacacgcctaacacgtcggacctagacgtactagtttgagtacttcgtagaaccgacgacgggtcttagttacttatacgttcgtcgcggtaagggaggggtaacgggggggaaggtagttagtacgacgtaactaagttagttaagtttaagttacgttggtggttaccgg

SEQ ID NO: 235949 - DNA, 601 bp, Homo sapiens
  misc_feature: GYAE6OF01B3DWJ.45.53.E09.1.454.CMB.1.raw
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagagcctggggcctcagtgaaggtttcctgcaaggcttcgtggatacactttcgctgcccatgcctattcagttgggtcgcgccgacggcccccggacgaacgggtcttgaggtggagtggggatggatcgaacgcgtggcgacgtggtacacgaagtaatacttcaacaagtaaacttccgaaggtacaaggtacgtaccacctagtttacgagggacctagttacttcggacgaacacacgacccgtaacacgtcggacctgacgtctaggtttgagtatcgtacgaccgacgacggtcttacgttacttacgttacgtggtgacggagggaagggggacggggggtaaggagttaggtcggaacgtaacgttagtagtattaagtcgttggtcggtacg

SEQ ID NO: 235950 - DNA, 747 bp, Homo sapiens
  misc_feature: GYAE6OF01BM923.45.53.E09.1.454.CMB.1.raw
  modified_base (679)..(679): a, c, t, g, unknown or other
  misc_feature (679)..(679): n is a, c, g, or t
tcagacgcgatcgacacgaccggtgctcgatttagagagagtgtgttgggtttggggacccaacaaccacatccctcctcagaacgcccccagagcacaactcctcaccatggactggacctggagatccttctttttggtggcagcagccacaggtgtccactcccaggtccagcatgtgcagtcgtggggctggaggcgaagaagccgtggggcctcagtgtaaggtttcctgacgaaggtcttacgtggaacttacgtaccttttcgccttcggcccagttcgacctattcgtagtttcggggtgacccggcccgaaccggggcccccccggaaacggtaaacggggtccgttttaggagggttacgggaagttcggggaagttgggaacgtaccgaaacgggtccgttacggggacctaacggtttaacgggttaaacctaaccggaaaggttaaaacttaactttaaccgaaaccgtaaaggtaaaaacctttacccgaaagggtaaaccaaggtaacggttaacccaaccgttaacgttttacggaacgggtaactaagtttacgtttaccggaccgtaaacaaccgaacgtacccgtaacacgtacgggtaccgaggacgtacgtacggtttagagtacgtactacgacgacgtacgcttagtctatctagngtacgagggacgggtagggggacgtaggtagtcgacttaacgaagttagattaacgtgtgttgtacgg

SEQ ID NO: 235951 - DNA, 744 bp, Homo sapiens
  misc_feature: GYAE6OF01ASSMF.45.53.E09.1.454.CMB.1.raw
tcagacgcgatcgacacgaccggtgctcgatttagagagagtgtgttgggtttgggggactgatcaggactcctcagttcaccttctcacaatgaggctccctgctcagctcctggggctgctaatgctctgggtctctggttccagtggggatattgtgatgactcagtctccactctccctgtccgtcacccctggagacgcccggcctccatcctcctgcagggctagtcagacgcctcctgcataagtaatggaatacaactatgtggtattggttcctgacagaacgccagggcagtcctaccacacgtcctcctgtactctatcgtagggtacttacgtacgttccgggccccgttccggggtccctggaccgtaggttcgaggtcggacgtacggttgggttaccgacggtactaacgtagttaacttttaacgaacgttaacgtaaaacttacgtaacggacgtaacgggtaaggtacggggtaacggtaccgttagggtaacgggttaggttttagggttttaacgggggttttaatttaccggttaggtacgtaagttacgggaaccgttaacgggttacgtacggtaaacgtaaacgttaccggtttacccggttaggggtttaaccgggttttacgggaaccccggggtaaccgggggttaaacccgaaccgggttacggttaacggggtaaccggtaaaccggtaacccggttaaaaccggttaaaccggg

SEQ ID NO: 235952 - DNA, 716 bp, Homo sapiens
  misc_feature: GYAE6OF01D3LCG.45.53.E09.1.454.CMB.1.raw
  modified_base (127)..(127): a, c, t, g, unknown or other
  misc_feature (127)..(127): n is a, c, g, or t
  modified_base (159)..(159): a, c, t, g, unknown or other
  misc_feature (159)..(159): n is a, c, g, or t
  modified_base (448)..(448): a, c, t, g, unknown or other
  misc_feature (448)..(448): n is a, c, g, or t
tcagacgcgatcgacacgaccggtgctcgatttagagagagtgtgttgggtttgggggactgatcaggactcctcagttcaccttctcacatgagctcctgctcagctcctggggctgctaatgctntggtctctgttcagtgggatatgtgatgactnagtctccactctcctcgtccgtacacccgtggacgacggccggcctaccacttcctcgtcgcggtacgggtcttacgacgtacggaccgtcccttccgtgcctaagtacgttaagtaggtaactaactaagttaatggtaggtagttcggttcgtacgacgagacgaccgacggacgcgttccacgacgtacgtcctcgtacgtatactacgtcgtacgtacgtacgttacggtcccggtccggtccggtccgtacgacgtacggttacgtacggtgcgtacgggttanccgtaacggtcgtactaacgtactttaacgtaacgtacgtaaagtacgtagacgaggtaaggtaggtagggtacggtaggtacgggtaggtttacggtttacggggtttacgttaacgttcggtacgttaacgtaggtacgtaacggttaccgttagtaccgttaaacgttaggttccggtttacgggtaacgggttttcgggtacccggaaacggggtaaccgtaacggacggtacggaacggacggtaacggtaaaccggtaacgg

SEQ ID NO: 235953 - DNA, 279 bp, Homo sapiens
  misc_feature: GYAE6OF01EMSL0.45.53.E09.1.454.CMB.1.raw
  modified_base (237)..(237): a, c, t, g, unknown or other
  misc_feature (237)..(237): n is a, c, g, or t
  modified_base (272)..(279): a, c, t, g, unknown or other
  misc_feature (272)..(279): n is a, c, g, or t
tcagacgcgatcgacacgaccggtgctcgatttagagagagtgtgttgggtttgggagggatattgcactaatgattatactgtgtgccatgggttgagctcctggggccagggaaccctggtcaccgtctcctcagcctccaccaagggcccatcggtcttccccctggcgccctgctccaggagcacctccgagagcacagccggcctgggctgcctggtcaaggactacttccncgatcgcgtctgagcgggctggcaaggcgcatagnnnnnnnn

SEQ ID NO: 235954 - DNA, 529 bp, Homo sapiens
  misc_feature: GYAE6OF01BUP3E.45.53.E09.1.454.CMB.1.raw
  modified_base (496)..(496): a, c, t, g, unknown or other
  misc_feature (496)..(496): n is a, c, g, or t
  modified_base (499)..(499): a, c, t, g, unknown or other
  misc_feature (499)..(499): n is a, c, g, or t
  modified_base (502)..(508): a, c, t, g, unknown or other
  misc_feature (502)..(508): n is a, c, g, or t
  modified_base (510)..(517): a, c, t, g, unknown or other
  misc_feature (510)..(517): n is a, c, g, or t
  modified_base (519)..(526): a, c, t, g, unknown or other
  misc_feature (519)..(526): n is a, c, g, or t
  modified_base (528)..(529): a, c, t, g, unknown or other
  misc_feature (528)..(529): n is a, c, g, or t
tcagacgcgatcgacacgaccggtgctcgatttagagagagtgtgatgggatggatcaacgctggcactggttacacagaatattcacagaaattccaggacagagtcaccatttctagggacatattcgcgaacacagcctacatggacctgagcagtttgagatctgacgacacggctgtctattactgtgcgagagacgggggggaggatattgcactaatgattatactgtgtgcatgggttgagctccgtggggccagggaacccctggtccaccgtctcctcacgcctccaccgacggcccagtccggtccttccccgtggccgtcccctgcctccgaggacgccaccgtccgagacgcacgacggccgacccgtgggcctcgccgttggtaccgaacgggtaccttaaccgttccctcggtaacttcccggcgttacgtcggacgggccggggtccgtggggaccgtaacggcccggacgaagtacggngcncgnnnnnnngnnnnnnnncnnnnnnnngnn

SEQ ID NO: 235955 - DNA, 728 bp, Homo sapiens
  misc_feature: GYAE6OF01D36VX.45.53.E09.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
tcagacgcgatcgacacgaccggtgctcgatttagagagagtgtgttgggtttggggacccaacaaccacatccctcctcagaacgcccccagagcacaactcctcaccatggactggacctggaggactccttctttttggtggcagcagccacaggtgtccactcccaggtccagcatgtgcagtcgtgggctgaggcgaagagccgtgggcctgagtgtaagttccngacagtcttcgnggactactactttcgctcgcccatcgcctattcgtagttgggtcgccgaccgaccggcccccggagtaagggtcgttggaggtaggtacgtgggagtcggaacgtaccgaacgtcgtaggacctaacggttacggttaacaaagtaacgtaaattaacgttaacaaacgttaacgtaaaaccgttaccgaacggtaacgaacggtaccgttacctaaccgttaacgtttacggaacgggtaactacgtaacgtttccggaacgtaaaccgacgtaaccgtacctaatacgttaacggaccgtacggaacgtacgttacggtttaggaacgtacgttacggtaaccggaacgtaccggtaccgggttctttacggttaacttaacgttacggtaggtacggacggtaaggggacgggggtaacgggggtagtagttacggtagacgttaaacgtaagttacttaacgttagtagttcgttggtacgg

SEQ ID NO: 235956 - DNA, 882 bp, Homo sapiens
  misc_feature: GYAE6OF01CLAQD.45.53.E09.1.454.CMB.1.raw
  modified_base (243)..(243): a, c, t, g, unknown or other
  misc_feature (243)..(243): n is a, c, g, or t
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtcgtggggctgaggcgaagaagccgtggggcctcagtgaaggtttcctgcaaggcttcgnggatactactttcgctgcccatgcctattcagtttgggtagtccgcccgtacgggccccccggaacgaacggggtctttcggaggtcgggtaggtaggggagtggactacgaaccggtcgtgggacctacggtaggttaacaaccgtaagtaaattactttaccgaaacgtaacgtaaaacgtttacccgaaaggtaacgaaacggtaacgttaccgaacccgtttaagttttaccggtaaacggggtaacttaacgtttaaccgtttaccggaaccggtaaaaccaaccgtaaccggtaacccttaaaccggaacgttacgggtaacccgttaagggtaaccgtacggttaacgggttttacgaacggttaacgttaccggttaaccggaacccgggtaaccggtaacccggggttacgtttacgggttttaacccgtttaaacgttttaccggttaacgggttaccggggtaaaccggggtaaacggggggtaaaccgggggggtaaacggggggggggggttaacggggttaacggttttaacgggttaacgggttaaaccgttaaaaccggtttaaagtttacgggttaaaacttttaacggttaaccggttttgggttaccggtttaaaccggg

SEQ ID NO: 235957 - DNA, 617 bp, Homo sapiens
  misc_feature: GYAE6OF01BML2B.45.53.E09.1.454.CMB.1.raw
  modified_base (232)..(232): a, c, t, g, unknown or other
  misc_feature (232)..(232): n is a, c, g, or t
  modified_base (418)..(418): a, c, t, g, unknown or other
  misc_feature (418)..(418): n is a, c, g, or t
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtcgtggggctgaggcgaagaagccgtggggcctcagtgaacggtttccngcaaggtcttcgtggatactacgtttcgctcgcccagtcgtcctattcagttgggtcgccgccgacggcccccggagacgggtcttcggagtgggagtgggatggatcgaacgtcgtcgcacgtaggttacacgaagtaatatacaacgtaagtaaacttccgaggaacgtagacgtacaaccttntttacgtaggactagtactcgacaacacacggactaacgagtcgaccgtgtacgacgtagttgagtatcgaacgacgtacgaccgtgtacgttacttacgttacgtaggtcggtacggaggaagggggacgggggtaggtacggttagtcgtacgtaacgttaagttacggtactttaagggtacttggttgtaccggg

SEQ ID NO: 235958 - DNA, 678 bp, Homo sapiens
  misc_feature: GYAE6OF01A8KY5.45.53.E09.1.454.CMB.1.raw
  modified_base (540)..(540): a, c, t, g, unknown or other
  misc_feature (540)..(540): n is a, c, g, or t
tcagacgcgatcgacacgaccggtgctcgatttagagagagtgtgttgggtttggggacccaacaaccacatccctcctcagaacgccccagagcacaactcctcacatggactggacctggaggatccttctttttggtggcagcagccacaggtgtccacctcccagggtccagcatgtgcagtcgtggggctggagggcgaaggaacgccggtggggcctcgagtaggtaacggtttcctgactaaggtcttcgtaggatacctacttcgctcgccctatcgcctattcgtaggttcgggtcgccggtacccggaccggacccccgggaacgtaacgggtcgttcggaggttggaggtagggtagtggacgtacgacggcgtggaccgtacgttacgtacaacgtaataagttactacaataacgtaaactacggaacgacgaacgtactacgtactagtttaccggtaaggtacctattaacgtcgaactaacgactacgtacctagacgtacgactagactgttaagtgtacgtntacgagacgaccacggttcgtacgttcttaagtcgttggacgggaggtaggggaacggggggtaggggtaaggttaacgttgttaacccggattaaggtaaagttcttaagttaacccgttggttaacgttcggtacg

SEQ ID NO: 235959 - DNA, 616 bp, Homo sapiens
  misc_feature: GYAE6OF01CIP96.45.53.E09.1.454.CMB.1.raw
  modified_base (159)..(159): a, c, t, g, unknown or other
  misc_feature (159)..(159): n is a, c, g, or t
  modified_base (234)..(234): a, c, t, g, unknown or other
  misc_feature (234)..(234): n is a, c, g, or t
  modified_base (488)..(488): a, c, t, g, unknown or other
  misc_feature (488)..(488): n is a, c, g, or t
  modified_base (515)..(515): a, c, t, g, unknown or other
  misc_feature (515)..(515): n is a, c, g, or t
  modified_base (539)..(539): a, c, t, g, unknown or other
  misc_feature (539)..(539): n is a, c, g, or t
tcagacgcgatcgacacgaccggtgctcgatttagagagagtgtgttgggtttggggacccaacaaccacatccctcctcagaacgcccccagagcacaactcctcaccatggactggacctggaggatccttctttttggtggcagcagccacaggtntccactcccaggtccagcatgtgcagtcgtggggctgaggcgaagaacgccgtgggcctgagtgaaggttttccngcgaaggtcttcgaggatactacgtttcgcgtacgcccatcgacctattcgagtttgggtcgaccgccgaccggcccccggaggaacgggtcttggagtggtacgtggacgtaggactacgaacgtcgtgactacgtaggttacaacgaagtaactacttacgaataagtaacgttaccgaagaaccgagtacgtacacttagttacgagactagtctacgaactaacgacacgtactacgagtccggacgtanaagtcgtagttagacgtatcgaacganaccggagtcgtattactattacgngtacgtgggaggacggggaggggtaacgtagttcggttagactaattaacgtgttaactagttacgtggttgtacgg

SEQ ID NO: 235960 - DNA, 667 bp, Homo sapiens
  misc_feature: GYAE6OF01BE0KD.45.53.E09.1.454.CMB.1.raw
  modified_base (167)..(167): a, c, t, g, unknown or other
  misc_feature (167)..(167): n is a, c, g, or t
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (599)..(599): a, c, t, g, unknown or other
  misc_feature (599)..(599): n is a, c, g, or t
  modified_base (613)..(613): a, c, t, g, unknown or other
  misc_feature (613)..(613): n is a, c, g, or t
  modified_base (619)..(619): a, c, t, g, unknown or other
  misc_feature (619)..(619): n is a, c, g, or t
  modified_base (643)..(643): a, c, t, g, unknown or other
  misc_feature (643)..(643): n is a, c, g, or t
tcagacgcgatcgacacgaccggtgctcgatttagagagagtgtgagtgggatggatcaacgctggcactggttacacagaatattcaacagaaattccaggacagagtcaccatttctagggacatattcgcgaacacagcctacatcggacctgagctagtttgngatctgacgacgacggctgtcctattactgtgcgaggaggacgggggggaggatatgctaactaatgtattanactggngtcgtccgagtgggttgacgtcgtccgtcggggaccgacgggtaccccgtggtaccaccgttccctccgtacgacgtcccctaccaaccggtaacgggcccctaggttccccgttacccgttcccccggacggcccgtccccgtcgaccctaccggacggtacgtcccgacccgttaccggagtaccggaccgaacgtccggacccggtccccggtgggtacctcgggtcccgtaggtaccgaacggtaccttaccgttacccgtcgtaccgtaccggtccgttacgtacgggtacggcccgggacggttccgggacgtacgggccgtacgtaaccgtcggagtccagtccgngtcgagcgtacgtnccgtancgtcgtacgcgagtacgtcgacgngacgtacacgacgacgcgtcgtcg

SEQ ID NO: 235961 - DNA, 682 bp, Homo sapiens
  misc_feature: GYAE6OF01CCVBL.45.53.E09.1.454.CMB.1.raw
  modified_base (377)..(377): a, c, t, g, unknown or other
  misc_feature (377)..(377): n is a, c, g, or t
  modified_base (599)..(599): a, c, t, g, unknown or other
  misc_feature (599)..(599): n is a, c, g, or t
tcagacgcgatcgacacgaccggtgctcgatttagagagagtgtgttgggtttggggacccaacaaccacatccctcctcagaacgccccagagcacaactcctcaccatggactggacctggaggactccttctttttggtggcagcagccacgaggtgtccactcccaggtccagcatgtgcagtcgtggggctgaggacgaagagccgtgggcctgagtagacggtttctgacgacggtcttcgtaggtactacctacgtttcgctcgaccctatcgacctattctaggtttcgggtcgccggaccgaccgggacccccgggaagtaacggggtcgtttagggacggtcgggaggtacggggtatcgggtaacncgaacgtcggtcggactacggttacggtaacacgaaagtaattagtacaacgtaagtaactaccgaaggacacgtactactaccttagtttacgacggtactacgtacgtacgaacaacgacgacgtcctaacgtacgtacggaaccgtgtacgtacgttaggttagagtactacgtacgaaccgtccgagttcgttacttacgttacgttacgtcggtagnggggaacgggagggggacgggggtagtaggttacgtcggtaacgtaacgttaagttgtacgtttaattcgggtgttggtacgg

SEQ ID NO: 235962 - DNA, 857 bp, Homo sapiens
  misc_feature: GYAE6OF01B9YYB.45.53.E09.1.454.CMB.1.raw
  modified_base (157)..(157): a, c, t, g, unknown or other
  misc_feature (157)..(157): n is a, c, g, or t
  modified_base (169)..(169): a, c, t, g, unknown or other
  misc_feature (169)..(169): n is a, c, g, or t
  modified_base (232)..(232): a, c, t, g, unknown or other
  misc_feature (232)..(232): n is a, c, g, or t
tcagacgcgatcgacacgaccggtgctcgatttagagagagtgtgttgggtttgggggactgatcaggactcctcagttcaccttctcacaatgagcctccctgctcagctccgtgggatgctaatgctcgtggtctcgtggttccaggtgggattnttgtgatgactntacgtcctcctactcctccctcgtcccgtccacccgtggacgccgccgtcctccagtcctcgngccgtaggtcctagtcgacgcctccctcgcgtacgtagttaagtaagtagtaactaaaccgtaattagtggttaggttacgttttcggttccaggacgaacggtaccggaccgggaggtaccgtaaccgttccacccgaattccggtcccttcgtagttactttaccgtacgttccggtacggttacttacccggtttacccgggttccccggggttccccccgggtttaccccgggtacccgttagtaaacccggggtttcggggttacgtccggggtcggttacccggtttaagggtttcccggtaccggacggttaaacccgtacgtttaaacgttttaccgtttaaaccgtaaacggttaaataaaccgtccggaagtaacggttagggttacgggtaacggtagggtacgtttaagggtaacgggttttgggtttaggggttttcggttttaactacgtgggttaaactcggttacgtaacgttggtacgttacgtacggtttaacggttccggttaacggttcgggggtttaccggttacgggacccggggtaaaggtaacccgttaggggttacccggaaagggaacggttaacccgaaacggggtaagttaccgggg

SEQ ID NO: 235963 - DNA, 703 bp, Homo sapiens
  misc_feature: GYAE6OF01A13F9.45.53.E09.1.454.CMB.1.raw
  modified_base (214)..(214): a, c, t, g, unknown or other
  misc_feature (214)..(214): n is a, c, g, or t
tcagacgcgatcgacacgaccggtgctcgatttagagagagtgtgttgggtttggggacccaacaaccacatccctcctcagaagccccagagcacaactcctcaccatggactggacctggaggatcctctttttggtggcagcagccacaggtgtccactcccaggtccagcatgtgcagtctggggctgaggcgaagaagccgtgggcctnagtgaggtttcctgcaaggcttcgtggactactctttcgctgccatgcctattctagttgggtcgccgccgaccggtccccccggacgaacgggtcgttcggaggttcgggagttggggatagggacgtccgaaaccggtcgtcggactaccgttacgggttaaccaacgtaagaacgttaattaccaacgtaagtaaacgttaccgtaacggaaccgaggtaacgtacctaacctaaacgttttacgttaacggggaactacgttaacttaccggaacctaaccgtaacaacgtacctaacgaacgttcggaaccgttacggaacgtcgtaggtttacgtaacgtactagttacgaccgtacggaccggttgttacgtaccgttaagttacccgttgttacggtcggtaaagggacggggtacggggggtaggtagttacggtcgtacgtacgttaacgtagtacgtttaagtacgttagtcgtacgg

SEQ ID NO: 235964 - DNA, 862 bp, Homo sapiens
  misc_feature: GYAE6OF01CQ6KA.45.53.E09.1.454.CMB.1.raw
  modified_base (141)..(141): a, c, t, g, unknown or other
  misc_feature (141)..(141): n is a, c, g, or t
  modified_base (190)..(190): a, c, t, g, unknown or other
  misc_feature (190)..(190): n is a, c, g, or t
tcagacgcgatcgacacgaccggtgctcgatttagagagagtgtgttgggtttggggacccaacaaccacatccctcctcagaagcccccagagcacaactcctcaccatggactggacctggaggatccttctttttggnggcagcagccacaggtcgtccactcccaggtccagcatgtgcaggtcgnggggctggaggacgaagaacgccgtggggcctcgagtaggtaacggttcctgcaacggtcttcgtaggtaactacctacgtttcgctcgaccctagtcgtacctattcgtaaggtttcggggtcgacccggaccccgaaccggggtacccccccggaacggaacggggtccgttacggggtaggttagggacggttacggggaacgtcgggaacctacgaaccggtcggtaccggacgtaaccggtttacggtaactaaccggtaagtaacttaaccgttaacgaaacgtaaagtttaaaaccgtaccggaaaggaacctaaggaaccgttaacccgtaaccgtttaaagtttacccggttaaggggtaaccttaagttttaaccgttaccgggaaaccgtaaaccgtaacccgtaacgtaaccccgtaaagtaccggtttaacgggtacccggttaacgggtaacgtaccggttttaaggttacggggtaactaggtttaccgaaacgggtacccggtaaacgtaccgggttccgttacggttaacctttagttacggttacgggtacgggaccgggtaagggggaaccggggggtaacgggggggtagttaagttacgggttacgaacgttaagtaacgttacgtaatttaacggcgtaggttcggtacg

SEQ ID NO: 235965 - DNA, 739 bp, Homo sapiens
  misc_feature: GYAE6OF01AD7CU.45.53.E09.1.454.CMB.1.raw
  modified_base (234)..(234): a, c, t, g, unknown or other
  misc_feature (234)..(234): n is a, c, g, or t
  modified_base (318)..(318): a, c, t, g, unknown or other
  misc_feature (318)..(318): n is a, c, g, or t
  modified_base (650)..(650): a, c, t, g, unknown or other
  misc_feature (650)..(650): n is a, c, g, or t
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtcgtggggctggaggcgaagaagccgtggggcctcgagtgtaaggtttccngacgaaggtcttcgtggatacacttttcgcttcgcccatcgcctattcagtttggggtcgccgcccgacgggcccccccggaanaaacggggtcctttaggacgtgggacgttggggagttggataccgaacgcgtcggactacgttaggttaaccacgaaacgtaatacgttacaaacgtaagtaaaacgttccgaaggaacaacggtacgtaccgtaaccgttacgttttacggaaggggtaacctagtttacgttaccgaaccggtaaaccaaccgaacgtacccgttaaacgtaacggttaccgggtaaccctaggaaccgtacgttaaggttttacggaagtacctacggttaacggaacccgtaacggtaccggtcgttacggtactttaacccgttagtcgggttacgngggtaaaccggggtacggggggaaggggggtacggtaagttacggtcgaacgtaacgttaagtggttaattagtcgttggtgttaccgg

SEQ ID NO: 235966 - DNA, 849 bp, Homo sapiens
  misc_feature: GYAE6OF01C8VLU.45.53.E09.1.454.CMB.1.raw
tcagacgcgatcgacacgaccggtgctcgatttagagagagtgtgttgggtttggggtgatcaggactcctcagttcaccttctcacaatgaggctccctgctcagctccgtggggctgctaatgcttcgtgggtctctgggttccaggtggggattattggtgtatgactcgagttctccactcctccgtcgtaccgtccacccgtggaacgcggcccggtcctacctcgtccgtccgtcggacggagggtacttacgacgaacggtccgtccctccgtacgactaaggttaaacgtaaggtacggtaaactaaccctaaacggtttagttagggttacggttaacgttttccggggttcccttagggacgtaaaaccgggtaaccggaccggaacgggtacccgtaaccggtttaccctaacccgaacggttaccgttccccgtacgtaacggttactttacctacgggttacgttacggggtaactttaccggttacccggttccccggggtcccccggggttacccggggttaccctaaggttaaccgggttaacggttcgggtaacgggtccgggttaacggtacggggtttaccggtacgggtaacgggtaccttaacggttaagtttaaccgttaacgtaaacgtaagtaaaactcggtaagtccgtaagggtacggtcgggtacgtacggttaagggttaacggtttggttaacggggttttacgttaacgttacgtaggtacctaggtacgtaacggttacgtacgtacgtaacgttagtcgggttacgttcggtaacggttcgggacgtacggacgagtcgtaggacagagactggtcg

SEQ ID NO: 235967 - DNA, 577 bp, Homo sapiens
  misc_feature: GYAE6OF01BEWLI.45.53.E09.1.454.CMB.1.raw
  modified_base (194)..(194): a, c, t, g, unknown or other
  misc_feature (194)..(194): n is a, c, g, or t
  modified_base (308)..(308): a, c, t, g, unknown or other
  misc_feature (308)..(308): n is a, c, g, or t
  modified_base (525)..(525): a, c, t, g, unknown or other
  misc_feature (525)..(525): n is a, c, g, or t
  modified_base (529)..(529): a, c, t, g, unknown or other
  misc_feature (529)..(529): n is a, c, g, or t
  modified_base (532)..(532): a, c, t, g, unknown or other
  misc_feature (532)..(532): n is a, c, g, or t
  modified_base (537)..(537): a, c, t, g, unknown or other
  misc_feature (537)..(537): n is a, c, g, or t
  modified_base (541)..(541): a, c, t, g, unknown or other
  misc_feature (541)..(541): n is a, c, g, or t
  modified_base (547)..(547): a, c, t, g, unknown or other
  misc_feature (547)..(547): n is a, c, g, or t
  modified_base (565)..(567): a, c, t, g, unknown or other
  misc_feature (565)..(567): n is a, c, g, or t
  modified_base (569)..(570): a, c, t, g, unknown or other
  misc_feature (569)..(570): n is a, c, g, or t
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
tcagacgcgatcgacacgaccggtgctcgattttagagagagtgtgagtgggatggatcaacgctggcgactggttacacagaatattcacagaaattccaggacagagtcaccatttctaggacatattcgcgaacacagcctacatggacctgagcagtttgagatctgacgacgacggctgtcgtattacngtttttcgcgagaggacgggggaggagtagttgcactaatagtattattactgtgtgactagtggttgtgtcgtccggtcggcgacggaccgtcggtccgtccgtcctcctccncgcctaccgaccgaccggccgtccgtccgtcccgtcccgtccggtccgtccgtcgccgtcgacggacgaccgaccgtcgacgacgacgacgacggtccggccgtcggtccgtccggtaccgtacgggtaaccgtaacgttaccgttaccgttccgtacgtacgtccggtcgtcgtacggcggtaccggtcggtacggacgaacggcgactacgcgtncgtncgngtcgngagngcgagngtcagtcgagcgtgcgcnnncnntcngngc

SEQ ID NO: 235968 - DNA, 774 bp, Homo sapiens
  misc_feature: GYAE6OF01EIAOF.45.53.E09.1.454.CMB.1.raw
  modified_base (235)..(235): a, c, t, g, unknown or other
  misc_feature (235)..(235): n is a, c, g, or t
  modified_base (249)..(249): a, c, t, g, unknown or other
  misc_feature (249)..(249): n is a, c, g, or t
  modified_base (296)..(296): a, c, t, g, unknown or other
  misc_feature (296)..(296): n is a, c, g, or t
tcagacgcgatcgacacgaccggtgctcgatttagagagagtgtggttgggtttgggacccaacaaccacatccctcctcagaagcccccagagcacaactcctcaccatggactggacctggaggatcctcttttggtggcagcagccacaggtgccactcccaggtccagcagtgtgctaggtcgtgggctggaggcgaagacgccgtggggcctcaggtggtaacgtttccngcgaaggtcttcgngatacgtactttcgactcgccctatcgacctattcgtagttcgggtnaccggtccgtaccggacccccggaagaacgggtctttacgggaggttcggaaggttagggacgtacgggacttacgaacggtcgtaccggactacggttaggtaaccagaacggtaattacgtacaacgtaacgtaaccttaccgaaggacaagtacgtaccacttagttacgtaggactacgttacgtaccggaactaaacgtacgaacgtacctacgtaacgtacggtacccgtaagacgttacgttaggtttacggacgttacgttaccgaacggtaacccgtaaccggtaccgggttaaccgtttaggtttaacccttaacggttaccgttgggttacggaacgggtacggggtaaccgggggaagggggggtttaacggtaaccggtttaggttacccgggtaaacgttaaccgttaaacgggtttagtttaaccgttaaggtttaccggttgggtttcgggttaaacccggg

SEQ ID NO: 235969 - DNA, 745 bp, Homo sapiens
  misc_feature: GYAE6OF01ALB4U.45.53.E09.1.454.CMB.1.raw
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
  modified_base (558)..(558): a, c, t, g, unknown or other
  misc_feature (558)..(558): n is a, c, g, or t
tcagacgcgatcgacacgaccggtgctcgatttagagagagtgtgttggggtttggggacccaacaaccacatccctcctcagaagcccccagagcacaactcctcaccatggacctgggaccctggaggatcctctttttggtggcagcagccacgaggtgtccactcccgaggtccagccatgtgcagtcgtgggctgaggcgaagaacgcctggggcctngtgtaaggtttccngcaggctctggtatactcgtttcgcgtcgccctagtcgcctatttcaaggtttgggtcgcccgacggaccgggccccccggagacggggtccttggagtcggaagtgggatggattcgaaccgtgtacggctacgtacggtacacgtagtaactactacaacgtaaggtaacttacccggaaggaactacggtaacgtacccgaacctttacggtttaccgtaacgggtaccttaagtacgttaccggaccgtaaccgtaccaacggtaccccgttaacgaggtaaccggtacccgttaaggtaaaccgtttacggtttanaaggttactacggttacggtaaccgaccggtacccggttacgttacgtttaccgttaacgtttccggtaggtacggtaccggaacggggaacggggggtaacggggggtaagtacgtttacgggttacgccttaaacggttaacttcggtaaactttacgaaccggttcgttcgggtcttaaccggg

SEQ ID NO: 235970 - DNA, 689 bp, Homo sapiens
  misc_feature: GYAE6OF01DY3QK.45.53.E09.1.454.CMB.1.raw
  modified_base (242)..(242): a, c, t, g, unknown or other
  misc_feature (242)..(242): n is a, c, g, or t
  modified_base (283)..(283): a, c, t, g, unknown or other
  misc_feature (283)..(283): n is a, c, g, or t
  modified_base (415)..(415): a, c, t, g, unknown or other
  misc_feature (415)..(415): n is a, c, g, or t
  modified_base (450)..(450): a, c, t, g, unknown or other
  misc_feature (450)..(450): n is a, c, g, or t
tcagacgcgatcgacacgaccggtgctcgatttagagagagtgtgttgggtttggggacccaacaaccacatccctcctcagaacgcccccagagcacaactcctcaccatggactggaccctggaggattccttcgtttttggtggcagcagccacgaggtcgtccactcccgaggtccagcatggtgcagtcgtggggctgacggcgaagacgccgtgggcctagagtgtacggtttccngactacggtcttcgtggactactactttccgcgtcgacccntaccgaccttatttccgtaggtttggggtcgaccggacccccggtaccggaccccccggaagtaaggggttcctttagggagggttggacgtggggtaactggataccgacgtgtcgctacggtgtaaccanaagtaacttacacaagtaagtaactccgaacgganacggtaccgtactaaccttacgttaacgagtaactagtacgttacggactaacaccgtagaccttaagacgttcggactagtacgttacgtagttacggtactacgttacgaacggacgaccgtcggtacgttcgttacttacgttcgtcgtagggaccgggaggggtaccgggggacgggggtaataggttacgtacggtaacttagtaagttagtatttaacgtcgttggtgtacgg

SEQ ID NO: 235971 - DNA, 773 bp, Homo sapiens
  misc_feature: GYAE6OF01EHVX2.45.53.E09.1.454.CMB.1.raw
tcagacgcgatcgacacgaccggtgctcgatttagagagagtgtgttgggtttggggacccaacaaccacatccctcctcagaacgcccccagagcacaactcctcaccatggactggacctggaggatccttcttttggtggcagcagccacaggtgtccactccaggtccagcatgtgcagtcgtgggctgagcgaagaagccgtcggggcctacgaggtaggtaacggtttcctgacgtaaggtcttccgtaggactacgtactttcgctacgcccatcgcctatctagttcgggtgcggaccgaccggcccccgaagtaacgggtctggacggttaggagtgggattagggacttaccgaacggtcgtacggacctaacgttgggtaacctacgtaaggaacttaacgttacccaagtaaaccggtaaacgtttcccgaaaggtaaccacggtaactccgttaaacctacggttttaaccgtacggggtaacctaaagtttacgttaaccggaacgtaaaacccgacaaccggttaaccctaacgtaacggttcggtaaacccgtaggtacgtacgtaaggttttcgaaaggtcttacggtcggaacccggtaacgaccggttcgttacgttaaaccgttacgttacgtgggtaacgtacggggtaaagtaccgggggggggtacggggggaaagtttcgtttaaatcggggttaaactaacgttaaacgtcgttaaacgttttcgaaacgtttgggtacccggtacgg

SEQ ID NO: 235972 - DNA, 228 bp, Homo sapiens
  misc_feature: GYAE6OF02FNMC2.45.53.E09.1.454.CMB.1.raw
  modified_base (224)..(228): a, c, t, g, unknown or other
  misc_feature (224)..(228): n is a, c, g, or t
tcagacgcgatcgacacgaccggtgctcgatttagagagagtgtgttgggtttgggtgccgaagttgctggaggtcaccgtctcctcagcctccaccaagggcccatcggtcttcccctggcgccctgctccaggagcacctccgagagcacagcggccctgggctgcctggtacaaggactacttcctactgcagtctgagcgggctggacaaggcgcatagnnnnn

SEQ ID NO: 235973 - DNA, 277 bp, Homo sapiens
  misc_feature: GYAE6OF02FZ46L.45.53.E09.1.454.CMB.1.raw
  modified_base (270)..(277): a, c, t, g, unknown or other
  misc_feature (270)..(277): n is a, c, g, or t
tcagacgcgatcgacacgaccggtgctcgatttagagagagtgtgttgggtttgggagggatattgcactaatgattatactgtgtgccatgggttgagctcctggggccagggaaccctggtcaccgtctcctcagcctccaccaagggcccatcggtcttcccctggcgccctgctccaggagcacctccgagagcacagcggccctgggctgcctggtcaaggctacttcctcgatcgcgtctgagcgggctggcaaggcgcatagnnnnnnnn

SEQ ID NO: 235974 - DNA, 268 bp, Homo sapiens
  misc_feature: GYAE6OF02GZOCF.45.53.E09.1.454.CMB.1.raw
  modified_base (267)..(268): a, c, t, g, unknown or other
  misc_feature (267)..(268): n is a, c, g, or t
tcagacgcgatcgacacgaccggtgctcgatttagagagagtgtgttgggggagggatattgcactaatgattatactgtgtgccatgggttgagctcctggggccagggaaccctggtcaccgtctcctcagcctccaccaagggcccatcggtcttcccctggcgccctgctccaggagcacctccgagagcacagcggccctgggctgcctggtcaaggactacttcctcgatcgcgtctgagcgggctggcaaggcgcatagnn

SEQ ID NO: 235975 - DNA, 140 bp, Homo sapiens
  misc_feature: GYAE6OF02GZUIY.45.53.E09.1.454.CMB.1.raw
tcagacgcgatcgacacgaccggtgctcgatttagagagagtgtgttgggtttgggggaagaggaagactgacggccctgggctgcctggtcaaggactacttcctcgatcgcgtctgagcgggctggcaaggcgcatag

SEQ ID NO: 235976 - DNA, 274 bp, Homo sapiens
  misc_feature: GYAE6OF02FYSQ9.45.53.E09.1.454.CMB.1.raw
  modified_base (272)..(274): a, c, t, g, unknown or other
  misc_feature (272)..(274): n is a, c, g, or t
tcagacgcgatcgacacgaccggtgctcgatttagagagagtgtgttgggtttgggagggatattgcactaatgattatactgtgtgccatgggttgagctcctggggccagggaaccctggtcaccgtctcctcagcctccaccaagggcccatcggtcttccccctggcgccctgctccaggagcacctccgagagcacagcggccctgggctgcctggtcaaggactacttcctcgatcgcgtctgagcgggctggcaaggcgcatagnnn

SEQ ID NO: 235977 - DNA, 451 bp, Homo sapiens
  misc_feature: GYAE6OF02GI2M2.45.53.E09.1.454.CMB.1.raw
  modified_base (435)..(451): a, c, t, g, unknown or other
  misc_feature (435)..(451): n is a, c, g, or t
tcagacgcgatcgacacgaccggtgctcgatttagagagagtgtgatgggatggatcaacgctggcactggttacacagaatattcacagaaattccaggacagagtcaccatttctagggacatattcgcgaacacagcctacatggacctgagcagtttgagatctgacgacacggctgtctattactgtgcgagagacgggggggaggatattgcactaatgattatactgtgtgccatgggttgagctccgtggggccagggaccctggtcaccgtctcctcagcctccaccaacgggcccatccggtccttccccctgggccgccctgcctccgaggacgccacctccgagacgcacaggccggccctgggctgcctggtcaaggactacttcctcgatcgcgtctgagcgggctggcgaggcgcatagnnnnnnnnnnnnnnnnn

SEQ ID NO: 235978 - DNA, 224 bp, Homo sapiens
  misc_feature: GYAE6OF02H67GR.45.53.E09.1.454.CMB.1.raw
  modified_base (223)..(224): a, c, t, g, unknown or other
  misc_feature (223)..(224): n is a, c, g, or t
tcagacgcgatcgacacgaccggtgctcgatttagagagagtgtgttgggtttgggtgccgaagttgctggaggtcaccgtctcctcagcctccaccaagggcccatcggtcttccccctggcgccctgctccaggagcacctccgagagcacagcggccctgggctgcctggtcaaggactcttcctcgatcgcgtctgagcgggctggcaaggcgcatagnn

SEQ ID NO: 235979 - DNA, 431 bp, Homo sapiens
  misc_feature: GYAE6OF02ISKS2.45.53.E09.1.454.CMB.1.raw
  modified_base (319)..(319): a, c, t, g, unknown or other
  misc_feature (319)..(319): n is a, c, g, or t
  modified_base (323)..(323): a, c, t, g, unknown or other
  misc_feature (323)..(323): n is a, c, g, or t
  modified_base (421)..(431): a, c, t, g, unknown or other
  misc_feature (421)..(431): n is a, c, g, or t
tcagacgcgatcgacacgaccggtgctcgatttagagagagtgtgatgggatggatcaacgctggcactggttacacagaatattcacagaaattccaggacagagtcaccatttctagggacatattcgcgaacacagcctacatggacctgagcagtttgagatctgacgacacggctgtctattactgtgcgagagacgggggggaggatattgcactaatgattatactgtgtgccatgggttgagctcctggggccagggaaccctggtcaccgtctcctcagcctccaccaagggcccatcggtcttcccccnggcnccctgctccaggagcacctccgagagcacagcggccctgggctgcctggtcaaggactacttcctcgatcgcgtctgagcggctggcaggcgcatagnnnnnnnnnnn

SEQ ID NO: 235980 - DNA, 541 bp, Homo sapiens
  misc_feature: GYAE6OF02HZA87.45.53.E09.1.454.CMB.1.raw
tcagacgcgatcgacacgaccggtgctcgatttagagagagtgtgttgggtttgggggactgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcagggctagtcagagcctcctgcatagtaatggatacaactatgtggattggttcctgcagaagccagggcagtctcacagctcctgatctatctgggatctattcggccctccggggtccctgacagttcagtggcagtggttcaggcacagtattttacactagaaatcagacagaggtggaggctggaggagttggttaggggtttattacgtgtcagttgcgtaaaggtctagactaagttcgtccgttggttaggtttttgggaacggtacggggaccgaaggtacgtagggaacggaacgtacgaaacggtaacgg

SEQ ID NO: 235981 - DNA, 510 bp, Homo sapiens
  misc_feature: GYAE6OF02JHAM8.45.53.E09.1.454.CMB.1.raw
  modified_base (409)..(409): a, c, t, g, unknown or other
  misc_feature (409)..(409): n is a, c, g, or t
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattggtgcgccacggcccccggacaacgggcgttgagtggagtgggagtggatcaacgctggggggggggcacgtggttacacagaatattacacagaaatacagacagagtcacatttctaggacatatcgacgacacanactacatcgactgagcagttgtagatctgacgacacgctgtctattactgtgcgagaggacgggggagggagtagtgcgacgtatagattatagtgtgtcg

SEQ ID NO: 235982 - DNA, 224 bp, Homo sapiens; identical to SEQ ID NO: 235913
  misc_feature: GYAE6OF02HB8Q9.45.53.E09.1.454.CMB.1.raw
  modified_base (223)..(224): a, c, t, g, unknown or other
  misc_feature (223)..(224): n is a, c, g, or t

SEQ ID NO: 235983 - DNA, 274 bp, Homo sapiens; identical to SEQ ID NO: 235976
  misc_feature: GYAE6OF02GVM20.45.53.E09.1.454.CMB.1.raw
  modified_base (272)..(274): a, c, t, g, unknown or other
  misc_feature (272)..(274): n is a, c, g, or t

SEQ ID NO: 235984 - DNA, 483 bp, Homo sapiens
  misc_feature: GYAE6OF02FVOSA.45.53.E09.1.454.CMB.1.raw
  modified_base (464)..(483): a, c, t, g, unknown or other
  misc_feature (464)..(483): n is a, c, g, or t
tcagacgcgatcgacacgaccggtgctcgatttagagagagtgtgatgggatggatcaacgctggcactggttacacagaatattcacagaaattccaggacagagtcaccatttctagggacatattcgcgaacacagcctacatggacctgagcagtttgagatctgacgacacggctgtctattactgtgcgagagacgggggggaggatattgcactaatgattatactgtgtgccatgggttgagctccgtggggccagggaccctggtcaccgtctcctcagcctccaccagggcccagtccggtccttcccccgtggccgcccctgcctccgaggacgccaccctccgagacgcacgacgccggccctggggcctcggcccgttggtacaaacgggtaccttacgttccctcgactccgcgttctggacggcgggctcgggacaagggcgcagtagnnnnnnnnnnnnnnnnnnnn

SEQ ID NO: 235985 - DNA, 274 bp, Homo sapiens
  misc_feature: GYAE6OF02HAMMK.45.53.E09.1.454.CMB.1.raw
  modified_base (271)..(274): a, c, t, g, unknown or other
  misc_feature (271)..(274): n is a, c, g, or t
tcagacgcgatcgacacgaccggtgctcgatttagagagagtgtgttgggtttgggagggatattgcactaatgattatactgtgtgccatgggttgagctcctggggccagggaaccctggtcaccgtctcctcagcctccaccaagggcccatcggtcttcccctggcgccctgctccaggagcacctccgagagcacagcggccctgggctgcctggtcaaggactacttcctcgatcgcgtctgagcgggctggcaaggcgcatagnnnn

SEQ ID NO: 235986 - DNA, 639 bp, Homo sapiens
  misc_feature: GYAE6OF02I5G8G.45.53.E09.1.454.CMB.1.raw
tcagacgcgatcgacacgaccggtgctcgatttagagagagtgtgttgggtttgggggactgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcagggctagtcagagcctcctgcatagtaatggataacaactatgtggtattggtcctgcaagaagccgagggcaggtctccacagcctcctgatctatcgtgggacttctacttccggccccgtccggggtccctggacctaggttcgagtcgggactagggttcggttcgacggcaacgagttactttactaacgtagtaaaatcgtaagacaaggaggtagggacgggtacgtaggagggtaggttagggtttacggggttttaagtttacgttacggtacgtagttcggtacgtaagggttacgtacgacgtaacgttcggtttaccgttaggggttacggtttttacgggaccggtaacggggtaaccgtaacggtacggtacgggtacggacggtaaccggaaacggtaaccgg

SEQ ID NO: 235987 - DNA, 546 bp, Homo sapiens
  misc_feature: GYAE6OF02G30SO.45.53.E09.1.454.CMB.1.raw
  modified_base (292)..(292): a, c, t, g, unknown or other
  misc_feature (292)..(292): n is a, c, g, or t
  modified_base (357)..(357): a, c, t, g, unknown or other
  misc_feature (357)..(357): n is a, c, g, or t
  modified_base (482)..(482): a, c, t, g, unknown or other
  misc_feature (482)..(482): n is a, c, g, or t
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtgcgccaggcccccgganaagggcttggacgtggatcgggatggatcgaacgctagggcctagtggttacacagaatattcanagaaattcaggacagagtcacatttcgtaggacaatattcgacgtaacacagcctacatgactgagctagtttagagtatcgtagacgtacgacggcttgtacttacttacgtgttagcggtagngggtaacgggggggaggattagtagaccgtaagtacgttaggaactttagtacgtgtagtacgg

SEQ ID NO: 235988 - DNA, 230 bp, Homo sapiens
  misc_feature: GYAE6OF02H2ARS.45.53.E09.1.454.CMB.1.raw
  modified_base (225)..(230): a, c, t, g, unknown or other
  misc_feature (225)..(230): n is a, c, g, or t
tcagacgcgatcgacacgaccggtgctcgatttagagagagtgtgttgggtttgggtgccgaagttgctggaggtcaccgtctcctcagcctccaccaagggcccatcggtcttccccctggcgccctgctccaggagcacctccgagagcacagcggccctgggctgcctggtcaaggactacttcctcgatcgcgtctgagcgggctggcaaggcgcagtagnnnnnn

SEQ ID NO: 235989 - DNA, 515 bp, Homo sapiens
  misc_feature: GYAE6OF02GQ17Q.45.53.E09.1.454.CMB.1.raw
tcagacgcgatcgacacgaccggtgctcgatttagagagagtgtgttgggtttggggacccaacaaccacatccctcctcagaagcccccagagcacaactcctcaccatggactggacctggaggatcctcttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtgcgccaggcccccggacaagggcttgagtggatgggatggatcaacgctggcactggttacacagaatattcacagaaattccaggacagagtcacctatttctagggacatattcgcgaacacagcctacatggaccttgagcagtttgagtatctgacgacacggctgtctattactgtgcgagaggacgggggggaggagttagtgactagtaatggtaatttatacgttggtgtcgg

SEQ ID NO: 235990 - DNA, 589 bp, Homo sapiens
  misc_feature: GYAE6OF02FWEJE.45.53.E09.1.454.CMB.1.raw
  modified_base (373)..(373): a, c, t, g, unknown or other
  misc_feature (373)..(373): n is a, c, g, or t
tcagacgcgatcgacacgaccggtgctcgatttagagagagtgtgttgggtttgggggactgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatcctcctgcagggctagtcagacgcctcctgcatagtaatggatacaactatgtggtatttggttcctgcagacgccgagggcagtcctccacagctcctgacttctatccgtggtactctacgttccggccccgtccggggtccctggacgtaggttacnggtcggctaggttcggttcgacggctaacgtagttaattttacactagtaaaatcgaagacgaaggtagtgggacggtcgtaaggaggtagttagggttttagggtttaacttacgtgtactagtagtacgtaaggttctagtactaagttcgttcggtggttacggtttacggaccggtaagggacctaggcggtaggagacgtacgaagtacgg

SEQ ID NO: 235991 - DNA, 579 bp, Homo sapiens
  misc_feature: GYAE6OF02ITB7B.45.53.E09.1.454.CMB.1.raw
tcagacgcgatcgacacgaccggtgctcgatttagagagagtgtgttgggtttgggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtgcgccaggccccccggacaacggggcttgagtggagtgggatggatcaacgctggcactggtacacagatattcacagaaattccaggacagagtcaccatttcgtagggacatattcgacgaacacacgcctacacgtaggacctgagactagtttgagagtctcgacgtacacgggtctgttcgttaattacgttggtgaccgggtaggaacgggggacgggggggggtaagggtaaggttaggttacggtacgtaaccgttaatacggttaacgtttaataacgtttggtaggttaccgg

SEQ ID NO: 235992 - DNA, 610 bp, Homo sapiens
  misc_feature: GYAE6OF02I8MQL.45.53.E09.1.454.CMB.1.raw
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtgcgccacggcccccggacaagggcttggagtggatggggatggatcaacgctggcactggttacacagaatatcactagaacttccaggacagagtacacctatttctagggactaagttattccgacgtaaacaccgtacgacccgttaacagttacggaccgttggaacgtaccgttaggtttacgagttacgtcgttacggaacggaaccgaccgggtccttagtccttaatttaccgtgtcggacgagggaacgggggtaaccggggggggtaggtaagtaggttacggactaacgtaagtcggttaaattagtacgtttaggtgtaccgg

SEQ ID NO: 235993 - DNA, 658 bp, Homo sapiens
  misc_feature: GYAE6OF02GGITF.45.53.E09.1.454.CMB.1.raw
tcagacgcgatcgacacgaccggtgctcgatttagagagagtgtgttgggtttgggggactgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcagggctagtcagacgcctctgcatagtaatggataacaactatgtggtattggttcctgcaggaacgccgagggcagtcctaccacagtcctcctgacttctatcgtgggacttctacgttcccggccccgttcccggggtcccctaggtaccgtacgggttccgaggtcgggaccgtagggtttacggttacgacggtaccaacgtaagttaacttttaacgaacgtaagtaaaactacgaacgacgaaggtaggtagggaggtacgtaggtaggtaggtttagggttttagggttttaagtttacgtgtacgtagtagtaacgtaacggtctagtaacgtagttcgttaccggttagggttacggttttacgggaacggtaacggggaaccgtaaggtacggttagggaacggaacggtaacgtaaacgtaacggg

SEQ ID NO: 235994 - DNA, 556 bp, Homo sapiens
  misc_feature: GYAE6OF02HQVH1.45.53.E09.1.454.CMB.1.raw
  modified_base (296)..(296): a, c, t, g, unknown or other
  misc_feature (296)..(296): n is a, c, g, or t
  modified_base (300)..(300): a, c, t, g, unknown or other
  misc_feature (300)..(300): n is a, c, g, or t
  modified_base (383)..(383): a, c, t, g, unknown or other
  misc_feature (383)..(383): n is a, c, g, or t
tcagacgcgatcgacacgaccggtgctcgatttagagagagtgtgttgggtttgggggactgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcagggctagtcagagcctcctgcatagtaatggatacaactatgtggattggttcctgacagaagccagggcagtcnccangctcctgatctatctggatctatccggccctcggggtcctgacgtgtcagtggcaggtgtcaggcactagtatttacacgtanaaatcagacagaggtggagtcgtggaggtagtggttagggtttattacgtgcgagtcgacgtaagttgtacgtacaacgttcggtacgttgggtacgttttagggacccggtaacgggggtaccgtaaacgggtcggttaaggaacggtaacgtaaccgtaaaccggtaacgg

SEQ ID NO: 235995 - DNA, 580 bp, Homo sapiens
  misc_feature: GYAE6OF02HP6HQ.45.53.E09.1.454.CMB.1.raw
  modified_base (296)..(296): a, c, t, g, unknown or other
  misc_feature (296)..(296): n is a, c, g, or t
  modified_base (300)..(300): a, c, t, g, unknown or other
  misc_feature (300)..(300): n is a, c, g, or t
tcagacgcgatcgacacgaccggtgctcgatttagagagagtgtgttgggtttgggggactgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcagggctagtcagacgcctcctgcatagtaatggatacaactatgtggtattggtcctgcagacgccagggcagtcncacngcctctgatctatcgtggacttctacgtccggcccgtccggggtccctgacgtggttcagtcggctagttggtacgaggcacgtagtactttacactagaaactcaagacgaggtaggtggacggtcgtaggaggtagttgggtttagggtttacttacgtgtacgtagtacgtacgtaggttcgtagtactaagttcggttacggttgggttacggtttacgggaccggtacgggtaaccgtaacggtcggtaggacggaacgaaccgtaacgtaacgg

SEQ ID NO: 235996 - DNA, 477 bp, Homo sapiens
  misc_feature: GYAE6OF02GQ9O1.45.53.E09.1.454.CMB.1.raw
  modified_base (434)..(434): a, c, t, g, unknown or other
  misc_feature (434)..(434): n is a, c, g, or t
  modified_base (461)..(477): a, c, t, g, unknown or other
  misc_feature (461)..(477): n is a, c, g, or t
tcagacgcgatcgacacgaccggtgctcgatttagagagagtgtgatgggatggatcaacgctggcactggttacacagaatattcacagaaattccaggacagagtcaccatttctagggacatattcgcgaacacagcctacatggacctgagcagtttgagatctgacgacacggctgtctattactgtgcgagagacgggggggaggatattgcactaatgattatactgtgtgccatgggttgagctccgtggggccagggaaccctggtcacccgtctccctcacgcctccaccgaacgggccccagtccggtccttccccccgtgggccgtcccctgcctccgaggacgcaccctccgagacgcacacgccggcccgtgggcctcgccctaggtcaaggaccttacgttccctcgagtccgcgtcgnggacggcgggctgggcaggcgcatagnnnnnnnnnnnnnnnnn

SEQ ID NO: 235997 - DNA, 540 bp, Homo sapiens
  misc_feature: GYAE6OF02HZ3EX.45.53.E09.1.454.CMB.1.raw
  modified_base (258)..(258): a, c, t, g, unknown or other
  misc_feature (258)..(258): n is a, c, g, or t
  modified_base (329)..(329): a, c, t, g, unknown or other
  misc_feature (329)..(329): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
  modified_base (517)..(540): a, c, t, g, unknown or other
  misc_feature (517)..(540): n is a, c, g, or t
tcagacgcgatcgacacgaccggtgctcgatttagagagagtgtgatgggatggatcaacgctggcactggttacacagaatattcacagaaattccaggacagagtcaccattttctagggacatattcgcgaacacagcctacatggacctgagcagtttgagatctgacgacacggctgtctattactgtgcgagaggacgggggggagggatattgcactaatgattatactgtgtgccagtggttgagctcgngggccagggaaccctgggtcaccgtctcctcacgccctccaccgaacggcccagtccggtccttcccccgnggcccgtccctgcctccgacggcgcctacccgccgagacgaccaacgacggcccggtcccgtgggcctacggtcccgtagggtaccgaaacggtaccttaccctttccgacgtacgtccgtacgttctacgggacggtccgggtcgtcgggaccgaacggggtccgacctaaagtaggcngngngngnnnnnnnnnnnnnnnnnnnnnnnn

SEQ ID NO: 235998 - DNA, 623 bp, Homo sapiens
  misc_feature: GYAE6OF02G5523.45.53.E09.1.454.CMB.1.raw
tcagacgcgatcgacacgaccggtgctcgatttagagagagtgtgttgggtttgggggactgatcaggactcctcagttcaccttctcacaatgaggctccctgctcagctcctggggctgctaatgctctgggtctctggttccagtggggatattgtgatgactcagtctccactctccctgtccgtcacccctggagacgccggcctccatcctcctgcagggctagtcagacgccctcctgcatagtaatggatacaactatgtggattggttcctgcagaagccgagggcagtcctccgacagcctcctgactctatcgtgggtacttcgtacttccgggccccgtccggggtccctaggactaggttcaggtcggcgtaggttcggttcgaggcctagtagttaacttttacaacttaagtaaactcgagactaggtaggtggaggcgtaggaggtagtttagggtttaggggtttacttacgttggtacgtagtcggtacgtaacggttcgtagaacgtagttcggttaccggttaggggttacggtttcggggacccggtaacggggtaacctaagggtccggtagggaacgaacggtaaccgaaccggtaacgg

SEQ ID NO: 235999 - DNA, 667 bp, Homo sapiens
  misc_feature: GYAE6OF02H978X.45.53.E09.1.454.CMB.1.raw
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcgagggctagtcagacgcctcctgcatagtaatggactacaactatgtaggtattcggttcctggcaagaacgccgaggggcagtcctccacacgtcctcctgactctagtcgtggacttctacgttccggccccgttcccggggtccctggactacggttcaggtcggcgtaggttcggttcgacggtacaacgtaagttacttttaacacgttaagtaaaactcgaagcgaaggtaggttagggacggtcgtagggtacggttaggtttaggggtttacggggttttaagttacgttacggtacgtaagtcggaaccgttaagggttctacgtaactaacgttcggttaccgttagggttaacggttttccggggaccgggtaaccggggtaccgtaacgggtcggttaagggaaggtaaccggtaacggtaaaccggtaggttacggg

SEQ ID NO: 236000 - DNA, 1059 bp, Homo sapiens
  misc_feature: GYAE6OF02JV7TS.45.53.E09.1.454.CMB.1.raw
tcagacgcgatcgacacgaccggtgctcgatttagagagagtgtgttgggtttggggtacccgaacaaccacatccctcctcagaagccccacgagcacaactcctcaccactggactggacctggaggatcctctttttggttggcagcagccacaggtgtccactcccaggtccagcatgtgcagtctggggctgaggcgaagagccgtgggcctcgagtggaaggtctccgtagcgaaggtcttctaggatacaccgtttcaaccggtcttaactacgttactaacgtaacgtcgggttacggacgtaaccgaacgggtccccccgttagggaacccgaacgggggtaccgtttacggggtaacgggttacggggtaacgttaggggggtaaaccgttagggggtaaccgttaaccccgtaaaaacccccgttaaaacgttaaaccgggttttacgggggttacggggacccgtaaaacccgtaaaaaacgtttaaccgttacggggaaaccctaaacggttaaaacgggtttaaaaccgggttttttaccggaaaaccggggggggttacgtaaacggggggttacccccgtaaaacccgttaaacgggttaccccgggaaaacccggggttaaaccgggggaaaccccggttaacccgggttaaaccccggttaaacggtttaaacccggtaaacccggggaacccgtaaacccggtaaaccggaaccccggtttaaacccgtaacggttaaaccggggtaacggttaacccggtaccgggttaacggaaccgggtacggacccggtttaagggaaaaccgggtacgttaaccgggttaccggtaaaccgggtaaacggttaacccccggggtaacgggtttacgttaaacggtttaacccggtcggggttaacgtcggggtaacgggtacgggaacccggggttaaacggtttaaacgttaaccggggttttaacgttttttaggggtaaccggttttaagggttaccggttttaacgggttaacggggtttacgttaaggggttacccgggg

SEQ ID NO: 236001 - DNA, 630 bp, Homo sapiens
  misc_feature: GYAE6OF02HL2CY.45.53.E09.1.454.CMB.1.raw
  modified_base (465)..(465): a, c, t, g, unknown or other
  misc_feature (465)..(465): n is a, c, g, or t
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcgagtagtacggtttcctgacgaagtcttcgtggactactactttcgctcgccctatcgcctattctagttgggtcgccgccgaccgggcccccggaagaacgggtcttaggaggtggagtgggagtggatacgaacgtcgtggctacgttggttaacacgaagtaatacttacaacgaagtaaacttaccgaggaacagacgtaccaacctatttcgaggactattacgtcgacaacacgacgtacctanagtcgacttaggagtactaggtttagagtatctaggacacgacgtcgtgttacttaagttacgtgtaggacgagggaacggggtacgggggggtaaggtagttacggttacggaccgtaaagttaaggttacgtaagttttaacgtacggttggtaggttaccgg

SEQ ID NO: 236002 - DNA, 523 bp, Homo sapiens
  misc_feature: GYAE6OF02IY7WK.45.53.E09.1.454.CMB.1.raw
  modified_base (276)..(276): a, c, t, g, unknown or other
  misc_feature (276)..(276): n is a, c, g, or t
  modified_base (292)..(292): a, c, t, g, unknown or other
  misc_feature (292)..(292): n is a, c, g, or t
  modified_base (439)..(439): a, c, t, g, unknown or other
  misc_feature (439)..(439): n is a, c, g, or t
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtncgccaggcccccgganaagggcttgagtggatgggatggatcaacgctggcactggttacacagaatattcaacagaaattccaaggacagagtcaacatttacagggacatacttcgacgaacacacgacctacatcggacctgagcgtagtttgagatcgngacgacacggctgtcttattactgtgcgaggaggacggggggtaggataagtgactagtaactgtaacttatacgttgtgtacg

SEQ ID NO: 236003 - DNA, 618 bp, Homo sapiens
  misc_feature: GYAE6OF02J1XB9.45.53.E09.1.454.CMB.1.raw
  modified_base (226)..(226): a, c, t, g, unknown or other
  misc_feature (226)..(226): n is a, c, g, or t
  modified_base (237)..(237): a, c, t, g, unknown or other
  misc_feature (237)..(237): n is a, c, g, or t
  modified_base (335)..(335): a, c, t, g, unknown or other
  misc_feature (335)..(335): n is a, c, g, or t
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccatcatgtgcagtctggggctgaggcgaagaagcctgggcctcagtgaagttccngcaaggcttgngatacactttcgctgcccatcgcctattcagttgggtgccgccgaggccccctggacctaagggcttgacgtggatgggatggacttacaaccctaanagtggtcggactaacgaaactagtcgacaaccgaagtaagtttcgagggactagggtcaccgagtcgaccgagggtaccaccgtaccagtacgagactaacgacgtccaacgtagtacgggagtccgtaggacgtcgaaggccgttagagtactcgtacggaccgacggaccggtccgttaggtagttacgtcggtagacggtaagggaggaccgtaaggtaacgtttcgttaaggttttaggtacggttaggttaacgtttacgggtacgttaggttacggg

SEQ ID NO: 236004 - DNA, 773 bp, Homo sapiens
  misc_feature: GYAE6OF02IKFTX.45.53.E09.1.454.CMB.1.raw
tcagacgcgatcgacacgaccggtgctcgatttagagagagtgtgttgggtttggggacccaacaaccacatccctcctcagaagccccagagcacaactcctcaccatggactggacctggaggatccttctttttggtggcagcagccacaggtgtccacctcccaggtccagcatgtgcagtctggggctggaggcgaagaagccgtggggcctcgagtgtaacggtttcctgacgaaggtcttcgtaggattactactttcgcttcgccctagtcgcctattctagttgggtcgccgccgaaccgggcccccggaacgtaacggggtcttaggacgggttaggtacggtcgggtagttacgggaactaccgaaacgtcgtcgggacctaccgtttagggtaaccgaaacaaggtaaacttaacgtttaccaaacgtaaacgtaaaacgttcccgaaagggtacctaaggaacgttaccctaaaccgttaaactttttccggaaacggggtaataacgtttaacgtttaccgaaccgtaaacctaaccgaaccgtaaccgttaaacctaacggtaccggtaaccgtacggtaacgtaacgtttaggtttaacgaacgtacgttacgttacggaaaccgtacgtaaccgtacgttacgttacgttaacgttacgttacggtacgtacggaagggtaaggggtacggggggtaaggtacggtagttacggacgtaacgtagtacgttacgttaagttacgttgttagtacgg

SEQ ID NO: 236005 - DNA, 667 bp, Homo sapiens
  misc_feature: GYAE6OF02GSHPT.45.53.E09.1.454.CMB.1.raw
  modified_base (310)..(310): a, c, t, g, unknown or other
  misc_feature (310)..(310): n is a, c, g, or t
tcagacgcgatcgacacgaccggtgctcgatttagagagagtgtgttgggtttgggggactgactcaggactcctcagttcacctttctcacgaatgaggctccctgctcagctcctgggctgctaatgtctctgggtctcgttggttccagtgggattatgtgactgactcagtctccactctccgtgtccgtcgacccgtggacgacgccggcctcgatcctcctgcacgggtctacgtcagacgcctcctgcgtatacgtatggaatacaactatgtgattcggttctgcagacgccgaggcagtcncacgagctctgtactctagtcgtgggacttacgttacgttccgggccccgttccggggtccctggaccgtacggttcgacggttcgggacgtaggtttcggttaccgacggtacctaacgtaagttaactttaaccgaacgttaacgaaaacgtcgaacgacgaagtaggtagggtacggacgtaggaacggtagtttagggttttacgggttttacttacgtacgtacgtagttacgacgttaacggttctacggtaacgtaagttcggtaccggttagggttacggtttaccgggaaccggtaacgggtaaccttaacggtcggtaggtacggacgtaccggaacggttaaccgg

SEQ ID NO: 236006 - DNA, 531 bp, Homo sapiens
  misc_feature: GYAE6OF02GP7ZZ.45.53.E09.1.454.CMB.1.raw
  modified_base (240)..(240): a, c, t, g, unknown or other
  misc_feature (240)..(240): n is a, c, g, or t
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttcnggatacactttcgctgcccatcgccattcattgggtgcgccacggccccccggacaacgggtcttggacgtggatgggatggatcgaacgctggcacttggtacacagaatattcacagaattcaggacagagtcacctatttcaggacatattcgcgaacacacgcctacatcggactgagtcgtagttgagtatactcgagaccgacggtcttagtacttattacgtgtgcgaggaggacggggggaggtagtagtgacgagtacgtagtattaactcgttagtgtacg

SEQ ID NO: 236007 - DNA, 572 bp, Homo sapiens
  misc_feature: GYAE6OF02HDAQF.45.53.E09.1.454.CMB.1.raw
  modified_base (240)..(240): a, c, t, g, unknown or other
  misc_feature (240)..(240): n is a, c, g, or t
  modified_base (277)..(277): a, c, t, g, unknown or other
  misc_feature (277)..(277): n is a, c, g, or t
  modified_base (355)..(355): a, c, t, g, unknown or other
  misc_feature (355)..(355): n is a, c, g, or t
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttcnggatactactttcgctgcccatgccattcattgggtncgccaggccccccggacaaggggtcttggagtggagtgggatggatcaacgctggcacgtggttacacagtaatactnacagtaaattccgaaggacaagagtcactattttacgaggactagtacttcggacgtaacacacgacctacagtcggtacctgacgactagtttcgagtatcgtgaccgacgacgtacgtgttacttatactgtcgtacgaggaggggtacggggggagggtaacttaggttacgacgtaaccgttagtagactttagttaacgtcggttggtacgg

SEQ ID NO: 236008 - DNA, 599 bp, Homo sapiens
  misc_feature: GYAE6OF02GCT6H.45.53.E09.1.454.CMB.1.raw
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaaagaagccgtggggcctcagtgaaggtttcctgcaaggcttctggatacactttcgctgcccatcgccattcattgggtgcgccacggccccccggacgaagggcttggaggtggagtgggatggatcaacgctggcactggttacacaagaatatacacaagtaaattccaaggacagagtacacctatttacgagggactaatagttacgacgtaaacaacacgtaccctaacacgtacgggaacctaggaacgcgtaaggtttacgagtactcgtacggaacgtaccgacggtcttcgttacttactttacgtacgtagacggtaggacggggaacgggggggaagggtaacgtagttaggaccgtaagtaatggtaattagtacgttagtgtacgg

SEQ ID NO: 236009 - DNA, 810 bp, Homo sapiens
  misc_feature: GYAE6OF02IZZI8.45.53.E09.1.454.CMB.1.raw
tcagacgcgatcgacacgaccggtgctcgatttagagagagtgtgttgggtttggggacccaacaaccacatccctcctcttagaagcccccagagcacaactcctcaccatggactggacctggaggatcctctttttggtggcagcagccacaggtgtccactcccaggtccagcatgtgcagtctggggctggaggcgaagaagccgtggggcctcagtgaaggtttcctgcgaaggtcttcgtggatactactttcgctcgcccatgccattcagttgggtcgcgccacggccccccggacgaacgggcttggagtcggagtgggataggataccgaacggcgtgggccacgttacgggttaaccaacgaacggtaaattaacgttacaactaaacggtaaaactttacccgaaggtaaccgtaaggtacgtacccgaacgttaacgtttttccgtaaggggtaacaagtttaccgttttaaccggaccggtaaaactaacccgaacgtaaccccttaaccgtaagtacgggaacccgttaggaacgttacttaaccgggttttaggacgttaaacgttccgtaacgggtaaccgtaacccgtaaccgggttaccggttaacgttacccgttttaaacgtttaccgttagggttacggtacccggggtaacgggggaacgggggtaacccgggggggggggtaaaggggttactttaagggttacccgggtaaccgtaaaccgtttaaagggttacggttaaacgttttaacgttaaccggttttaggttaccgggtttaaccggg

SEQ ID NO: 236010 - DNA, 273 bp, Homo sapiens
  misc_feature: GYAE6OF02F55ZQ.45.53.E09.1.454.CMB.1.raw
  modified_base (267)..(273): a, c, t, g, unknown or other
  misc_feature (267)..(273): n is a, c, g, or t
tcagacgcgatcgacacgaccggtgctcgatttagagagagtgtgttgggggggagggatattgcactaatgattatactgtgtgccatgggttgagctcctggggccagggaaccctggtcaccgtctcctcagcctccaccaagggcccatcggtcttcccctggcgccctgctccaggagcacctccgagagcacagcggcctgggctgcctggtcaaggactacctcctcgactcgcgtctgagcggctggcaaggcgcatgnnnnnnn

SEQ ID NO: 236011 - DNA, 368 bp, Homo sapiens
  misc_feature: GYAE6OF02J0MX5.45.53.E09.1.454.CMB.1.raw
  modified_base (310)..(310): a, c, t, g, unknown or other
  misc_feature (310)..(310): n is a, c, g, or t
  modified_base (312)..(312): a, c, t, g, unknown or other
  misc_feature (312)..(312): n is a, c, g, or t
  modified_base (324)..(324): a, c, t, g, unknown or other
  misc_feature (324)..(324): n is a, c, g, or t
  modified_base (329)..(329): a, c, t, g, unknown or other
  misc_feature (329)..(329): n is a, c, g, or t
  modified_base (332)..(332): a, c, t, g, unknown or other
  misc_feature (332)..(332): n is a, c, g, or t
  modified_base (335)..(368): a, c, t, g, unknown or other
  misc_feature (335)..(368): n is a, c, g, or t
tcagacgcgatcgacacgaccggtgctcgatttagagagagtgtgggggagggatattgcactaatgattatactgtgtgccatgggttgagctctggggccagggaaccctggtcaccgtctcctcagcctccaccgaacgggcccatccggtccttccccccgtggccgcccctgcctccgaggacgccacccgtccgagacgccacacgccggccctgggctcgcctggtcaaaggcctaccttccacgatccggccgtcgtcgacggccgggtctcgggaccgaacggggcccgccaagttacggngncgtgctcgagtnagctnagngcnnnnnnnnnnnnnnnnnnnnnnnnnnnnnnnnnn

SEQ ID NO: 236012 - DNA, 236 bp, Homo sapiens
  misc_feature: GYAE6OF02GLZRH.45.53.E09.1.454.CMB.1.raw
  modified_base (222)..(236): a, c, t, g, unknown or other
  misc_feature (222)..(236): n is a, c, g, or t
tcagacgcgatcgacacgaccggtgctcgatttagagagagtgtgttgggtttgggtgccgaagttgctggaggtcaccgtctcctcagcctccaccaagggcccatcggtcttcccctggcgccctgctccaggagcacctccgagagcacagcggccctgggctgcctggtcaaggctcttcctcgatcgcgtctgacgcgggctggcaaggcgcatagnnnnnnnnnnnnnnn

SEQ ID NO: 236013 - DNA, 764 bp, Homo sapiens
  misc_feature: GYAE6OF02I1NAX.45.53.E09.1.454.CMB.1.raw
tcagacgcgatcgacacgaccggtgctcgatttagagagagtgtgttgggtttggggacccaacaaccacatccctcctcagaagcccccagagcacaactcctcaccatggactggacctggaggatccttctttttggtggcagcagccacaggtgtccacctcccaggtccagcatgtgcagtcgtggggctggaggcgaagaagccgtggggcctcgagtggaaggtttcctggcaaggtcttctggatactactttcgctcgcccagtcgccattcagttgggtgccgccgacggccccggagaacgggcttggaggtggagtgggatggatccgaacggcttgggcacgttaggttacacgtaaggtaattacgttaccaacgtaacggtaaaaacctttacccggaaagggtaaccctaagggtaaaccgtaccgttaacccgttaagtttttaccggtagggaaacttacgttacgtttacccgacgtaaactaccacggtacccttaactaggttaacgacccgttagggaaacgtgttaaccggtttgaacggtttaccttacggaccggtaaacccggtaccggtaacccgggtcgttttacggttaaccgtttaatttacgggtcggttacgaccgggtttaaggggaaccgggggggtaaccggggggggtaaggttaactttacggggtttacgaaccggttaactttaaggtacggtttaatttaacggtacgtttggacgggtttacg

SEQ ID NO: 236014 - DNA, 520 bp, Homo sapiens
  misc_feature: GYAE6OF02FYS79.45.53.E09.1.454.CMB.1.raw
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtgcgccaggccccccggacaagggcttggagtggatgggatgggatcgaacgctggcactggttacacagaatattcacagaaattccaaggacagagtcaccatttcagggacatattcgacgaacacagcctacatggacctgagcagtttgagtatctgacgacacggctgtctattacgtgtagcgaggaggacgggggggaggagttagttgactagtaatggaatttagacttgtgtacg

SEQ ID NO: 236015 - DNA, 830 bp, Homo sapiens
  misc_feature: GYAE6OF02GBGCI.45.53.E09.1.454.CMB.1.raw
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctggaggcgaagaagccgtggggcctcagtgaaggtttcctgcaaggcttctggatacactttcgctcgcccatcgccattcagttgggtgcgccgacgggccccccggacgaacgggtcttggaggtggagtggggtatgggaataccaacggtcgtacggcctacgtcggttaaccaacgtaagtaaattacttacaacaagtaaacttacccgaaggaaccaaggtaacgtaccctaaacccttagttttaccgtaacggggtaacctaagttaacgtttccggtaaccggaaacctaaccgtaaccggtacccccttaaacgtacgttaccgggtaacccgttacggaaccggttacgttaacgggttttacggtaaacggttaaccgttacccggttaacggtaacccgggtaaaccggtaacccggggttacccgtttacggtttacccgttttaaagtttacccggttacggttaccgggtaccgggtaacgggtacggggggggtaaaaccggggggggggttaacgggttaaacggttttaacggttaacgggtacccgtttaaaacgtttaaacggttaacggtttaaacgttttaacggtttaacggtttaggtttaggttaacccggg

SEQ ID NO: 236016 - DNA, 351 bp, Homo sapiens
  misc_feature: GYAE6OF02IVRY3.45.53.E09.1.454.CMB.1.raw
  modified_base (137)..(137): a, c, t, g, unknown or other
  misc_feature (137)..(137): n is a, c, g, or t
  modified_base (329)..(351): a, c, t, g, unknown or other
  misc_feature (329)..(351): n is a, c, g, or t
tcagacgcgatcgacacgaccggtgctcgatttagagagagtgtgttgggtttggggagggatattgcactaatgattatactgtgtgccatgggttgagctccgtggggccagggaaccctggtcaccgtctcctnagcctccaccgaacgggcccatccggtccttccccctggccgccctgcctcccgagggacgccacccgtccggagacgccacgaggccggcccctggggcctcgcccgtgggtacaagggaccttaccttccctcggattccgccgttctgggacggccggggtctggccaaaggggccggccaataggcannnnnnnnnnnnnnnnnnnnnnn

SEQ ID NO: 236017 - DNA, 620 bp, Homo sapiens
  misc_feature: GYAE6OF02H44PQ.45.53.E09.1.454.CMB.1.raw
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcaagaagcctggggcctcagtgaaggtttcctgcaaggcttcgaggatactactttcgctgcccagtcgccattcagttgggtgccgtccgacggtcccccggaactaagggccttggaggttggagtcgggatggatcgaacgctggcagtggttacacagaactattcaactagaaacttcgaagacagacgtctaacctatttacgaggtactatactacgacgaacacagcctaacgagtacggacctagacgtcgtaaggtttgagtacgtacgtacgaaccgaccgtaccggctacgttacttaacgttacgtacgtacgtacggtaggaccggggtaacggggggaggtaacgttacggttaggtaccgtaacgttaagtaccggtaagtttaacgtttacgttaggttagtaccgg

SEQ ID NO: 236018 - DNA, 735 bp, Homo sapiens
  misc_feature: GYAE6OF02ITGIE.45.53.E09.1.454.CMB.1.raw
  modified_base (229)..(229): a, c, t, g, unknown or other
  misc_feature (229)..(229): n is a, c, g, or t
  modified_base (329)..(329): a, c, t, g, unknown or other
  misc_feature (329)..(329): n is a, c, g, or t
tcagacgcgatcgacacgaccggtgctcgatttagagagagtgtgttgggtttggggacccaacaaccacatccctcctcagaagcccccagagcacaactcctcaccatggactggacctggaggatcctcttttggtggcagcagccacaggtcgtccactcccaggtccagcatgtgcagtctggggctgaggcgaagacgccgtggggcctcagtgaagtttccngcaaggcttctggactacaccttcaccggtcttactataataccacgttggggtcgacgtacgacggccccgtaggacaaggggccttggaggttacggngttcggggatagggactaccgaaaccccttaaagaagttcgggtaggaccaaacgtaaacctgtacggtcaaacgaggtaacgtttacgaagggtcgtacgggtaccaaccgtagtacggaacccgtacggggaactaccggttacccaacgtaccaacgcccgtaacgaaccggtacccgtaaccgaaggttacggaacggtccgttaaggtacgtacccgacgggttacgtcggtaagtaccttacgggaacgtaaccgggaccgtaaccgggtcggttaccgttaacgttacgtcggtagggtaccgaggaaggtaccgtaaggttaacgttaacggttagtttacggtaaggtttgggtttaacggttacgggtacggtttacggtacggtcgttaccgggg

SEQ ID NO: 236019 - DNA, 292 bp, Homo sapiens
  misc_feature: GYAE6OF02GG3W9.45.53.E09.1.454.CMB.1.raw
  modified_base (266)..(266): a, c, t, g, unknown or other
  misc_feature (266)..(266): n is a, c, g, or t
  modified_base (272)..(292): a, c, t, g, unknown or other
  misc_feature (272)..(292): n is a, c, g, or t
tcagacgcgatcgacacgaccggtgctcgatttagagagagtgtgttgggtttgggagggatattgcactaatgattatactgtgtgccatgggttgagctcctggggccagggaaccctggtcaccgtctcctcagcctccaccaagggcccatcggtcttccccctggcgccctgctccaggagcacctcgacgagcacagcggccctgggctgcctggtccaaggactacttcctactgctagctgagcgggctggcaaggcncatagnnnnnnnnnnnnnnnnnnnnn

SEQ ID NO: 236020 - DNA, 617 bp, Homo sapiens
  misc_feature: GYAE6OF02HU9Z2.45.53.E09.1.454.CMB.1.raw
tcagacgcgatcgacacgaccggtgctcgatttagagagagtgtgttgggtttggggacccaacaaccacatccctcctcagaagcccccagagcacaaactcctcaccatggactggacctggaggatcctcttttggtggcagcagccacaggtgtccactcccaggtccagcatgtgcagtctggggctgaggcgaagaagcctggggcctcgagtgaaggtttcctgcaaggcttctggatactactttcgctgcccatcgctattcatggtgcgccgacggccccggagaacggtcttgaggtggagtgggatggatcgaacgcgtggctagtcggtaacactagtaatagttcaacaagtaaacttccgaaggacaagtacactacctatttcgaaggtacaacgttacttccggaactaacacgactacctaacacgtacgaaccgtgacgtctagtttgaagtacgtcgtacgaaccgtacgacgggtcttagttacttacgttacttggtaccgagggtacggagggggtaacgggggggtaaggtaacgttaggttacggaccgtaacgttaacgtagtaacgtttaagtacggttaggtcgtacgg

SEQ ID NO: 236021 - DNA, 688 bp, Homo sapiens
  misc_feature: GYAE6OF02H7S5I.45.53.E09.1.454.CMB.1.raw
  modified_base (436)..(436): a, c, t, g, unknown or other
  misc_feature (436)..(436): n is a, c, g, or t
tcagacgcgatcgacacgaccggtgctcgatttagagagagtgtggttgggtttgggggactgatcaggactcctcagttcacttctcacaatgaggctccctgctcagctccgtggggctgctaatgctcgtgggtctcgttcggttccgaggtggggtattattggtgatgactcagtctccactcctccgtcgtccgtccacccgtggagacggccgcctcatctcgtgcgaggtctagcagcacctcctgactacgtaagtagtaggtaactactaacttacgtggtaggttactttcggttcgttacgacgacggaacggccggtaacgggctacgtccgtaccgacgacgttcctactggtacttctagtacggtggtacttccgttacgtccgggaccccggttcggtactagtcggtacgtagttcgnggttcggtcgtacgggttggtacgacgtcgtaacgttacgttaacttacgaagtacgtaactacgagtacgaggtaggtaggcgtacggtaggaaggtttaggttcgggtttaggttactacggttacgtacgtagtacggtacgtacggtttcgaacgtagttacggttcggtcgggttagggttcgggtacccggtaacgggacggtacggtaccggtggtaacgggaacgtaaccggtagttaaaccgg

SEQ ID NO: 236022 - DNA, 670 bp, Homo sapiens
  misc_feature: GYAE6OF02HKJIQ.45.53.E09.1.454.CMB.1.raw
  modified_base (142)..(142): a, c, t, g, unknown or other
  misc_feature (142)..(142): n is a, c, g, or t
  modified_base (240)..(240): a, c, t, g, unknown or other
  misc_feature (240)..(240): n is a, c, g, or t
  modified_base (277)..(277): a, c, t, g, unknown or other
  misc_feature (277)..(277): n is a, c, g, or t
  modified_base (553)..(553): a, c, t, g, unknown or other
  misc_feature (553)..(553): n is a, c, g, or t
  modified_base (569)..(569): a, c, t, g, unknown or other
  misc_feature (569)..(569): n is a, c, g, or t
tcagacgcgatcgacacgaccggtgctcgatttagagagagtgtgttgggtttggggacccaacaaccacatccctcctcagaacgcccccagagcacaactcctcaccatggactggacctggaggatccttctttttggnggcagccagccacgaggtgtccactcccaggtccagcatgtgcagtctggggctgaggcgtaaagaagccgtggggacctcgagtgtaacgtttcccnggcaaggtcttctgacttacactttcgctcgaccctntgccctatttaccagttgggtcgccgcccaccggggaccccccggaggtaacgggtcttggacggttagggaggtgggaatggaactcgaacgtcgtggccgttaactgggttaacacgtaagtaacttacgttcaacgaagtaaacttccgaaggaccaagtacgtctacctagtttccgtaaggatacttaagtccgaccgtaaacactaacgtccctaactagttacccgggacttacggactcgttaaagtttggaactcgtacggtacganacccgtagtcgttacncgtttatacttgacgaggtacgggcggggtaagggggacggttagttagtcggtaactaaggttaacgttagtaaggtttaaccggtttagtacggtacgg

SEQ ID NO: 236023 - DNA, 641 bp, Homo sapiens
  misc_feature: GYAE6OF02HL2EM.45.53.E09.1.454.CMB.1.raw
  modified_base (215)..(215): a, c, t, g, unknown or other
  misc_feature (215)..(215): n is a, c, g, or t
  modified_base (229)..(229): a, c, t, g, unknown or other
  misc_feature (229)..(229): n is a, c, g, or t
  modified_base (285)..(285): a, c, t, g, unknown or other
  misc_feature (285)..(285): n is a, c, g, or t
  modified_base (312)..(312): a, c, t, g, unknown or other
  misc_feature (312)..(312): n is a, c, g, or t
  modified_base (572)..(572): a, c, t, g, unknown or other
  misc_feature (572)..(572): n is a, c, g, or t
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtcgtggggctgaggcgaagagccgtgggcctnagtgaaggtttccngcaaggtcttcgtggatactactttcgctcgcccatcgcctattccagttggggtnccgtcccgaacgggtcccccccggaanaacggggtccttaggaggttgggtacgtggggtacgtgggtaacgtaccgaacgtcgtaggacctacggttacggttaaccaacgtaagtaaacttataaccgaacgtaagtaaacttaccgaggtaacacgtacgtaccacgttatttaccgaagactagttacgtacgaacacaacgcgtacctagtacggcgacgttgacgtacttagtacgatcgtacgtagacgtacgacgtcttgttacttatacgtcgttagngagggacggggacgggggtatacgttagtagacgtaattaagtagttagtacgttagtcgttgtaccgg

SEQ ID NO: 236024 - DNA, 453 bp, Homo sapiens
  misc_feature: GYAE6OF02FMNX0.45.53.E09.1.454.CMB.1.raw
  modified_base (144)..(144): a, c, t, g, unknown or other
  misc_feature (144)..(144): n is a, c, g, or t
  modified_base (190)..(190): a, c, t, g, unknown or other
  misc_feature (190)..(190): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (350)..(350): a, c, t, g, unknown or other
  misc_feature (350)..(350): n is a, c, g, or t
  modified_base (408)..(408): a, c, t, g, unknown or other
  misc_feature (408)..(408): n is a, c, g, or t
  modified_base (438)..(438): a, c, t, g, unknown or other
  misc_feature (438)..(438): n is a, c, g, or t
  modified_base (440)..(440): a, c, t, g, unknown or other
  misc_feature (440)..(440): n is a, c, g, or t
  modified_base (442)..(453): a, c, t, g, unknown or other
  misc_feature (442)..(453): n is a, c, g, or t
tcagacgcgatcgacacgaccggtgctcgatttagagagagtgtgatgggatggatcaacgctggcactggttacacagaatattcacagaaattccaggacagagtcaccatttctagggacatattcgcgaacacagcctanatggacctgagcagtttgagatctgacgacacggctgtctattacngtgcgagagacggggggggaggatattgcactaaatgattatactgtgtgccatggggttgagctcctggggccaagggaaccctggtccaccgtctccncngcctccaaccaagggcccagtcggtccttcccccctgggccgccctgcctccaaggcncgacctccgagacgcacgagccggaccctgggcctggcctggtcaaggtctacgttcncgattcgcgtctggagcggctggcaggcgnangnnnnnnnnnnnn

SEQ ID NO: 236025 - DNA, 788 bp, Homo sapiens
  misc_feature: GYAE6OF02H82LF.45.53.E09.1.454.CMB.1.raw
tcagacgcgatcgacacgaccggtgctcgatttagagagagtgtgttgggtttggggaccccaacaaccacatccctcctcagaacgcccccagagcacaactcctcaccatggactggacctggaggactccttctttttggtggcagcacgccacaggtcgtccacctcccgaggtccagcatgtgcagtcgtggggcgtggaggcgaagaaggcccgtgggggcctcgagttaggtaaccggttttccgtggacgtaggtccttcgtaggtactaccgtacctttcggcctcgacccatcgcctattcgtagttcgggtcgccgcccgacccgggacccccggtacggaacggtccgttggaggtcgggagtcggggtagtggacgtacgaacgtcgtcggtactaccggtagtaacctagtaactaacttactacaacgtaacgttaaacccgttcggaaacggacgttaacgacgttacccgtaacctttaacgttttcgggaacggtaactaacgttaacgtttacccgaaaccgtaaacccgtacggtaccctaaccgtaaacgtaaccggtacggaccgttacggtaccgttagttaacggtttcgaagtacgttacgttaccggaccggttaccaccggttacgtactttaccgttaccgttgttaacgggacgggttacgggaggggtacgggggggtaaggggaggtttaaccgtaggttaggtaacccttaggttaaagttcggtaaagttttacgtacgggtttagtagttccgg

SEQ ID NO: 236026 - DNA, 830 bp, Homo sapiens
  misc_feature: GYAE6OF02JH2GU.45.53.E09.1.454.CMB.1.raw
  modified_base (140)..(140): a, c, t, g, unknown or other
  misc_feature (140)..(140): n is a, c, g, or t
  modified_base (241)..(241): a, c, t, g, unknown or other
  misc_feature (241)..(241): n is a, c, g, or t
tcagacgcgatcgacacgaccggtgctcgatttagagagagtgtgttgggtttggggacccaacaaccacatccctcctcagaagcccccagagcacaactcctcaccatggactggacctggaggatccttcttttggnggcagcagccacaggtgtccactcccaggtccagcatgtgctagtcgtgggctgaggcgaaaggacgccgtcgggccttacgaggtagtaacggttttccngaccgaaggtccgttcgacggataccgttaacgtttccggcttcggacccctagtacgcctagttcctaaggttcgggtacacccggaccgtaccggggtaccccccggaaacggtaacgggtcgtttacggaacggtggaacgttggggacgtaggtaacgtacgaacggtcgtacggacgtacggttacgttaacgaaccggaagttaaacgtacgtttaccgaacgtttaaacggtaaaacccgtttccgaaacgggtaaacgtacggttaaccgtaaccgtaaacccgttaggttttaaccggtaagggtaacttaaagtttaaccggtcggtaaccgtaaaactaaccgtaacgtaaccctacggtaacggttaccgtaacccgttacgtaaccggtacgtttaacggttcggtaacacgtttacgtaaccggacgtaacgtaccgggtctttaccgtaacgtttaacgttaccgtcgggtaacgtacggtacggggtaacgggtaggggggtaacggtaagttacggttacgaagttaaccggttaagacgttaagttacgtttacggttcggtagttaccgg

SEQ ID NO: 236027 - DNA, 507 bp, Homo sapiens
  misc_feature: GYAE6OF01D53PH.14.3.A03.1.454.CMB.1.raw
  modified_base (499)..(499): a, c, t, g, unknown or other
  misc_feature (499)..(499): n is a, c, g, or t
tcagcgtctagtaccacgaccggtgctcgatttagagagcgtcacagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctcaagtctggcaacacggcctccctgagcatctctgggctcaggctgagacgaggctgattattactgcagctcatatactattagcagaacttgtggttttcggcggtaggacgaaggtgaccgtctaggtcagcccaaggcctcgcccctgtccnctcgtccg

SEQ ID NO: 236028 - DNA, 526 bp, Homo sapiens
  misc_feature: GYAE6OF01D9XQ3.14.3.A03.1.454.CMB.1.raw
  modified_base (316)..(316): a, c, t, g, unknown or other
  misc_feature (316)..(316): n is a, c, g, or t
tcagcgtctagtaccacgaccggtgctcgatttagagagcgtcacagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaatcattatttatgaggtcaataatcggccctnaggtatttctaatcgcttctctggctccaagtctggcaacacggcctccctgagcatctctgggctccaggctgaggacgaggctgattattactgcagctcatatactattagctagtaacttgttggtttcggcggtagggaccaagggtcgaccgtccgtaggtcacgcccgaaggcctcgcccccttgggtcctacgtcgttcccg

SEQ ID NO: 236029 - DNA, 505 bp, Homo sapiens
  misc_feature: GYAE6OF01A6V0D.14.3.A03.1.454.CMB.1.raw
  modified_base (356)..(356): a, c, t, g, unknown or other
  misc_feature (356)..(356): n is a, c, g, or t
  modified_base (395)..(395): a, c, t, g, unknown or other
  misc_feature (395)..(395): n is a, c, g, or t
  modified_base (497)..(497): a, c, t, g, unknown or other
  misc_feature (497)..(497): n is a, c, g, or t
tcagcgtctagtaccacgaccggtgctcgatttagagagcgtcacagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcaccaggcaaagcccccaaatcattatttatgaggtcaataatcggccctcaggagtttctaatcgcttctctggctccaagtctggcaacncggcctccctgagcatctctgggctccagctgaggacgnggctgattatactgcagctcatatactattagctagaacttgtggtttcggcggagggaccaaggtgaccgtctaggcagcccaaggcctcgccccctggcncgtctccg

SEQ ID NO: 236030 - DNA, 519 bp, Homo sapiens
  misc_feature: GYAE6OF01DGXFN.14.3.A03.1.454.CMB.1.raw
  modified_base (316)..(316): a, c, t, g, unknown or other
  misc_feature (316)..(316): n is a, c, g, or t
  modified_base (511)..(511): a, c, t, g, unknown or other
  misc_feature (511)..(511): n is a, c, g, or t
tcagcgtctagtaccacgaccggtgctcgatttagagagcgtcacagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaatcattatttatgaggtcaataatcggccctnaggagtttctaatcgcttctctggctcaagtctggcaacacggcctccctgagcatctctgggctccaggctgaggacgaggctgattattactgcagctcatatactattagcagaactgttaggttttcggcggtagggaccgaaggtcgaccggtccgtaggtcacgcccgaaggcctcgccccctggtccncgtctccg

SEQ ID NO: 236031 - DNA, 504 bp, Homo sapiens
  misc_feature: GYAE6OF01BUJXG.14.3.A03.1.454.CMB.1.raw
  modified_base (497)..(497): a, c, t, g, unknown or other
  misc_feature (497)..(497): n is a, c, g, or t
tcagcgtctagtaccacgaccggtgctcgatttagagagcgtcacaggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagctagaactgtggttttcgcggagggccaaggtgaccgtctaggtcagcccaaggctgcccctggtcnctctccg

SEQ ID NO: 236032 - DNA, 553 bp, Homo sapiens
  misc_feature: GYAE6OF01BHPBH.14.3.A03.1.454.CMB.1.raw
tcagcgtctagtaccacgaccggtgctcgatttagagagcgtcacagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcaccaggcaaacgcccccaaatcattatttatgaggtcaataatcggccctcaggtagtttctaatcgcttctctggctcaagtctggcaacacggcctccctgacgcatctcgtgggcctccgaggcctggaggacgaggctggatttattactgcagctcattatacttaatagactaagtaacttggttcgggtttcggcgggtacgggaccgtaagggtcggacccggtccgtaggtccacggcccgaaggcctaccggccccctagggtccacgttccgtcccg

SEQ ID NO: 236033 - DNA, 580 bp, Homo sapiens
  misc_feature: GYAE6OF01BIAUR.14.3.A03.1.454.CMB.1.raw
  modified_base (425)..(425): a, c, t, g, unknown or other
  misc_feature (425)..(425): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggtattatatttgtctctggtaccaacagcaccaggcaaacgccccaaatcattattatgagtcaataatcggccctcaggtagtttctaatcgtcttctcgtggctccaagtctggcaacaccggcctcctgacgctatctcgtcgggctccgaggctggacggacgagctagatttatacgtgcagtctanatatactaattagactaagtacgttggttcgggtttcggacggtaagggtaccgtaaagggtaccgtacccggttaccgtagggtaccgaacggaccccggtaaaggtcccgtcccggtaccccccgttggtaccctcccgtcccgtttaccccg

SEQ ID NO: 236034 - DNA, 546 bp, Homo sapiens
  misc_feature: GYAE6OF01AH8EB.14.3.A03.1.454.CMB.1.raw
  modified_base (316)..(316): a, c, t, g, unknown or other
  misc_feature (316)..(316): n is a, c, g, or t
  modified_base (420)..(420): a, c, t, g, unknown or other
  misc_feature (420)..(420): n is a, c, g, or t
tcagcgtctagtaccacgaccggtgctcgatttagagagcgtcacagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaacgcccccaaatcattatttatgaggtcaatatcggccctnaggtagttctaatcgcttctctggctccaagtctggcaacacggcctcctgagtatctcgtgggctccaggtctgaggacgaggctgtattattactgcagctnatatactatagactaagtaactgttggtttaccggagggtacggacgaaggtcgtaccgtccgtacggtcacggtcccgaaggtcctccgtcccccgttcggtcctaccgttcgtccgttaccccc

SEQ ID NO: 236035 - DNA, 515 bp, Homo sapiens
  misc_feature: GYAE6OF01E2BRC.14.3.A03.1.454.CMB.1.raw
  modified_base (320)..(320): a, c, t, g, unknown or other
  misc_feature (320)..(320): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgccactggaaccagtagtgacgttggttattataatttttgtctcctggtaccaacagcacccaggcaaagcccccaaactcattatttatgaggtcaataatcggccctnaggagtttctaatcgcttctctggctccaagtctggcaacacggcctccctgagcatctctgggctccaggctgaggacgaggctgatttattactgcagctcatatactattagcaagtaactgtggtttcggcggagggaccaaggtcgaccgtccgtaggtcagcccaaggctcgcccctggcactcgtccg

SEQ ID NO: 236036 - DNA, 537 bp, Homo sapiens
  misc_feature: GYAE6OF01DIU4X.14.3.A03.1.454.CMB.1.raw
  modified_base (263)..(263): a, c, t, g, unknown or other
  misc_feature (263)..(263): n is a, c, g, or t
  modified_base (362)..(362): a, c, t, g, unknown or other
  misc_feature (362)..(362): n is a, c, g, or t
  modified_base (526)..(526): a, c, t, g, unknown or other
  misc_feature (526)..(526): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaanagcacccaggacaaacgcccccaaactctattatttatgaggtcaataatccggccctcaggtagtttctaatcgcttctctgctcaagtctggcaacncgcctcctgagcatctctggctccaggctggaggacgaggctgtatttattactgcagctacatataacttattagctagtacgttgttgggttttcggcgggtaagggaccgaagggtcgaccgtcgtaggtcaacgcccgaaggccgtcgccccgtcggtcncctcgttcccg

SEQ ID NO: 236037 - DNA, 598 bp, Homo sapiens
  misc_feature: GYAE6OF01BUT96.14.3.A03.1.454.CMB.1.raw
  modified_base (221)..(221): a, c, t, g, unknown or other
  misc_feature (221)..(221): n is a, c, g, or t
  modified_base (259)..(259): a, c, t, g, unknown or other
  misc_feature (259)..(259): n is a, c, g, or t
tcagcgtctagtaccacgaccggtgctcgatttagagagcgtcacgagggggggtctcaggaggcagcgctctcaggacatctccaacatggcctgggctctgctgctcctcaccctcctcactcagggcacagggtcctgggcccagtctgccctgactcagcctgcctccgtgtctgggtctcctggacagtcgatcaccatctcctgcactggaaccngtagtgacgttggttattataatttgtctctgtacaanagcaccagacaaacgccccaaatcattattatgagtcaataatcggcctcaggtacgtttctaatcgtcttctctggcctcaagtctaggacaacacggcctccctgagctatccgtctgggcttaccgagggtctaggacgggacggaggccttaggtaatttacttacgtcgactacgtcctataattaactacttaattacgactaagtaacgttgttacgggtttcgggacggaacgggtaaccgtaggttacgaacccggttcgttagggtcctacggacccgtaaggcccgttaccgaccccccgttagggtcccacgtttcccgttaccccg

SEQ ID NO: 236038 - DNA, 642 bp, Homo sapiens
  misc_feature: GYAE6OF01CXDDJ.14.3.A03.1.454.CMB.1.raw
  modified_base (224)..(224): a, c, t, g, unknown or other
  misc_feature (224)..(224): n is a, c, g, or t
  modified_base (320)..(320): a, c, t, g, unknown or other
  misc_feature (320)..(320): n is a, c, g, or t
  modified_base (381)..(381): a, c, t, g, unknown or other
  misc_feature (381)..(381): n is a, c, g, or t
tcagcgtctagtaccacgaccggtgctcgatttagagagcgtcacgagggggggtctcaggaggcagcgctctcaggacatctccaccatggcctgggctctgctgctcctcaccctcctcactcagggcacgagggtccgtgggcccgagtcgtcgccctgactcagcctgcctccgtgtctgggtctcctggacagtcatcacatctcctgcactggaaccngtagtgacgttggtattataattttgtctctggtaccaacagcacccaggacaaacgccccaaactctattatttatgagtcaataatcggccctnaggtatttctaatcgcttctcttcggctaccgaagtctggacaacgacggcctcctggacncatctcgtggctcgagctgaggacgaggctgattatactgcagctacataactacttaattacgactaagtaacgttggttacgggttttaccggggacgggttaacggggaacccgtaaacggggttccggtaaccccggtttaccggttaacggggttaccgaacccgggtaacccccggtaaacgggtaccccgttcccggggtacccccccttaccgggggttccctaaacccgtttcccggttttaacccccccgg

SEQ ID NO: 236039 - DNA, 670 bp, Homo sapiens
  misc_feature: GYAE6OF01D678R.14.3.A03.1.454.CMB.1.raw
  modified_base (324)..(324): a, c, t, g, unknown or other
  misc_feature (324)..(324): n is a, c, g, or t
tcagcgtctagtaccacgaccggtgctcgatttagagagcgtcacagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgtacgttggttattattaattttgtctcctggtaccaacagccaccaggacaaacgccccaaactctatttatttatgaggtacaataactcggccctnaggtagtttctaatcgcttctctggctccaagtctggcaacaccggcctccctgagctatctcgtgggcctcgaggctggaggacgaggtctagtaatttacgttactgctacgcttacaattaacttaaccttaagttacgacgtaagtaaacgtttgggtttacggggttttaccgggacggggtaacggggtaaaccgtaaacggggttaccggtaaccccgggtttaccgttaaggggttacccgtaaaccgggtacccccggtaaaacgggtccccgttaccccgggtaccccccccggttacgggttaaccccttaaccgttccccgtttaccccccggg

SEQ ID NO: 236040 - DNA, 523 bp, Homo sapiens
  misc_feature: GYAE6OF01AH21N.14.3.A03.1.454.CMB.1.raw
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
  modified_base (415)..(415): a, c, t, g, unknown or other
  misc_feature (415)..(415): n is a, c, g, or t
  modified_base (485)..(485): a, c, t, g, unknown or other
  misc_feature (485)..(485): n is a, c, g, or t
tcagcgtctagtaccacgaccggtgctcgatttagagagcgtcacagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttangagtcaataatcggccctnaggtagtttctaatcgcttctctggcctcaagtctggcaacacggcctccctgacgcatctctggctccaggctggaggacgaggctgactttattacngcagctcatatactattagctagacttgttaggtttcggcggaggaccaaggtcgaccgtcgtaggtacncgcccgaaggcctcgccccctggtccaccgtcttcccg

SEQ ID NO: 236041 - DNA, 577 bp, Homo sapiens
  misc_feature: GYAE6OF01BWPBP.14.3.A03.1.454.CMB.1.raw
tcagcgtctagtaccacgaccggtgctcgatttagagagcgtcacagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaatcattattatgagtacaataatcggcctcagtagtttctaatcgcttctctggctccaagtctggcaacacggcctccctgacgcatctcgtgggcctcgaggctagaggacgaggctagtattattactgcagtctcatatactattagactaagtaacttggttgggtttacggacgggtacgggtaaccgtaagggtacggtacccggttccgttagggtaccgacggtaccccgaaagggtccctaccggtaccccccgtgggttaccctaccgttcccgttaccccg

SEQ ID NO: 236042 - DNA, 498 bp, Homo sapiens
  misc_feature: GYAE6OF01EAEOK.14.3.A03.1.454.CMB.1.raw
  modified_base (317)..(317): a, c, t, g, unknown or other
  misc_feature (317)..(317): n is a, c, g, or t
  modified_base (357)..(357): a, c, t, g, unknown or other
  misc_feature (357)..(357): n is a, c, g, or t
  modified_base (417)..(417): a, c, t, g, unknown or other
  misc_feature (417)..(417): n is a, c, g, or t
  modified_base (491)..(491): a, c, t, g, unknown or other
  misc_feature (491)..(491): n is a, c, g, or t
tcagcgtctagtaccacgaccggtgctcgattttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctctggtaccaacagcaccaggcaaacgcccccaaatcattatttatgaggtcaataatcggccctnaggtagtttcaatcgcttctctggctcaagtctggcaacncggcctcctgagcatctcgtggctccaggctgaggacgaggctgattattactgcagctnatatactatagcagtactgtggtttcggcggaggacaggtgaccgtcgtagcagccaggctcgcccctggtccnctctccg

SEQ ID NO: 236043 - DNA, 583 bp, Homo sapiens
  misc_feature: GYAE6OF01EQEAC.14.3.A03.1.454.CMB.1.raw
  modified_base (318)..(318): a, c, t, g, unknown or other
  misc_feature (318)..(318): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgtttggttattataattttgtctcctggtaccaacagcacccaggcaaagcccccaaactcattatttatgaggtcaatatcggccctnaggtagtttcaattcgcttctctggctccaagtctggcaacgcggcctccctgacgcattcctcgtcgggctcccgaggctagaggacggagctgatttattactgctagctcattaatacttaattacgactaagtaacttggttgggttttcgggacgggtacgggtaaccgaaagggttacgacccggttaccgttagggtccacggaccccgaagggccctccggtaccccccgtcggttctacccgttccgttcccccgg

SEQ ID NO: 236044 - DNA, 603 bp, Homo sapiens
  misc_feature: GYAE6OF01DKFYJ.14.3.A03.1.454.CMB.1.raw
  modified_base (258)..(258): a, c, t, g, unknown or other
  misc_feature (258)..(258): n is a, c, g, or t
  modified_base (289)..(289): a, c, t, g, unknown or other
  misc_feature (289)..(289): n is a, c, g, or t
  modified_base (309)..(309): a, c, t, g, unknown or other
  misc_feature (309)..(309): n is a, c, g, or t
tcagcgtctagtaccacgaccggtgctcgatttagagagcgtcacagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgtttggtattatatttgtctctgtaccaangcaccagcaaacgccccaactcattatttangaggtcaataatccggcctnaggtatttacaatccgcttctctggcctcaagtctggacaacgacggccctccctgacgctaatctcgtcgggtcctccgaggtcgtaggacgggacgacggtcgtagtatttacttacgtgtactagttacattattacttaagttacgactaagtaacgttggttcggttttacgggacgggtacgggtaaccgtaggtaccggtaaccggttccgtacggtacgacggtacccgaacgggtccgttcccgtcccccgttacggtacctacccttccgtcccgttacccccg

SEQ ID NO: 236045 - DNA, 519 bp, Homo sapiens
  misc_feature: GYAE6OF01C2P9I.14.3.A03.1.454.CMB.1.raw
  modified_base (261)..(261): a, c, t, g, unknown or other
  misc_feature (261)..(261): n is a, c, g, or t
  modified_base (293)..(293): a, c, t, g, unknown or other
  misc_feature (293)..(293): n is a, c, g, or t
  modified_base (309)..(309): a, c, t, g, unknown or other
  misc_feature (309)..(309): n is a, c, g, or t
  modified_base (409)..(409): a, c, t, g, unknown or other
  misc_feature (409)..(409): n is a, c, g, or t
tcagcgtctagtaccacgaccggtgctcgatttagagagcgtcacaggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaanagcacccaggcaaagccccaaatcattattangagtcaatatcgcctnagtagtttctaatcgcttctctggctccaagtctggcaacacgcctcctgagcatctctcggctccgaggctgaggacgaggctgattatactgcagctnatatactattagactagtaacttggttaggtttcggcggtaggtacgaaggtcgaccgtcgtaggtcacggacccgaaggcctccggacccctggtccacgtcttcccgg

SEQ ID NO: 236046 - DNA, 544 bp, Homo sapiens
  misc_feature: GYAE6OF01BXBI1.14.3.A03.1.454.CMB.1.raw
  modified_base (218)..(218): a, c, t, g, unknown or other
  misc_feature (218)..(218): n is a, c, g, or t
  modified_base (317)..(317): a, c, t, g, unknown or other
  misc_feature (317)..(317): n is a, c, g, or t
  modified_base (360)..(360): a, c, t, g, unknown or other
  misc_feature (360)..(360): n is a, c, g, or t
  modified_base (422)..(422): a, c, t, g, unknown or other
  misc_feature (422)..(422): n is a, c, g, or t
tcagcgtctagtaccacgaccggtgctcgatttagagagcgtcacaggggggggtctcaggaggcagcgctctcaggacatctccaccatggcctggctctgctgctcctcaccctctcactcagggcacagggtcctgggcccagtctgccctgactcagcctgcctcgtgtctgggtctcctggacagtcgatcaccatctcctgcactggaaccngtagtgacgttggttattataattttgtcttcctggtaccaacagcacccaggcaaacgcccccaaatcattatttatgaggtcaataatcggccctanaggtagtttctaatcgcttctctggctaccaagtctggcaacncggccctcctgagcatctctggctccgaggctagaggacgaggctgattattactgcagctnatatactattgactacgaattgtaggtttcggacggtacggtacgtaaggtcgtaccggtcgtaaggtccgtacgccgtaacggccgtacggcccccgttcggcctaccgtcgttaccccgg

SEQ ID NO: 236047 - DNA, 563 bp, Homo sapiens
  misc_feature: GYAE6OF01CG7WW.14.3.A03.1.454.CMB.1.raw
  modified_base (264)..(264): a, c, t, g, unknown or other
  misc_feature (264)..(264): n is a, c, g, or t
  modified_base (434)..(434): a, c, t, g, unknown or other
  misc_feature (434)..(434): n is a, c, g, or t
tcagcgtctagtaccacgaccggtgctcgatttagagagcgtcacgagggggggtctcaggaggcagcgctctcaggacatctccaccatggcctgggctctgctgctcctcaccctctcactcagggcacagggtcctgggcccagtctgccctgactcagcctgcctccgtgtctgggtctcctggacagtcgatcaccatctcctgcactggaaccagtagtgtacgtttggttattattaattttgtctctggtaccaanagcaccaggcaaacgccccaaatcattattatgagtcaaataatcggcctcaggtagtttctaatcgacttctctggctaccaagtctggacaacgacggcctccctgacgcatctcgtgggctccgacggctaggacggacgaggtctagtattattacgtgcagctanattatactaattacgactaagtacgttggttcgggtttacggacggtacggtacgaaggtcgtaccgtcgtaggtccgacgacccgaaggtccgtccggacccccgttggcctaccgtccgttccccgg

SEQ ID NO: 236048 - DNA, 547 bp, Homo sapiens
  misc_feature: GYAE6OF01CN1AB.14.3.A03.1.454.CMB.1.raw
  modified_base (420)..(420): a, c, t, g, unknown or other
  misc_feature (420)..(420): n is a, c, g, or t
tcagcgtctagtaccacgaccggtgctcgatttagagagcgtcacgaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaacgcccccaaatcattatttatgaggtcaataatcggccctcaggtagtttctaatcgcttctctggctccaagtctggcaacgacggcctccctgagcatctctgggcctccgaggctggaggacgaggctgtattattacngcagctcaatactactattagactagtaacttggtttgggtttcggcgggagggaccgaaagggtcgacccggtcgtaggtcgacgcccgaaggcctcgaccccctggtcccacgttccgttcccgg

SEQ ID NO: 236049 - DNA, 607 bp, Homo sapiens
  misc_feature: GYAE6OF01C7L7O.14.3.A03.1.454.CMB.1.raw
  modified_base (265)..(265): a, c, t, g, unknown or other
  misc_feature (265)..(265): n is a, c, g, or t
tcagcgtctagtaccacgaccggtgctcgatttagagagcgtcacgaggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccagtagtgacgtttggttaattataattttgtctcctggtaccaanacgcaccaggcaaacgaccccaaatcattatttatgaggtacaataatccggcctcgaggtatttctaatcgtcttctctggcctacctaagtctaggacaacgacggtccctcccgtgacgcatcctcgtagggtcctccgaggtctggacggacgaggctgtattattactgacagtctactaattactaacttaattacgactagtaacgttggtttacgggtttcgggacgggtaacgggtaaccgaaagggttcgaccccggttacgtacggtacgacggacccgtaacggtccgtcccggtaccccccgttaggtccctaccgttccgttccccgg

SEQ ID NO: 236050 - DNA, 679 bp, Homo sapiens
  misc_feature: GYAE6OF01ADYMO.14.3.A03.1.454.CMB.1.raw
  modified_base (257)..(257): a, c, t, g, unknown or other
  misc_feature (257)..(257): n is a, c, g, or t
  modified_base (288)..(288): a, c, t, g, unknown or other
  misc_feature (288)..(288): n is a, c, g, or t
tcagcgtctagtaccacgaccggtgctcgatttagagagcgtcacgagggggggtctcaggaggcagcgctctcaggacatctccaccatggcctgggctctgctgctcctcaccctcctcactcagggcacgagggtcctgggcccagtctgccctgactcagcctgcccccgtgtctgggtctcctggacagtcgatcacatctcctgcactggaaccagtagtgtacgtttgttattatatttgctctgacacngcaccaggcaaacgccccaaatcattattangagtcaatactccggcctgaggtatttcaatcgtcttctcgtcggcctacgaagtctcggacctaaccgccggtcctcccgtagaccgtctacttccgtcggtcggggtcccttccggaggtcgtacgggacgggtaacggaggtaccttagttaacgtttacgtttaacgcggtaccgtacgtcctaacgtaatttaaccttaacgttaaggttaacgacgttaaagggttaccgtttagggtttaccgggttaccgggacggggaacggtaaccggtacgggttaccgtacccggttaccggtacggtacccgaacggtccccggtaacggtcccgttaccccggtaccccgttcggtcccttacccgttcccgttcccgttacccccg

SEQ ID NO: 236051 - DNA, 541 bp, Homo sapiens
  misc_feature: GYAE6OF01BL38O.14.3.A03.1.454.CMB.1.raw
  modified_base (317)..(317): a, c, t, g, unknown or other
  misc_feature (317)..(317): n is a, c, g, or t
  modified_base (387)..(387): a, c, t, g, unknown or other
  misc_feature (387)..(387): n is a, c, g, or t
tcagcgtctagtaccacgaccggtgctcgatttagagagcgtcacagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctnaggatttctaatcgcttctctggctccaagtctggcaacacggcctccctgagcatctcgtgggcctcgnggctggacggacgaggctagtatttattactgcagtctacattactactattagactaagtacttggttcgggtttcggacgggtaacggaccgtaggtcgtaccgtcgtagcgacgacccgagtcctccgccccgtagtcctcgtccgtcccg

SEQ ID NO: 236052 - DNA, 801 bp, Homo sapiens
  misc_feature: GYAE6OF01D2MZW.14.3.A03.1.454.CMB.1.raw
  modified_base (222)..(222): a, c, t, g, unknown or other
  misc_feature (222)..(222): n is a, c, g, or t
tcagcgtctagtaccacgaccggtgctcgatttagagagcgtcacgagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaaccngtagtgacgtttggttattattattttgtctccgtagtaccaacacgcaccaggaccaaacgacccccaaactctaatttatttacgtgtaggtacaattaacgtcggaccctgtaggtagtttactaacgtcgtctttcgtcgtcgtccttaccgaagtcgtacggaccaaaccgaccgtccctccgtagacgctactcgttcgtcggtcctaccgacggtcgtacgggtaacggaccggtacggtaccgttagttaactttaaccgtttaccgtagtaccgtacggttcctttacgtaaactttaacgttaaccgtttaacgtttaaccgaacgttaaacggtttaaaccgtttggggttttaccggggttttttaccggggaaccgggggttaaaccggggtaacccggttaaacggggttaccggttaaaccccgggtttacccggttaaccggggtacccgtaaaccccggggtacccccgtaaaccggggttccccggttacccccgggttacccccccggttacccgggtttaccccgttaaccccggtttcccggttttaccccccccggg

SEQ ID NO: 236053 - DNA, 591 bp, Homo sapiens
  misc_feature: GYAE6OF01CRDXI.14.3.A03.1.454.CMB.1.raw
  modified_base (295)..(295): a, c, t, g, unknown or other
  misc_feature (295)..(295): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattattaatttgtctcctggtaccaacagcaccagcaaacgccccaactcattatttangagtacaatactcggtccctgaggtatttactaatccgtctttctcgtggtcctaccgtaacgtcgtggaccaacgccggtccctccgtgacgctactctcgtcggcctccgagcgtaggacggacggagtcgtagtatttacttacgtgcagtctactaattattaccttaattacgacgtaagtaacgttggtttacgggtttcgggacgggtacgggtaccgaaggtcggacccgttcgtaggtacacggacccgtaggccgtcccgaccccgtcgtcctccgttcctacccg

SEQ ID NO: 236054 - DNA, 678 bp, Homo sapiens
  misc_feature: GYAE6OF01B462W.14.3.A03.1.454.CMB.1.raw
  modified_base (261)..(262): a, c, t, g, unknown or other
  misc_feature (261)..(262): n is a, c, g, or t
  modified_base (293)..(293): a, c, t, g, unknown or other
  misc_feature (293)..(293): n is a, c, g, or t
tcagcgtctagtaccacgaccggtgctcgatttagagagcgtcacgaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctctgcactggaaccagtagtgtacgttggttattattaatttgtctctgtacaanncaccagcaacgaccccaaatctattatttangagtacaataacgtcggcctagaggtactttctaatacgtcttctcgtcggcctacgaagtctcgacaaccgacggcccttaccgtcgagactagtctcggtcggcctacgaggtcgtaggaacggtacggacggtacgttaggtaatttaacgttactacggacctagtaccttacgtaaactttacgttaaactttaagttaccgtacgtaaacggtaacgtttcggtttacggggttttacggacgggtaaccgggtaaccgtaacggggttacgtaaccccgggttccgttaagggtacccgtaaccggtccccgtaaacgggtcccgttcccggaccccccgtttaccgggtaccttcccgttcccgtttaccccccggg

SEQ ID NO: 236055 - DNA, 608 bp, Homo sapiens
  misc_feature: GYAE6OF01DK53N.14.3.A03.1.454.CMB.1.raw
  modified_base (450)..(450): a, c, t, g, unknown or other
  misc_feature (450)..(450): n is a, c, g, or t
  modified_base (482)..(482): a, c, t, g, unknown or other
  misc_feature (482)..(482): n is a, c, g, or t
tcagcgtctagtaccacgaccggtgctcgatttagagagcgtcacgaggggggggtctcaggaggcagcgctctcaggacatctccaccatggcctgggctctgctgctcctcaccctcctcactcagggcacagggtcagtgggcccagtctgccctgactcagcctgcctcgtgtcgtgggtctccgtggacagtcgatcaccatctcctgcactggaacctgtagtgtacgttggttaattattaattttgtctcctggtaccaacagcaccaggacaacgccccaaatcatttattatgagtacaataactccggcctgaggtagtttctaatcgtcttctcgtggctacgaagttctaggactaacgacggtccctccgtagacgtctattccgtcgtcgggcctaccgaggtcgtaggacggaacgtggctagtatttatacgngacagtctacgaattactaacttagtacgtanaacgtaacgttggttacggttacgggacggtagggaaccctaagggtaccgtaccgttaccgaggtcgaacccgtacccgtaacggtcccgttacccgccccccgttggtaccctcgtttccccgg

SEQ ID NO: 236056 - DNA, 715 bp, Homo sapiens
  misc_feature: GYAE6OF01C5M5B.14.3.A03.1.454.CMB.1.raw
  modified_base (219)..(219): a, c, t, g, unknown or other
  misc_feature (219)..(219): n is a, c, g, or t
  modified_base (423)..(423): a, c, t, g, unknown or other
  misc_feature (423)..(423): n is a, c, g, or t
  modified_base (651)..(651): a, c, t, g, unknown or other
  misc_feature (651)..(651): n is a, c, g, or t
tcagcgtctagtaccacgaccggtgctcgatttagagagcgtcacgaggggggggtctcaggaggcagcgctctcaggacatctccaccatggcctgggctctgctgctcctccaccctcctcactcagggcacgagggtcctgggcccagtctgccctgactcagctgcctcgtgtctggtctcgtggacagtcgatcacatcctctgcacgtgaacngtagtgtacgttagttattattatttcgtctcctgtaccacacgccaccgagaccaaccgacccccaatctaatttatttacgtaggtacggtactaaacgtaacgtccggtaccctagtaggttactttactaacgtccgttaccttcttcgtcggtccttacgtaacggttctacggaccaaccgtccggtcccttacccgnggaactcctacgttcccgtacggttcgggtccctaccggtacgggtcgttaacggggacggtaaccgggacggttacgttacggtttaacttttaacgtttaccacggacccgttactcccgttaatacgtttaaccttacgttaagttaccgacgtaagttacgttcggtttacgggttcggacgggtacgtaaccgtacgggtccgtaaccgttcgacggttaccncggtaccccggaggttcccgtccccggttaccccgtagttacccgccgtttccgttacccccgg

SEQ ID NO: 236057 - DNA, 647 bp, Homo sapiens
  misc_feature: GYAE6OF01DHI6K.14.3.A03.1.454.CMB.1.raw
  modified_base (298)..(298): a, c, t, g, unknown or other
  misc_feature (298)..(298): n is a, c, g, or t
  modified_base (306)..(306): a, c, t, g, unknown or other
  misc_feature (306)..(306): n is a, c, g, or t
tcagcgtctagtaccacgaccggtgctcgatttagagagcgtcacgaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaaccagtagtgacgtttgttattattaatttgtctctgtaccaacagcaccaggcaaacgccccaaactcatttatttangtaggtanaataactcggcctcaggtatttactaatcgctttctctggtctccaagtctcggacaaacgcgtccctcctgagcatctcgtcgggtcctccgacgggtctaggacggacggacggtcgttagtactttagtttactcgacgtacgtctacgtaatttattaaccttattaacggtaccgtaagttacgttggtttacgggtttttaccgggacggggtacggggtaaccgtaacgggttacggtacccggttacccggttaagggtcccgtaccggaccccggtaacggtccgttaccccggtccccccgttaccggtaccctcccttccgttacccccg

SEQ ID NO: 236058 - DNA, 812 bp, Homo sapiens
  misc_feature: GYAE6OF01DO37F.14.3.A03.1.454.CMB.1.raw
tcagcgtctagtaccacgaccggtgctcgatttagagagcgtcacgagggggggggtctcaggaggcagcgctctcaggacatctccaccatggcctgggctctgctgctcctcaccctcctcactcgagggcacagggtcctgggcccagtctcgccctgactcacgcctgcctccgtgtctgggtctcctggacagtcgatcaccatctcctgcactaggaaccagtagtgtacgttggttaatttattaagtttttgtccttccgtaggtacccaacgtacgcctaacccgaggaccaaaaccggtcccccaaaacttctaacgttttaattttacgaggtaaggttaccaaaagtttaacgtcccggtacccttacgaagggttacttttactaaacgtccgtactttctactggtacctcaaggtctacggacctaacgaccggtcccttacccaggactcctaacttcccgtacgttacgggccctccgaacgggtcgtacgggacgggaaccgggtaacggtccgttaggttaactttacgttaacgttggaccgtaaggtccttaactaaacttaacgtttaactaaacgttttacggaaccgttaaaggtaacggttttacgggtttacgggggtttttaccgggacggggttaaccggggtaaccggtaaacgggttaccgggtaaccccggttacccgttaacggggtaacccgtaacccgggtaaccccgaaccggggttacccgttaccccggtcccccggttaccggttacccgtacccgttccccgtttacccccgg

SEQ ID NO: 236059 - DNA, 697 bp, Homo sapiens
  misc_feature: GYAE6OF01CKEHH.14.3.A03.1.454.CMB.1.raw
  modified_base (270)..(270): a, c, t, g, unknown or other
  misc_feature (270)..(270): n is a, c, g, or t
  modified_base (308)..(308): a, c, t, g, unknown or other
  misc_feature (308)..(308): n is a, c, g, or t
tcagcgtctagtaccacgaccggtgctcgatttagagagcgtcacgaggggggggtctcaggaggcagcgctctcaggacatctccaccatggcctggctctgctgctcctcaccctcctcactcgagggcacagggtcctgggcccagtcctgccctgactcagcctgccctcgtgtcgtgggtctcctggacagtcgatccaaccattcctcctgccactggaaccagtagtgtacgtttgttattattatttgtctctagtaccaanagccaccgagacaaaccgaccccaatctaattatttangagtacaaatacgtccggtacctagaaggtactttactaatccgtcttctcctggtacctacgtaagttccgtagggaaccaaaccgaccggtccctcccgtagacgtacctacttccgtcggtcgggtccctcgtaagggtccttagggaacgggtacgtacgggtactagggttaattttacgttaccgtagtaccgtgttaccctataaactttatttaaaccgttaatttaacgaacgttaggttaaaccgtttggggtttacggggtttaccgggacgggtaacgggtaacctacgggtcgtacccgtacggtaggaccgaccgtacccgaagttccccggtcccgtaccccgttaccggtacccttccgttccgttcccccgg

SEQ ID NO: 236060 - DNA, 677 bp, Homo sapiens
  misc_feature: GYAE6OF01CEXVY.14.3.A03.1.454.CMB.1.raw
  modified_base (292)..(292): a, c, t, g, unknown or other
  misc_feature (292)..(292): n is a, c, g, or t
tcagcgtctagtaccacgaccggtgctcgatttagagagcgtcacgaggggggggtctcaggaggcagcgctctcaggacatctccaccatggcctgggctctgctgctcctcaccctcctcactcagggcacgagggtcctgggcccagtctgccctgactcagcctgcctccgtgtctgggtctccgtggacagtcgatcaccatctcctgcacgtggaaccagtagtgtacgttggttatattatttgtctctgtacacagcaccagacaacgccccaatcattattangagtacaataagtcggcctcgtagtagtttactaatcgtcttctctggctacgaagtcgtacggacaacgacgtccctcctgacgctactcgttcgtcggtcctcgagtcgtaggacggacgacggtcttaggtaactttacgttacgttcggactaacggtcttaactaattaacgttaactttaacgttaacgtaaccgtaacgttaaccggtttagggttttacgggggttttaccgggaaccggggttaaacggggtaaccgtaaacggggttcccggtaacccgggttaccggttaacgggttaccgaaccggtacccgaacgggttcccgttaccccggacccccgttcggtacccttacgttccccgtttacccccgg

SEQ ID NO: 236061 - DNA, 653 bp, Homo sapiens
  misc_feature: GYAE6OF01CDA4Z.14.3.A03.1.454.CMB.1.raw
  modified_base (303)..(303): a, c, t, g, unknown or other
  misc_feature (303)..(303): n is a, c, g, or t
  modified_base (323)..(323): a, c, t, g, unknown or other
  misc_feature (323)..(323): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgtacgtttggttaattataattttgtctcctggtaccaacagcacccaggcaaacgcccccaaactcatttatttangaggtcaataatcggccctnaggtagtttctaatcgcttctctggcctacctaagtctcggacaaaccgacggccctccgtgagctatcctcgtcggcctccgaggtctaggacggacgaggctagtactttattaccgtgacgtagtctactaattacttactaagttacgcgtaaggtaacgtttgggtttcgggttttaccgggacgggtaacgggtaaccgtaagggtaccggtacccggtaccggttaacgggtccgtaacccgggacccgtaaccggggtcccgttacccggtaccccccccggttaggttcccctaacccgtttcccggtttacccccccggg

SEQ ID NO: 236062 - DNA, 867 bp, Homo sapiens
  misc_feature: GYAE6OF01DHKBT.14.3.A03.1.454.CMB.1.raw
  modified_base (196)..(196): a, c, t, g, unknown or other
  misc_feature (196)..(196): n is a, c, g, or t
  modified_base (325)..(325): a, c, t, g, unknown or other
  misc_feature (325)..(325): n is a, c, g, or t
tcagcgtctagtaccacgaccggtgctcgatttagagagcgtcacgaggggggggtctcaggaggcagcgctctcaggacatctccaccatggcctgggctctgctgctcctcaccctcctcactcagggcacgagggtcctgggcccagtctgccctgactcagcctgcctccgtgtctgggtctccgtggaccngtcgatcaccatcctcctgcacgtggaacctaggtagtgtacgtttggttattattaatttttgtctcctacggtaaccaacgtacgccacccgagaccaaaccgtcccccaaactctatttaatttanagtacgtactaataactccggtaccctacgtagtacgtttactaacgttcgtaccttctccgttcggtcctaccgaagttccgtagggacccaaaccggacccggttcccttacccgtagggactaccgtacgttcccgttaccggtcggggtaccctaccgggtacgggtcccggttaaggggaacccgggtaaccgggtaacggttccggtttaagtaaccgttttaacgttaaacccggtttcggaacccgtagttaacccttaacggttaacgttaaatttaacccgttaaaggttacgtaaccgtaaaggttaaccgggttttgggttttaccgggggtttaaccgggaccggggttaaaacgggggtaacccgtaaacggggtttaccccgggtaaaccccggtttccgggttaacggggtacccggttaaacccgggaccccgggttaaacccgggtcccccgttaccccgggtaccccccccggtttacgggtacccccgtttaacccgtttcccccgggttttcccccccggg

SEQ ID NO: 236063 - DNA, 756 bp, Homo sapiens
  misc_feature: GYAE6OF01CTYP2.14.3.A03.1.454.CMB.1.raw
tcagcgtctagtaccacgaccggtgctcgatttagagagcgtcacgaggggggggtctcaggaggcagcgctctcaggacatctccaccatggcctgggctctgctgcctcctccaccctcctcactcgagggcacgacgggtcctcgggcccagtctcgccctgactcagcctgcctcgtgtctggtcctccgtggacagtcgatcacatctcctgcactgaaccagtagtgtacgttgttattattaatttcgtcctccgtaggtaccaacacgaccaaccgaggaccaaaccgaccccctaaactacttaatttaacgtttacgtaggtaacgtacgtaaacttaccgtaccggtaccgtacgtaaggttacgttttactaaacgttccgttaccgttcttcggtcgtacccgtacgtaacgtccgtacggaccgaaccggtaccggtcccctaccgtagtaacgactaccgtccgtcggtaccggtccgtaccgtacgggcgttaacgggacgggtacggtacggtcttaagtactttaacgtacgtcgacgtagtcttaacgtacttaacgttaaccttaaggttacgtaacgtacggtttaacgggtttcgggttttaccgggttacggggaaccgggtaacgggtaccggtaaacgggtaccgtacccggttaaccgtacggtaaccggacgacccgtaaggtcccgtaccccgtccccggtacgccgttacccgttccgttcccccgg

SEQ ID NO: 236064 - DNA, 577 bp, Homo sapiens
  misc_feature: GYAE6OF01A78UV.14.3.A03.1.454.CMB.1.raw
  modified_base (296)..(296): a, c, t, g, unknown or other
  misc_feature (296)..(296): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataagtatgtctcctggtaccaacaacaccaggcaaacgcccccaaatcatgatttangaggtcagtaatcggccctcgagggtttctaatcgtcttctctggctcagtctgcaacacggcctcctgaccatctctggtctccgaggctggacggacgagtctgtatttattagttgctagcttactatatgcctaccgtgtacagtactaatcaagttcggttcgggttttaccggggccggggggttaaccgtaacggggttcggtaaccccggttcccggttagggttcccgacgggtacccgacgggtccctccggtccccccgttggtaccccg

SEQ ID NO: 236065 - DNA, 562 bp, Homo sapiens
  misc_feature: GYAE6OF01E0Y5M.14.3.A03.1.454.CMB.1.raw
  modified_base (257)..(257): a, c, t, g, unknown or other
  misc_feature (257)..(257): n is a, c, g, or t
  modified_base (289)..(289): a, c, t, g, unknown or other
  misc_feature (289)..(289): n is a, c, g, or t
  modified_base (350)..(350): a, c, t, g, unknown or other
  misc_feature (350)..(350): n is a, c, g, or t
  modified_base (425)..(425): a, c, t, g, unknown or other
  misc_feature (425)..(425): n is a, c, g, or t
  modified_base (452)..(452): a, c, t, g, unknown or other
  misc_feature (452)..(452): n is a, c, g, or t
tcagcgtctagtaccacgaccggtgctcgatttagagagcgtcacgaggggggggtctcaggaggcagcgctctcaggacatctccaccatggcctggctctgctgctcctcacccctcctcactcagggcacgagggtcctgggcccagtctgccctgactcagcctgcctccgtgtctggtctcgtggacagtcgatcaccatcctctgcacgtgaacagtagtgtacgttgttattattatttgtctctgacangcaccagacaacgccccaatctatttattagngtacggtacaagtactccgcctgtagtactttacatctcttctcgtcgcctacgagttcgngaccaacgccgtccctccgtagacgctactctcgtgcctcgagtcgtaggagacgagtctagttacttagtacgngactgtcttactagttactactatacngtaagtacgttgggttacgggttacggacggacggtacgtacggttcgacccggttcgaggtccacgacccgtagtcccgtccgtcccgtcgccttcctcccgttccccg

SEQ ID NO: 236066 - DNA, 646 bp, Homo sapiens
  misc_feature: GYAE6OF01EQI2C.14.3.A03.1.454.CMB.1.raw
  modified_base (264)..(264): a, c, t, g, unknown or other
  misc_feature (264)..(264): n is a, c, g, or t
  modified_base (445)..(445): a, c, t, g, unknown or other
  misc_feature (445)..(445): n is a, c, g, or t
tcagcgtctagtaccacgaccggtgctcgatttagagagcgtcacgaggggggggtctcaggaggcagcgctctcaggacatctccaccatggcctggctctgctgctcctcaccctcctcactcagggcacagggtcctgggcccagtctgccctgactcagcctgcctccgtgtctgggtctcctggacagtcgatcaccatctcctgcactggaaccagtagtgacgttgttattattaattttgtctcctggtaccaacngcacccaggacaaacgacccccaaactctattatttatgtaggtacaataacgtccgccctgtaggtacgtttactaatcgtcttctctcggctcaagtctcgacaacgacgcctccgtgacgctatctcgtcggtcctccagactacggaggacggacgtacgtagtaattttacgtacncgtaccaactcgtaatacgtaagtaacgttaacgttaacccttacgttccgttaggtttcggtttaccgggacgggaacgggtaacctaaggtccgtaaccggtacccggttaccggtaggtaccgtaaccggaccccgtaacgggtcccgtaccccggtccccggttaccggtacccgtacccgttcggttaccccccgg

SEQ ID NO: 236067 - DNA, 608 bp, Homo sapiens
  misc_feature: GYAE6OF01B9YBJ.14.3.A03.1.454.CMB.1.raw
  modified_base (207)..(207): a, c, t, g, unknown or other
  misc_feature (207)..(207): n is a, c, g, or t
tcagcgtctagtaccacgaccggtgctcgatttagagagcgtcacgaggggggggtctcaggaggcagcgctctcaggacatctccaccatggcctgggctctgctgctcctcaccctcctcactcagggcacgagggtcctgggcccagtctgccctgactcagcctgcctccgtgtctggtctcctggacagtcgatcaccatcncctgcactggaaccagtagtgtacgttgttattataattttgtctcgtggtaccaacagacaccaggacaaacgccccaaatcaatttatttatagtagtacaaataactccggtcctactaggtacgtttctaactcgtacttcctcgtagtcctacaagtctggacaaccgaccggtccctacctagacgctatcttcgtcgggcctccgaggtcgtaggacggacggacggcttagtaatttacttactgcagtctatattatactaattacgagtacgtaagttggttacgggtttcggacgggtacgggaacgtaggtacgtacccggtactacgggtcgaacgtacccgacgggtcctaccggacccccgttggtaccctcgttccgttccccgg

SEQ ID NO: 236068 - DNA, 678 bp, Homo sapiens
  misc_feature: GYAE6OF01BCW1V.14.3.A03.1.454.CMB.1.raw
  modified_base (220)..(220): a, c, t, g, unknown or other
  misc_feature (220)..(220): n is a, c, g, or t
  modified_base (293)..(293): a, c, t, g, unknown or other
  misc_feature (293)..(293): n is a, c, g, or t
tcagcgtctagtaccacgaccggtgctcgatttagagagcgtcacgagggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccngtagtgtacgttggttattatattttgtctcctgtaccacagcaccaggacaaacgccccaaatcattattangagtcaatatcggcctacaggtatttactaatcgtcttctctcggtctaccaagtctaggaccaacgtaccggtccctacccgtgaacgtcctaacgttccgtcggtcgggtccctacccgaagggtccgttacgggaacgggtaaccggacgggtaccgttaggtaacgtttacgtttaaccgtcgtacgtacggtctacgtaattaacttaacttaacgttacgaccgtaacgtaacgttggtttacgggttttaccgggacgggtaacgggtaaccgtaagggtacggtaacccggttaccgttagggtacccgtaccggaccccgtaaggtcccgtacccggtacccccgttacgggtccctaccgtcccggtttaccccg

SEQ ID NO: 236069 - DNA, 637 bp, Homo sapiens
  misc_feature: GYAE6OF01B1HJV.14.3.A03.1.454.CMB.1.raw
  modified_base (323)..(323): a, c, t, g, unknown or other
  misc_feature (323)..(323): n is a, c, g, or t
tcagcgtctagtaccacgaccggtgctcgatttagagagcgtcacgaggggggggtctcaggaggcagcgctctcaggacatctccaccatggcctggctctgctgctcctcaccctcctcactcagggcacagggtcctgggcccagtctgccctgactcagcctgcctccgtgtctgggtctcctggacagtcgatccaccatcctcctgccagtggaaccagtagtgtacgttggttattattaattttcgtctcctggtaccaacagcaccaggcaaacgcccccaaactcattatttatgagtcaataatcggccctnaggtatttctaagtcgcttctcgtgctcaagtctggacaacacgcctcccgtgacgcactctcgtcggctccgaggctaggagggaccgaggtctaggtatttacgttacgtgacagtccttacgtaattactacttaattacggacttaacggtaaactttggggtttacggggttttaccgggccggggaaacggggtaaccgtaaaggggttccggtaacccggttccgttagggttacccgaggtacccccgaaagggtccctcccgggttccccccgtaccgggttaccctaccgttcgttacccccgg

SEQ ID NO: 236070 - DNA, 697 bp, Homo sapiens
  misc_feature: GYAE6OF01EE2TP.14.3.A03.1.454.CMB.1.raw
  modified_base (301)..(301): a, c, t, g, unknown or other
  misc_feature (301)..(301): n is a, c, g, or t
tcagcgtctagtaccacgaccggtgctcgatttagagagcgtcacgaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgccacgtggaaccagtagtgtacgttgttattattaattttgtctctagtaccaacagccaccagacaaacgaccccaatctattattangtagtacaataacgtccgcctagagtacgtttactaactcgtcttctcgtggtcctacgtaagttcgtacggaccaaccgaccggtcccttcccgtagacgtactacgttccttcggtacgggtcccttaccggacgggtacgttacggggaaacgggaaccggtaggtacttagttaacttttaacgttaccgttgacgtacgtccttactaatttaacgttaattaacgttaacgacgtaaagttaaccggtttgggtttacgggtttacgggaccgggtaacgggtaacgtacgggttaccgtacccggttaccgtaggtacgaaccggtacccggtaacggtcccgttccccggtaccccccgtgggttaccctccgttcccgttaccccgg

SEQ ID NO: 236071 - DNA, 791 bp, Homo sapiens
  misc_feature: GYAE6OF01E5VP3.14.3.A03.1.454.CMB.1.raw
tcagcgtctagtaccacgaccggtgctcgatttagagagcgtcacgaggggggggtctcaggaggcagcgctctcaggacatctccaccatggcctgggctctgctgctcctcaccctcctcactcagggcacagggtcctgggcccagtctgccctgactcagcctgcctcgtgtctggtctcctggacagtcgatcaccatctcctgcactggaaccagtagtgtacgttggttattattattttcgtctcctgtaccaacagccacccaggacaaacgaccccccaaactctattatttatagaggtacaattaacgtccggccctacgaggtacgttttactaaacgttcgtacttcctcgttcggcctacctaaacgttccgtgggtacccaaaccgtacccggcccctttaccccgtaggtaacgcctagttacccgtccggtacgggtcccgttacccgacgggtacccgttaggggaacgggtaacccgggaacgggtacgttaggttaacgtttaacgtttacgtacgacccgtacgtaccttacgtaaacttacgtttaaacttaacgttacgtaccgtaaacggttaacggtttggggtttaccgggttttaccggggaacccggggttaaaccgggtaacccgggtaaacgggttacccggtaacccgggttccgttaaccggggtacccgtaccggtaacccccggaacgggttccccgtccccggttaccccccggttacccgggttccctaccccgtttcccgtttacccccccgg

SEQ ID NO: 236072 - DNA, 709 bp, Homo sapiens
  misc_feature: GYAE6OF01AMFXD.14.3.A03.1.454.CMB.1.raw
  modified_base (272)..(272): a, c, t, g, unknown or other
  misc_feature (272)..(272): n is a, c, g, or t
tcagcgtctagtaccacgaccggtgctcgatttagagagcgtcacgaggggggggtctcaggaggcagcgctctcaggacatctccaccatggcctgggctctgctgctcctcaccctcctcactcagggcacgagggtcctgggcccagtctgccctgactcagcctgcctcgtgtctgggtctccgtggacagtcgatccaccatcctcctgcacgtggaaccaggtagtgtacgtttggttattattattttgtctcctggtaccaacngccacccaggaccaaacgcccccaaatctattatttatgagtacaatacgtccggcctagaggtagtttactaatcgtcttcctcgtcgcctacgtaagtcgtacggacaaccgaccggtccctcccgtagacgtctacgtccttccggtcgggccttaccggacggtcgtagggaacgggtaccggtacggtacgttaggttaactttaaccgtttaaccgtcggtaccgtacggtaccttacgtaacgtttaacttaaccgttaagttaaccgacgttaaacggttacggttttgggtttacgggttttaccggggaacggggtaaccgggtaaccgtaacggggttaccgtacccggttaccggtacggtaccgaccggacccgaacggtccctcccggtacccccgttcggtaccctcgttcccgttccccgg

SEQ ID NO: 236073 - DNA, 551 bp, Homo sapiens
  misc_feature: GYAE6OF01DV3WF.14.3.A03.1.454.CMB.1.raw
  modified_base (295)..(295): a, c, t, g, unknown or other
  misc_feature (295)..(295): n is a, c, g, or t
  modified_base (306)..(306): a, c, t, g, unknown or other
  misc_feature (306)..(306): n is a, c, g, or t
  modified_base (312)..(312): a, c, t, g, unknown or other
  misc_feature (312)..(312): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcaccagcaaacgccccaaatcattatttangagtcaataancgcctnagtagtttctaatcgcttctctgctcaagtctggcaacacgcctcctgagcatctcgtggctcgaggctagaggacgaggctgtatttattactgcagtctacatatactattacgatagtaacttggttggttttcggacgggtaacgggaaccgtaagggtcgacccggttaccgttagggtcgacgacccgaaggtccgtccgacccccgttggtaccctaccgttcgttaccccg

SEQ ID NO: 236074 - DNA, 575 bp, Homo sapiens
  misc_feature: GYAE6OF01BDLD3.14.3.A03.1.454.CMB.1.raw
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctctgtaccaacagcaccaggcaaacgccccaaatcattatttatgaggtcaataatcggccctgaggtagtttctaatcgcttctctggctccaagtctggacaacacggcctcccgtgagcatctcgtgggccttccgaggctggacggacgaggctagtatttattacgtgcagctacatactactattacgctaagtaacgtttggttagggtttcggacgggtacgggtaccgtaagggtacggacccgtccgttagggtaccacggtaccccgaaggtccctaccggtccccccgtaggttcccaccgttccgttacccg

SEQ ID NO: 236075 - DNA, 614 bp, Homo sapiens
  misc_feature: GYAE6OF01EDD0C.14.3.A03.1.454.CMB.1.raw
  modified_base (222)..(222): a, c, t, g, unknown or other
  misc_feature (222)..(222): n is a, c, g, or t
  modified_base (260)..(260): a, c, t, g, unknown or other
  misc_feature (260)..(260): n is a, c, g, or t
  modified_base (310)..(310): a, c, t, g, unknown or other
  misc_feature (310)..(310): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaaccngtagtgacgttgttattataattttgtctctgtaccangcaccagcaaacgccccaaatctattattatgaggtcaataatcggcctnaggtatttcaatcgcttctctggctccgaagtctggccaaacaccggtcctccctgacgctatctcgtgggcctccgaggctggaggacggaggtctagtatttattaacgtcgcagtctactatattaacctattacgactaagtaacgtttggttcgggttttacgggaccggggtaacgggtaacccgtaaaggggttccggtaacccggttccgttacgggtaccgaccggtaaccccgaaagggtccccttacccgggtccccccgttacgggttccctaaccgttcccgtttaccccg

SEQ ID NO: 236076 - DNA, 612 bp, Homo sapiens
  misc_feature: GYAE6OF01BK9QV.14.3.A03.1.454.CMB.1.raw
  modified_base (222)..(222): a, c, t, g, unknown or other
  misc_feature (222)..(222): n is a, c, g, or t
  modified_base (235)..(235): a, c, t, g, unknown or other
  misc_feature (235)..(235): n is a, c, g, or t
tcagcgtctagtaccacgaccggtgctcgatttagagagcgtcacgaggggggggtctcaggaggcagcgctctcaggacatctccaccatggcctggctctgctgctcctcaccctcctcactcagggcacagggtcctgggcccagtctgccctgactcagcctccctccgcgtccgggtctcctggacagtcagtcaccatactcctgcactggaaccngcagtgacgttgngtcttatactttgtctctggtacaacagcaccagacaaacgccccaaactcatgtatttatgacgtacaataacgccggtcccgtcggggtccctgactcgtcttcgtcgtcgcctaccgaacgttcgtcggaccaacgaccggtccctcccgtcgtaccgttctcgtcgggcctccgacgcgtacgacgtagtcggacggtcttagtatttacgttacgtcgacgtacgtcctacacgtatcgactacgtactaacgttaaacgttacggttttcggggttacggacgggtacggaacgtacgtcgtaccgtaccgtaccgtagaccgacgacccgtacggctacccgtcccgtacgtcctccgttccgtaccccg

SEQ ID NO: 236077 - DNA, 688 bp, Homo sapiens
  misc_feature: GYAE6OF01C1HRR.14.3.A03.1.454.CMB.1.raw
  modified_base (165)..(165): a, c, t, g, unknown or other
  misc_feature (165)..(165): n is a, c, g, or t
  modified_base (662)..(662): a, c, t, g, unknown or other
  misc_feature (662)..(662): n is a, c, g, or t
tcagcgtctagtaccacgaccggtgctcgatttagagagcgtcacgaggggggggtctcagggaggcagcgctctcaggacatctccaccatggcctgggctctgctgctcctcaccctcctcactcagggcacagggtcctgggcccagtctgccctgactcancctgcctcgtgtctgggtctctggacagtcgatccacatctcctgccacgtggaacctaggtagtgtacgtttggttaatttaattaatttttcgtccttccgttaggtaacccaaacgacgaccaacccagggaccaaaacccgccccccaaaattcctaaattttatttagtagtaagttaccaaattaacgtccggacccctgaaggttacgtttactaactcgtctttccgtcgtacggaccttaccgaagttcgtacgggaccaaaccggccggtaccctcccgtaggacgtacacgttccgtccgtacgggtcctaccggacgggtccgttagggacggtaacggacggttacgtagttaactttacgttacgcggtacacgtacctactaagttaacttacttacgttaacgactaaggtaacgttggttacggttacgggacggtacggaccgtaaggtccgaccggtcgtagcaccgccgtacgtccnccgtccccgtgtcctgtccgttcccg

SEQ ID NO: 236078 - DNA, 840 bp, Homo sapiens
  misc_feature: GYAE6OF01ATS8T.14.3.A03.1.454.CMB.1.raw
tcagcgtctagtaccacgaccggtgctcgatttagagagcgtcacagggggggatctcaggaggcagcgctctcaggacatctccaccatggcctgggctctgctgctcctccacctctcactcgaggcacggcggtccgtcggcctgtcgtcgtccgtcgactcgacgtccgtcgtccgttcgtcgtcggttcgggtcctcgtcgactacgtcgtactccactacttcctcgtacgcgtacgtacggaacctaggtacgtacggttacggtttaggtttattttaacgtttacgttttcgtccgttaccgttaacggtaaccaacgacgtacccaaccgaacggaaccaaacccgtaacccctaaacttacttaattttaactttacggtacggtaacggtaactaaacgttaccggtcccggtaccttaggtaacgggtttactttactaacgttccgttcctttccgttcggtaccgtctaacgtacgttcgacgaaccgaccgccgtccctacgtggactacgtacttccgtcggtacgtccgtcggagtcggtagggaacggtccgtaggtctagttacttacgttcaggacctgttactaacgttaacgttacttaagttacgtacggtaaccgttaaaggtacgggttttcgggtttaccgggaccgggtaacgggggtaccgttaaacgggtaaccgggtttcccgggtaaacccgtttaggggtaaccccggtacgggtaaccccggtaacccgggtaccccggttaccggttccccccggtaccccggttttaccggttaaccccgtttcccggttttaaacccccgggg

SEQ ID NO: 236079 - DNA, 581 bp, Homo sapiens
  misc_feature: GYAE6OF01ATBYX.14.3.A03.1.454.CMB.1.raw
  modified_base (450)..(450): a, c, t, g, unknown or other
  misc_feature (450)..(450): n is a, c, g, or t
  modified_base (454)..(454): a, c, t, g, unknown or other
  misc_feature (454)..(454): n is a, c, g, or t
  modified_base (541)..(541): a, c, t, g, unknown or other
  misc_feature (541)..(541): n is a, c, g, or t
  modified_base (550)..(550): a, c, t, g, unknown or other
  misc_feature (550)..(550): n is a, c, g, or t
tcagcgtctagtaccacgaccggtgctcgatttagagagcgtcacaggggggggtctcaggaggcagcgctctcaggacatctccaccatggcctggctctgctgctcctcaccctcctcactcagggcacagggtcctgggcccagtctgccctgactcagcctgcctccgtgtctgggtctcctggacagtcgatcaccatctcctgcactggaaccagtagtgtacgtttggttattattaattttgtcttcctggtaaccaacagccacccaggaccaaacgcccccaaatctatttatttatgagtacaataatccggccctgaggtagtttactaactcgtctttctcgtcggtcctaccagtctggaccaacgccgtccctccgtgacgctactcctgtcgggcctcgaggctgggaggacgaggtcttagactttagtacgngacncgctactaagtacttacttatacgactagtacgttggttcggtttacgggacggtacggaccgtagggtacgtaccgtcgtaggacncggacccgngccgtcccgccctccggctccgtccgtcccg

SEQ ID NO: 236080 - DNA, 627 bp, Homo sapiens
  misc_feature: GYAE6OF01ATXQQ.14.3.A03.1.454.CMB.1.raw
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
  modified_base (437)..(437): a, c, t, g, unknown or other
  misc_feature (437)..(437): n is a, c, g, or t
tcagcgtctagtaccacgaccggtgctcgatttagagagcgtcacagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctctgcactggaaccagtagtgacgttggttattataattttcgtctcctggtaccaactgcacccaggaccaaacgcccccaaatcattactttangaggtcaataatcggccctnaaggtgtttactaactcgctttctctcggcctacagtctaggcaacgacggcctccctgacgcactcgtcgtcggcctccgagtcgtggacggagtaggctagtacgtttattacngcagcgtacaattagtaacttattacgacctaagtaaccttgggtttacgggttttccgggacgggtaacgggtaccgtaaaggggttcccgtaaccggttacccggtagggtaccgtacccggacccgtaaacgggcccgttacccggtaccccccgtagggtccctaacccgttccgtttacccccgg

SEQ ID NO: 236081 - DNA, 586 bp, Homo sapiens
  misc_feature: GYAE6OF01BDD4X.14.3.A03.1.454.CMB.1.raw
  modified_base (259)..(259): a, c, t, g, unknown or other
  misc_feature (259)..(259): n is a, c, g, or t
  modified_base (344)..(344): a, c, t, g, unknown or other
  misc_feature (344)..(344): n is a, c, g, or t
tcagcgtctagtaccacgaccggtgctcgatttagagagcgtcacgaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttgttattatatttgtctctgtaccaangcaccagacaacgccccaaatcatttatttatgagtacaatatcggcctcgaggtatttcaatcgtcttctcgtgctctaagtcnggacaacgcgcctcctgacgcatctcgtcggcctccgaggtctggaaggacgaggtctagtatttattacgtcgtacagtctactattataactattacgactaagtaacgttggtttacgggtttacggacgggtaagggtaccgtaagggtaccggtacccggtaccgtagggtaccgtacggacccgtaaggtcccgtaccggtccccccgttaggtaccctccgttcccgttacccgg

SEQ ID NO: 236082 - DNA, 793 bp, Homo sapiens
  misc_feature: GYAE6OF01C73B3.14.3.A03.1.454.CMB.1.raw
tcagcgtctagtaccacgaccggtgctcgatttagagagcgtcacgaggggggggtcccaggaggcagcgctctcaggacatctccaccatggcctgggctctgctgctcctcaccctcctcactcagggcacgagggtcctgggcccagtctgccctgactcagcctgcctccgtgtcgtgggtctccgtggacagtcgatcaccatcctctgcacgtggaacagtagtgtacgtttgttattattaagttttgctctggtaccaacagcaccaggaccaaacgcccccaaactctaactttatttacgtgaacggtactaaactaacgtccggaccctacgtaacggtagttttacctaaacgttccggtaccttttccgtcgttcgggtaacccttaccgtaaacgttccgttacggaaccaaaccgtaaccgggtcccttacccgtgaacgctaacttccgtcgttacgggtcccttaccgaggtccgttaggaacggacgggtaacggtcttacggttaaatttacgtttacgttacgaccgtacgtccttaaccgaatttaacttaacgttaacgttaacggaccctaaaggttaaccgtttagggtttcggggtttttaaccgggacggggtaaaccgggtaacccggtaacgggtacccgggttaaaccccggttacccgggttaacgggttaccgaccggtacccgggtaaacggcccgttaccccgggtccccccgtttaacgggtccctaacccttttccggtcccccggtttacccccccg

SEQ ID NO: 236083 - DNA, 886 bp, Homo sapiens
  misc_feature: GYAE6OF01D17X0.14.3.A03.1.454.CMB.1.raw
tcagcgtctagtaccacgaccggtgctcgatttagagagcgtcacgaggggggggtctcaggaggcagcgctctcaggacatctccaccatggcctggctctgctgctcctcaccctcctcactcgagggcacgagggtcctcgggcccagtctcgccctgactcagcctgcctcgtgtcgtggtctcgtggacagtcgatcacctatcctctgacacgtaggaaccagtagtgtacgtttagttaatttattacgttttgtccttccgtacggtaaccaacgacgaccgacccgaaggaacccaaaaccgaccccctaaaacttctaacttttaagttttacgtaggtaacggttacctaaaacgtttaccggtcccggtaccctacggtaacggtttaaccgttttactaaaccgttccgtccgttttccgtccggttaccggtacccgttaaccgtaaacggtttccgtacgggaaccccgtaaaacccggtaccccggtcccccttaccccggtaagtaaccgtccgttaaccgttccggttaccgggtacccggggtcccttaaccgggtaaccggggtcgtaacggggtaaccggggtaaccggtaaggttcgttacgttaacgtttaacgtttccgtacgtacgtacccggtacttactaaactttaacgttacgtttaaaggtcgtaacgtaaacggtttacgtttcggggtttacgggtttaccggggaaccggggtaccggtaaaccgggttaacgttaacccgggtaaccggttaccgttaacgggaccgaacccgggtacccccggtaaggtcccccgtaccccgggttaccccccgttggtaacccccttacgtttccccgttacccccccgg

SEQ ID NO: 236084 - DNA, 797 bp, Homo sapiens
  misc_feature: GYAE6OF01A6LNF.14.3.A03.1.454.CMB.1.raw
tcagcgtctagtaccacgaccggtgctcgatttagagagcgtcacgaggggggggtctcaggaggcagcgctctcaggacatctccaccatggcctgggctctgctgctcctcaccctcctcactcgagggcacgagggtcctgggcccagtctgccctgactcagcctgcctcgtgtcgtgggtctccgtggacagtcgatcacctatcctcctgcacgtcggaaccagtagtgtacgtttggttaatttattaagttttcgtcttccgttaggttaaccaacgtacgaccaacccgaacggaaccaaaaccggacccccctaaagtccttaatttatttacgtaggtaacgtacctaaataaccgtccggtacctagtacgggttactttacgtaactcgtacttcgtcgtacggtacctacgtacgtcgtacggacctaacgtccgtccctccgtagtactctacttacgtcgtacggtcctacgacggtcgtacgggaacggacggtacggtcgtaacgttaacgttaacgtttacgcggtaccgacgttaccttactaacgtttaacgttaccttaaggttaccgtaacgtaacgggtttaacggtttcgggtttaccggggtttacggggaaccgggttaaacgggtaaccgttaaccggggttcccggtaaccccgggttacgtaaccgggtaccggttaacccggaaccccggttaaccggtccccggttacccccggttacccccggttacggttccccgtaacccgttccccggtttaccccccggg

SEQ ID NO: 236085 - DNA, 703 bp, Homo sapiens
  misc_feature: GYAE6OF01DIZTX.14.3.A03.1.454.CMB.1.raw
  modified_base (208)..(208): a, c, t, g, unknown or other
  misc_feature (208)..(208): n is a, c, g, or t
  modified_base (655)..(655): a, c, t, g, unknown or other
  misc_feature (655)..(655): n is a, c, g, or t
tcagcgtctagtaccacgaccggtgctcgatttagagagcgtcacgaggggggggtctcaggaggcagcgctctcaggacatctccacatggcctggctctgctgctcctcaccctcctcactcgagggcacgagggtcctgggacccagtctgcccttgactcagcctgccctcgtgtctgggtctcgtggactagtcgatcaactntcctcctgctacggtcgaactgttgtcgtacgttttgttattagttatttcgttctcgtacgtaaccaatacaccaccgaggacaaaccgaccccaatctaactttagtttataggtacgttaacaaagttacgtccggtccctagtaaggttacttactaactcgtacttgcgtcgctacgtagtcgtacgaaccctacggaccgtccctcgtagaccgttacacgttccgtacggtcggtaccttcggaacggtgtacggggaaacgtacggtacggttacttagttaagtttctttacggactccgtaacgttaccttagaaccttagtttaacttacgtaacgttacgtaacgttttaggttcgggtttacggggttcgggaacggggtaacggtaaccggtaggtccggtaaccggttcggtacggactacgggtaccccgnggttacccgcccggttacccgttgtaccctcggttcccgtttccccgg

SEQ ID NO: 236086 - DNA, 766 bp, Homo sapiens
  misc_feature: GYAE6OF01DLLPJ.14.3.A03.1.454.CMB.1.raw
tcagcgtctagtaccacgaccggtgctcgatttagagagcgtcacgaggggggggtctcaggaggcagcgctctcaggacatctccaccatggcctgggctctgctgctcctcaccctcctcactcagggcacgagggtcctgggcccagtctgccctgactcacgcctgcctccgtgtctcgggtctccgtggacagtcgatcaccatcctctcgcacgtacggaacctagtagtggtacgtttaggttattttattagttttgtcctccgttacggtaaccaacacgaccaacccgacggaccaaaccgtacccccaaattaccttaattttattttaagtaggtaacgttactaaacgtaaccgtccggtaccctacgtaggttactttacgtaactcgtctttcgtcgtcggtacctactaacgttcgtacgaacctaacccggtaccggtccctacccgtaggacgtactacgtccgttacggtccgggtcctaccgggacggtacggtacggggtaacggaccgggtaggtaccgttagttaacgtttacgttaacgtcgtactaccgtcttacgtaacttaacttacgttaagttacgacgttaagtacggtttacgggtttacgggtttaccggggacgggtaacgggtaccggtaaagggttaccggtacccggttacggtaccggttacggacccgttacccggacgtcccgtacccggtccccgttacggtaccctaccgttcccgttaaccccg

SEQ ID NO: 236087 - DNA, 701 bp, Homo sapiens
  misc_feature: GYAE6OF01D897Z.14.3.A03.1.454.CMB.1.raw
tcagcgtctagtaccacgaccggtgctcgatttagagagcgtcacgaggggggggtctcaggaggcagcgctctcaggacatctccaccatggcctgggctctgctgctcctcaccctcctcactcgagggcacgagggtcctgggcccagtcctgccctgactcagcctgcctccgtgtcgtgggtctcctggacagtcgatccaccatcctcctgcacgtaggaaccagtagtgtacgttgttaattattatttcgtctcgtacgtaccaacacgccaccgagaccaaaccgaccccaaatcttaatttattagtggtagtacaagtaacgtccggccctagtaggttatttactaacgtccgtcttcgtcgttcggtacctacgtaacggttcgtacggtaacctaaacccggacccggtcccctcccgtagaccggtactactccgtcgttacgggccttcccgaagggtcctaaggggtacggacgtacgggtccttaggttaactttacgttacgtcgtacgaccgtactaactaattacgttaactgtaacgacgtagttaacggtttcgggttacgggttacgggacggtacgggtaaccgtagggtccgtacccggttaccggtaagaccgtaaccgccccggtaagtcccggtccccgtccccgtaggtccctaccgttccgttaccccgg

SEQ ID NO: 236088 - DNA, 930 bp, Homo sapiens
  misc_feature: GYAE6OF01DQRJ0.14.3.A03.1.454.CMB.1.raw
tcagcgtctagtaccacgaccggtgctcgatttagagagcgtcacgaggggggggtctcaggaggcagcgctctcaggacatctccaccatggcctgggctctgctgctcctcaccctcctcactcgagggcacgagggtcctgggcccagtctgccctgactcagcctgcctcgtgtctgggtctccgtggacagtcgactccacctattcctcctgacctaacgttacgggaaacctaggttagtcggttaacggttttaggtttaattttaaagttaacgttttttcggttccttccgttaacggttaacccaaacgacgacccgtaacccaaggaacccaaaaccgacccccctaaaaacttcttaaacttttaattttaagtacggtaacggttaacaaagttaaaccgtccgggtaccccttaggtaagggttaacgtttttaacgtaacgttccggttacctttccgttacgttcggtaccttaaccgtaaacgttcgtaacggacctaaaccggtacccggtccctttacccgtagtacggtaccttaacgttcccggttcgttaccggggtaccttaccggaacgggtaccgtaggggaacgggaacggtacgggtacgttacggttaactttaacgtttaacgtcggtacctacgtaccttacgtaacgttaatttaaccgtttaagttaaccggaacgttaacgggttaaaccggtttcggggttttaccgggggttttacgggggaccggggtaaaaccggggtaaccggttaaacggggttaccggtacccgggtttacccggttaacgggtacccggtaaaccgggtaacccccgggtaaggtacccccggttacccgggttaacccccccggttgggtttaacccctacccggtttcccggttttaccccccggg

SEQ ID NO: 236089 - DNA, 731 bp, Homo sapiens
  misc_feature: GYAE6OF01CBA5C.14.3.A03.1.454.CMB.1.raw
  modified_base (253)..(253): a, c, t, g, unknown or other
  misc_feature (253)..(253): n is a, c, g, or t
tcagcgtctagtaccacgaccggtgctcgatttagagagcgtcacgaggggggggtctcaggaggcagcgctctcaggacatctccaccatggcctgggctctgctgctcctcaccctcctcactcagggcacagggtcctgggcccagtctgccctgactcagcctgcctcgtgtcgtgggtctccgtggacagtcgatcaccatcctcctgccacgtggaaccagtagtgtacgttgttattattattttntctctgtacacagcaccagacaaacgaccccaaactcattatttacgtgagtactagtaacgtccggacctcggtacgggtttctaacgtcgtcttcttcgtcggtccttaccgtaagttcgtacggtacgaaacccgtacccggtccctccccgtacgtaccctacttccgttaccgtcggggtaccttcccgaggtcgtacggaacgggacggtacgttaccgttggttaattttagtttaacgtttcgacgtacggtaccttacgtaattacgtacgtccgtaaccgtacgggaccaacgtacctaaattcgttagtttcgggtttaccggggttttacgggggaccgggggttaaccgtaacgggtccgggtaacccgttaccggttacggttacccggaccggtaaccccgggtaacgggtcccgttacccgggtaccccccggtttcggtccccgtaacccgtttccccggg

SEQ ID NO: 236090 - DNA, 769 bp, Homo sapiens
  misc_feature: GYAE6OF01B0V5O.14.3.A03.1.454.CMB.1.raw
  modified_base (168)..(168): a, c, t, g, unknown or other
  misc_feature (168)..(168): n is a, c, g, or t
  modified_base (218)..(218): a, c, t, g, unknown or other
  misc_feature (218)..(218): n is a, c, g, or t
  modified_base (464)..(464): a, c, t, g, unknown or other
  misc_feature (464)..(464): n is a, c, g, or t
tcagcgtctagtaccacgaccggtgctcgatttagagagcgtcacgaggggggggtctcgaggaggcagcgctctcaggacatctccaccatggcctggctctgctgctcctcaccctcctcactcgagggcacgcgggtccgtgggcccagtctcgcccctgactcncgcctcgccgtccgtgtcgtggtcctccgtggaccagtcgatccaacctntcctccgtgctacgtacggaacctagtaggtacggtagttttaggttaatttaatttaacgttttcgtccttaccgttacggtaaccaacacgaccacccgaggaaccaaaccaccccctaaatcgtagttagtaatttagtacggtagtactagtaaccgtccggtaccgttacgttaacgggtttctaagtcctcttctcgtcggtcaccgtagtcgtacggacctaaccgccggtccctaccncgtaacctccgttcgtcggtacggttccacggtacggccgtacgggaacggtcccgtagttacgttacgttaagttttcttagttacggacctaccgttataacgtagttacgtccgtaaccgtccggttacggacaacgtaaccgttagttacgtcggttttaaggggtccgggggttttaccgggaccggggttaaccttaacggggtccgttacccggtaggttaccgggacccggtaccccggtaaaccgccggttccccgggtaacccccgttccccggtaagtccccgtttaaccccgg

SEQ ID NO: 236091 - DNA, 644 bp, Homo sapiens
  misc_feature: GYAE6OF01A30W6.14.3.A03.1.454.CMB.1.raw
  modified_base (268)..(268): a, c, t, g, unknown or other
  misc_feature (268)..(268): n is a, c, g, or t
tcagcgtctagtaccacgaccggtgctcgatttagagagcgtcacgaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgccatggaaccagtagtgtacgttgttaattattaattttgtctcctggtaccaacngcacccaggaccaaacgcccccaaatctatttactttatagaggttacaaattaatccggaccctacgaggtacttttactaatccgctttctcgtcggccttacgaaggtcctaggaccaacgaccgtccctcccgtgtacgctatctcgcggctccgagcgtagaggacgaggctagtagttaacttacgtgacagtctactattataactattacgactaagtaattggtttacgggtttaccgggaggtacgggtacggtaacggttacgtaccccggtacgttaccggtaccgaacggtaccccggaaacggtcccgttacccggtaccccccgttaccgggttccccgtaaccgttcccgtttacccccg

SEQ ID NO: 236092 - DNA, 604 bp, Homo sapiens
  misc_feature: GYAE6OF01BXO0X.14.3.A03.1.454.CMB.1.raw
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattattaattttgtctcctggtaccaacagcacccaggccaaacgcccccaaactcatttatttatgaggtcagtaactcggccctgagggtttctaatcgtcttctctggctccaagtctggacaacgaccggcctccgtgaccctatcctcgtcgggcctcgacggtctggacggacgtagtcgtagtatttattattgactagcttcaatatcgctaccgtggacagactaatctagtcggtttcggggtttccggggaccggggggtacctaaggggttccggtacccggttacccgttacgggtccgtaaccggcccgaacgggtccttaccggcccccccgttcggtccgtacccgttcccg

SEQ ID NO: 236093 - DNA, 846 bp, Homo sapiens
  misc_feature: GYAE6OF01DFWBS.14.3.A03.1.454.CMB.1.raw
tcagcgtctagtaccacgaccggtgctcgatttagagagcgtcacgaggggggggtctcaggaggcagcgctctcaggacatctccaccatggcctgggctctgctgcctcctccaccctcctcactcgacgggcacgacgggtccgtcgggcccagtccgtcgccctgactcgcgtcctcgtcctccggtgtcgtcgggtcctcgtaggactacgtacgactccacctactccttccgtcgacctaccggtacggaaccgtaggttaggtacggtttacggttttaggtttaattttaagttttaattttcggttcctaccgtacgtaaccaacacggaccaaccggacggaaccaaacccgtacccctaaatacgttaatttattacgtaaggtacgtaactaaacgttacgtccggtacctacgtaacggttactttaacgtacttcgttcttctcgtcgtctacgtagtcgcgtaaccaccgtccgtccctactcgactcgtaccttcgtccgggtccgtacctaccggggagtacgggtaacgggacggtaaaccggtagggtccgttaaagtttacctttaacggttaaccggtccgacgttaccggtttaacctaagttaacctaaacgttttccgtaaattccggaactttaaacgggttcggttttcggggtttttaaccggggaaccggggaaccgggtaaccggttaaccgggtaaacgggttccccgggttaacccggtaaggttacccgggaacccgttaaccgggacccgtacggttccccggtaccccggtaccccgtacgggttcccttaccgtcccgtttacccccccg

SEQ ID NO: 236094 - DNA, 532 bp, Homo sapiens
  misc_feature: GYAE6OF01A9ZBB.14.3.A03.1.454.CMB.1.raw
  modified_base (295)..(295): a, c, t, g, unknown or other
  misc_feature (295)..(295): n is a, c, g, or t
  modified_base (313)..(313): a, c, t, g, unknown or other
  misc_feature (313)..(313): n is a, c, g, or t
  modified_base (350)..(350): a, c, t, g, unknown or other
  misc_feature (350)..(350): n is a, c, g, or t
  modified_base (381)..(381): a, c, t, g, unknown or other
  misc_feature (381)..(381): n is a, c, g, or t
  modified_base (402)..(402): a, c, t, g, unknown or other
  misc_feature (402)..(402): n is a, c, g, or t
tcagcgtctagtaccacgaccggtgctcgatttagagagcgtcacaggggggggtctcaggaggcagcgctctcaggacatctccaccatggcctggctctgctgctcctcaccctctcactcagggcacagggtcctgggcccagtctgccctgactcagcctgcctccgtgtctgggtctcctggacagtcgatcaccatctcctgcactggaaccagtagtgacgttgttattataattttgtctctggtaccaacagcacccaggcaaacgccccctaaatcattatttangagtcaatatcggccctnagtatttcaatcgcttctctgctacagtctggcaacncgcctcctgacgcatctcgtggctcgagtcngaggcgagctgattatacgtncagctcatatactagttacgactagtaacgttggttcgggtttcgacgggtacggaaccgtaggtcgacccgttcgtaggtcaccgacccgaaggtcctccgacccccttggtcctccgttcgttccccg

SEQ ID NO: 236095 - DNA, 703 bp, Homo sapiens
  misc_feature: GYAE6OF01DUSEX.14.3.A03.1.454.CMB.1.raw
  modified_base (268)..(268): a, c, t, g, unknown or other
  misc_feature (268)..(268): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacgagggtcctgggcccagtctgccctgactcagcctgcctccgtgtcgtgggtctcctggacagtcgatcaccatctcctgcactggaaccagtagtgacgttgttaattattaattttgtctcctaggtaccaacncgacacccaggaccaaacgccccaaactctatttattatgagtacaataactccggcctgaaggtagtttactaatcgtcttctcgtcggacctcctaaagtcgtggacaaccgtaaccggcccttcccgtgaacgtactacgttccgttcgtacgggcctcccggaacggtcgtaacgggacgggtacggacgggtcgttaggttactttaacgtttacgtagccgtaagtctaacgtaattaactaaacttaagttaacgacttaacggtacgttttgggtttacgggtttaccgggaggggttaaccggaacccggttaaacgggttccgtaacccggttaccggttaacggtacccgaccggtaccccggtaaggtcccgtaccccggttaccccccgttacggttaaccctcccgttccgttaccccccg

SEQ ID NO: 236096 - DNA, 783 bp, Homo sapiens
  misc_feature: GYAE6OF01EVJTF.14.3.A03.1.454.CMB.1.raw
tcagcgtctagtaccacgaccggtgctcgatttagagagcgtcacgaggggggggtctcaggaggcagcgctctcaggacatctccaccatggcctgggctctgctgcctcctccacccctcctcactcgagggcacgagggtcctgggcccagtctgccctgactcagcctgcctcgtgtctggtctcgtggacagtcgatccaccattcctcctgcacgtacggaacctaggttagtgtacggttttaggtttaatttatttaagtttttcgtccttccgttaggttaaccaacgagtcccaacccgacgggaccaaaccgaccccccaaattccgtaattttactttagtcggtaacggtactaaagttaacgtcccggtccctacgtaggttactttataacgtccgtcttcgtctcggctacgaagttcgtagccgaaacgtccggtccctaccgtgacgtactacgtttcgtacgtccgggcctaccggagggtcgttagggacgggtaaccgtagggtaccttagttaacttttacgtacgcgtacacggtcttataacttactaacgtttaacgtacgacggttaacgttacggtttagggtttaccggggtttaccgggaacgggtaacggggaacccggttaaggggtaccccggtaccggttttaacccggtaggtacccggtaaccggtacccccgggtaaggtccccccgtttacccccgggtacccccgtttaccggaccggttacccctttcccggtttacccccccg

SEQ ID NO: 236097 - DNA, 528 bp, Homo sapiens
  misc_feature: GYAE6OF01BO6CQ.14.3.A03.1.454.CMB.1.raw
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
  modified_base (254)..(254): a, c, t, g, unknown or other
  misc_feature (254)..(254): n is a, c, g, or t
  modified_base (283)..(283): a, c, t, g, unknown or other
  misc_feature (283)..(283): n is a, c, g, or t
  modified_base (299)..(299): a, c, t, g, unknown or other
  misc_feature (299)..(299): n is a, c, g, or t
  modified_base (322)..(322): a, c, t, g, unknown or other
  misc_feature (322)..(322): n is a, c, g, or t
  modified_base (367)..(367): a, c, t, g, unknown or other
  misc_feature (367)..(367): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
tcagcgtctagtaccacgaccggtgctcgatttagagagcgtcacagggggggtctcaggaggcagcgctctcaggacatctccaccatggcctggctctgctgctcctcaccctcctcactcagggcacagggtcctgggcccagtctgccctgactcagcctgcctccgtgtctgggtctcctggacagtcgatcaccntctcctgcactggaaccngtagtgagttgttatatattttgtctctgtaccangcaccagcaaacgccccaatcattattangagtcaatatcgcctnaggtagtttctaatcgtcttctntcgctcagtcgtgacaacacgcctcctgagcatctcgtggctcgngctggaggacgagctagtattagttancgacngtctntaattactacgttatacgctaagtacgttgttacggttcgggcggaagggtacctaggtccgaccgttcgtacgtcgaccgaccggacgccgttccgccccgtgtcctacccgtcgttcccccg

SEQ ID NO: 236098 - DNA, 852 bp, Homo sapiens
  misc_feature: GYAE6OF01CPUT8.14.3.A03.1.454.CMB.1.raw
tcagcgtctagtaccacgaccggtgctcgatttagagagcgtcacgagggggggggtctcaggaggcagcgctctcaggacatctccaccatggcctgggctctgctgcctcctccaccctcctcactcgagggcacgagggtcagtcgggccagtctcgccctgacctcacgcctcgccttccggtgtcgtgggttcctccgtggacagtcgactccacctactcctcctgacctacgtacggaaacctaggttagtacggttacggttttagtttaattttaatttaacgtttttcgttacccttaccgttaccggtaacccaaacgtacgacccaacccgacggaaccaaacccgaccccctaaacttacttaattttaacgtttagtacggtaacggtaactaaacgttaaccggttcccggtacccgtaggttaacgggttaacgttttacgttaacgttccgttacctttccgtcgttccggtaccttaccgtaacggttccgtacggaacccaacccggtacccggtccccttaccgtacggacgtacttaccgttccggttaccgtaccggggtccttacccgggacgggtcggttacgggaaccgggtacggtaacgggttcttaagtttaacgtttacgtaccgtacggaccttacgtacctaattaacttaacgtttaacttacgtaagtacgtaacggtttaggttacgggttttcgggtaccggggacgggtaacggtaccggtaacggtccggtacccggttacgtaccggtccgaaacccggtcccgtaccgggtcccgtaccccggttacccggtccgtacccttccgtttccccg

SEQ ID NO: 236099 - DNA, 697 bp, Homo sapiens
  misc_feature: GYAE6OF01EBOOR.14.3.A03.1.454.CMB.1.raw
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
tcagcgtctagtaccacgaccggtgctcgatttagagagcgtcacgaggggggggtctcaggaggcagcgctctcaggacatctccaccatggcctggctctgctgctcctcaccctcctcactcgagggcacgagggtcctgggcccagtctcgccctgactcagcctgcctcgtgtctggtctcgtggacagtcatcaccatctcctgccacgtacgaacctagtagtcgtacggtttggtttaatttattaattttcgtcctccgtacggtaaccaacgacgaccaccgaggaccaaaccgacccctaaatctaatttattagtgtaacgtacaagtactccgtccctagtagtactttactatcgtcttctcgtcgtactcgtagtcgtacgacaaccgtacgtccctcgngtacnctacttcgtacgtcgggcctcgacggtcgtacggacggacgtacggtacttagttactttacgttaacgcgtactacggtactactaacgttaacgttaacgttaagttacgaacgttaacgttacggtttcgggttacgggttaccgggacgggtaacgggtaaccgtacgggttaccggtaccggttaccggtagggaccctaccgggaaccccgtacggaccccgttccccggtaccccggttacggttaccttacccgtcggtttaccccccg

SEQ ID NO: 236100 - DNA, 799 bp, Homo sapiens
  misc_feature: GYAE6OF01DPAZC.14.3.A03.1.454.CMB.1.raw
  modified_base (211)..(211): a, c, t, g, unknown or other
  misc_feature (211)..(211): n is a, c, g, or t
  modified_base (393)..(393): a, c, t, g, unknown or other
  misc_feature (393)..(393): n is a, c, g, or t
tcagcgtctagtaccacgaccggtgctcgatttagagagcgtcacgaggggggggtctcaggaggcagcgctctcaggacatctccaccatggcctgggctctgctgctcctcaccctcctcactcgagggcacgacgggtcctgggcccagtctcgccctgactcagcctgcctccgtgtcgtggtctccgtggacagtcgatccacctntctcctgacacgtggaaccagtgtgtacggtttagttattattattttcgtctcgtacgtaaccacgacgccacccgaggaccaaacccgaccccctaaactctaatttactttagtggtacgtaactaacgttaacgtcccgtccctacgtacggtacgttttactaacttcgtcctttcncgttcggccttaccgtaagtctacgacaaaccgtccggtccctccgtagacgctacttcgtcgtcgccgtacgacggtcgtacggacggacggacggtcgttagtacgtttacgtacgtccgtacacgtacccgtatacgtttaactacgtttaaacgttcggaaccgttaacgttaaacgggtttcgggttttaccggggtttaccggggtacggggtaaacccgggttaaaccgggtaccggggttaacccgggtaacccggtttaacccgggttacccggggtaaccccgtacccggggtaacccccggtaacccgggttacccccggtacccccggtttaccccccgggttaccccggttaccccgggtttaaccccgtttcccccggtttccccccccggg

SEQ ID NO: 236101 - DNA, 667 bp, Homo sapiens
  misc_feature: GYAE6OF01ARKOI.14.3.A03.1.454.CMB.1.raw
  modified_base (202)..(202): a, c, t, g, unknown or other
  misc_feature (202)..(202): n is a, c, g, or t
  modified_base (468)..(468): a, c, t, g, unknown or other
  misc_feature (468)..(468): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctctggacagtcgatcaccntctcctgcactggaaccagtagtgtacgtttggttattattagttttgtctcctggtaccaacagcaccaggaccaacgcccccaaactctattatttatgtagtacaatacgtcgccctcgaggtacgtttctaactcgtcttctcgtcgcctactagtcgtacggacaacgaccggtccctcccgtgacgctacttcgtacgtcggtctaccgaggtcgtagggacggacggacgggtacttaggtaactttaacgtttaccgngtaccgacgtccttaacactttaattaacttaattacgacgtaacgttaaccgttgggtttacgggtttacgggcgggtaaggggaccgtaaacgggtcgtacccggttaccggtacggttacgaccggacccgtaacgggtcccgtaccccggtacccccgttaccggtcccgttacccgtttcccggttacccccgg

SEQ ID NO: 236102 - DNA, 756 bp, Homo sapiens
  misc_feature: GYAE6OF01CZ7QY.14.3.A03.1.454.CMB.1.raw
  modified_base (200)..(200): a, c, t, g, unknown or other
  misc_feature (200)..(200): n is a, c, g, or t
tcagcgtctagtaccacgaccggtgctcgatttagagagcgtcacgagggggggggtctcaggaggcagcgctctcaggacatctccaccatggcctgggctctgctgctcctccaccctcctcactcagggcacgagggtcctgggcccagtctgccctgactcagcctgcctccggtgtcgtgggtcctccgtggacngtcgatccacctatcctcctgctacgtaggaacctaggtagtcggtacgtttggtttaattagtttaattttcgtccttccgtacggtaaccaacgacgccaacccgaacggaccaaaacccgacccccaaacttctaatttaagtttagtaggacggtactaaagtaacgtccggtacctcgtaaggttacgtttactaacgtcgtacctttcgtacgttcggtaccgtacctaaacggttccgtacggaacctaaccgacccggtccctcccgtacgacgtacctacgttccgtcggttacggtccctaccggagggtcgtagggaacggtacggtacgggtcttacggtacttttaactccgttaagcgtacgtctaactattacgttaattacgttagatacgttaacgttgggtttacggttcggggaacggtacgggtaacgtacggggttacgtacccggtcggtaaggtccgaaccggtacccggaaccgggttcccgtacccccggtaccccgttacggtaacccttcccgtttccggttacccccg

SEQ ID NO: 236103 - DNA, 646 bp, Homo sapiens
  misc_feature: GYAE6OF01D2Q8U.14.3.A03.1.454.CMB.1.raw
  modified_base (310)..(310): a, c, t, g, unknown or other
  misc_feature (310)..(310): n is a, c, g, or t
  modified_base (503)..(503): a, c, t, g, unknown or other
  misc_feature (503)..(503): n is a, c, g, or t
tcagcgtctagtaccacgaccggtgctcgatttagagagcgtcacgaggggggggtctcaggaggcagcgctctcaggacatctccaccatggcctgggctctgctgctcctcaccctcctcactcgagggcacgagggtcctgggcccagtctgccctgactcagcctgcctccgtgtcgtggtctcgtggacagtcgatcaccatctctgcacgtagaactagtagtgtagtttgttattattatttcgtctcctagtaacaacgacgaccaccgaggaccaaaccgaccccaaatctatttattagngtacgtactaatacgtccgtccctagtaggttactttactaactcgtcttctacgtcggcctaccgtaagttcgtacggacctaaaccgacccggtcccttaccgagtaacgtacctacgtttcccgtacggttccggccttaccggagggtaccgtagggaacggacggtagtcgtaagttaactttagtcncgtacgacgttctacgtatacttaataacgtgacgtaagtacgttgggtttacggtcggacggacgtaacgaggtacgaccgttcgtacgtacaccggaccgtagcccgtacccgtccccgtagttcacccgttcggtccccg

SEQ ID NO: 236104 - DNA, 775 bp, Homo sapiens
  misc_feature: GYAE6OF01AZSOW.14.3.A03.1.454.CMB.1.raw
  modified_base (327)..(327): a, c, t, g, unknown or other
  misc_feature (327)..(327): n is a, c, g, or t
tcagcgtctagtaccacgaccggtgctcgatttagagagcgtcacgaggggggggtctcaggaggcagcgctctcaggacatctccaccatggcctggctctgctgctcctcaccctcctcactcagggcacgagggtcctgggcccagtctgccctgactcagcctcgcctccgtgtcgtgggtcctccgtggactagtcgatccaccatcctcctgccacgtacgaacctagtagtgtacggttgtttattattaattttgtctccgtggtaaccaacgacgaccacccaggaccaaacgacccccaaactctaatttagtttanggtagtacaacgtaacgtccggccctacgtaaggtactttacgtaactccgttactttcgtccgtcggtctaccgtaacgtcgttcgggaaccaaccggtacccggtccccttacccgtacgtacgtacctaccttccgtacggttcgggaccttaccggacgggtaccgttacggggacggaaccggtagtaacccggttagttaactttaaccttacggttcgacgtacgtcctttaaccgtaatttaacgaaatttaaccggttcggtaaaccgttaacggttacggtttcggggttttaaccgggttaccgggaacggggtaaccgggtaacgttacgggttaccggtaacccggttacgttacgggaacgtaccccgttaccggaaccggttccgtacccccggtaccccgttacggtaccccttcccgttcgttaccccccg

SEQ ID NO: 236105 - DNA, 635 bp, Homo sapiens
  misc_feature: GYAE6OF01ERDGV.14.3.A03.1.454.CMB.1.raw
  modified_base (315)..(315): a, c, t, g, unknown or other
  misc_feature (315)..(315): n is a, c, g, or t
  modified_base (377)..(377): a, c, t, g, unknown or other
  misc_feature (377)..(377): n is a, c, g, or t
tcagcgtctagtaccacgaccggtgctcgatttagagagcgtcacagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacggtttggtgttaataagtatgtctcctacggtaaccaaacaaccaccgaggaccaaaaccgcccccaaaactctatgtaatttangaaggtcaaataactccggtccctacgaggtactttctaactcgcttctctgactcgagtcngacaacgcgcctcctgacgcacttcgcgtcggcctcgacggtgtacggacggacggaggtcgtagttacttatacgtacgcgtacgtacgtactaacttaacttacgttaacgttacacgttaagtaacggttcggtttacgggtttcgggacgggtaacgggtaaacggtacggttacgtacccggttacggttacggaccgtaaccgaccccggtaacggtccgtaccccggtccccggttcccggtaccttcccg

SEQ ID NO: 236106 - DNA, 772 bp, Homo sapiens
  misc_feature: GYAE6OF01DQWA0.14.3.A03.1.454.CMB.1.raw
tcagcgtctagtaccacgaccggtgctcgatttagagagcgtcacgaggggggggtctcaggaggcagcgctctcaggacatctccaccatggcctgggctctgctgcctcctcaccctcctcactcgagggcacgagggtcctgggcccagtctgccctgactcagcctgcctcgtgtctggtctcgtggacagtcatcactatctctgcactaggaacctagtgtgtacgtttgttattattattttcgtcctacgttacggtaaccaacgagaccaccgaggaccaaaaccgcccccaaattctaattttaatttagacggttaggtactaagttaaccgtccggtacccgttaggttaacgggttttctaacgttccgtactttccgtagtccggtacttaccgtaagtcgtacgacctaaccgccgtcccttcccgtcaacctcttccgtacggtccgggtacctaccggtacggtacgttacgggaacgggtacgttacgttaccgtttaagggttaacttttttacggtttaacgtttcgggacctacgtaaccttacttaaacggtttacgtaccgtaccccgtaacggttcgggaaccctaacgggtaacctaaacgtttccgttaaggtttcgggggttttacccgggggtttcgggggaaaccccgggggtactaaacgggttcccggtaccgtaccgggtacggtccgtacgaccccggtagtccccgttacccgccccgtttaccgcttccgttccccg

SEQ ID NO: 236107 - DNA, 1006 bp, Homo sapiens
  misc_feature: GYAE6OF01C96DC.14.3.A03.1.454.CMB.1.raw
tcagcgtctagtaccacgaccggtgctcgatttagagagcgtcacgaggggggggtctcaggaggcagcgctctcaggacatctccaccatggcctgggctctgctgctcctcaccctcctcactcgagggcacgagggtcctcgggcccagtcctgccctgactcagcctgcctccgtgtctgggtctcgtggacagtcgactccacctatcctccgtgcctacgtaggaaaccctagtacgtgtacgtttgttaattattatttcgtccttccgtacggtaaccaacgtacgcccaccgaggaaccaaacccgaccccctaaactccttaatttaactttagtaggtaacggttactaaaacgttaacgtcccggtacccgttacgtaaacgggtttacgttttaaccgtaacttccggtttacccttttccgttaccggttaccggttacccctttaacccggttaaaacggttccccggttacgggtaaaccccgtaaaaccccgggtaccccggggtttcccccccttacccgggttaacgggaacccggtacccgttaaccggtttcccggttaccgggttacccgggggttacccttacccccggggtaaagggggttcccgttaaacgggggaaccggggtaacccgggtaacggggttccgttaacggtttaaccgttttaaaccggtttacccggtaccggtaaccgttacgtacccgttaaccgtaaacgtttaacccgtaagttttaaccgtaaacggtaccgttaaacgggttaaacccgggttttggggtttacccgggggttttaccggggaaccgggggtaaacccgggttaaaccggtaacggggttacccggttaccccgggttaaccgggttacgggtaaccccggtaacccgggtaaacccgggtaaccgggtacccccggtaccccggttacccccccggtttaagggtaccccttaccccgggttcccggtttacccccccggg

SEQ ID NO: 236108 - DNA, 665 bp, Homo sapiens
  misc_feature: GYAE6OF01BMHL5.14.3.A03.1.454.CMB.1.raw
  modified_base (136)..(136): a, c, t, g, unknown or other
  misc_feature (136)..(136): n is a, c, g, or t
  modified_base (219)..(219): a, c, t, g, unknown or other
  misc_feature (219)..(219): n is a, c, g, or t
  modified_base (274)..(274): a, c, t, g, unknown or other
  misc_feature (274)..(274): n is a, c, g, or t
  modified_base (306)..(306): a, c, t, g, unknown or other
  misc_feature (306)..(306): n is a, c, g, or t
  modified_base (316)..(316): a, c, t, g, unknown or other
  misc_feature (316)..(316): n is a, c, g, or t
  modified_base (325)..(325): a, c, t, g, unknown or other
  misc_feature (325)..(325): n is a, c, g, or t
  modified_base (466)..(466): a, c, t, g, unknown or other
  misc_feature (466)..(466): n is a, c, g, or t
tcagcgtctagtaccacgaccggtgctcgatttagagagcgtcacgaggggggggtctcgaggaggcagcgctctcaggacatctccaccatggcctgggctctgctgctcctcaccctctcactcgagggcacgngggtcctgggcccagtctgccctgactcagcctgcctccgtgtcgtgggtcctccgtggacctagtcgatcacctatctcgtncacgtggaacctgtagtcgtagttgttaattatattttcgtctctagtaccaacngcaccaggacaacgcccaactctactttatangtagtataanagtcgcctnaggtattctaatcgtactttctcgtgtactacgtaacgtcgtcggacaacgacccgtcccgtacctggactcgtatccttcgcggccttcaggtccgtggacggacgtaggcttaggtacttatagtccgactagtcctanaacgttactttacgaaagtttcgaacgttaaagtccggtttagggtttaccggtttacgggcggggtaaaccggtaaccgtaaggggtttacccaaccccggggttctaacggggtacccgaaaccgtccccgggtaaaccggtcccgtaccccggcccccggtttaacgggtccccttacggtcccgtttacccccgg

SEQ ID NO: 236109 - DNA, 726 bp, Homo sapiens
  misc_feature: GYAE6OF01EOK56.14.3.A03.1.454.CMB.1.raw
  modified_base (187)..(187): a, c, t, g, unknown or other
  misc_feature (187)..(187): n is a, c, g, or t
  modified_base (192)..(192): a, c, t, g, unknown or other
  misc_feature (192)..(192): n is a, c, g, or t
  modified_base (202)..(202): a, c, t, g, unknown or other
  misc_feature (202)..(202): n is a, c, g, or t
tcagcgtctagtaccacgaccggtgctcgatttagagagcgtcacgaggggggggtctcaggaggcagcgctctcaggacatctccaccatggcctggctctgctgcctcctcacctctcactcgaggcacgaggtcctcggcctagtctcgccctgactcagcctcgcctcgtgtcgtggtctcgnggacngtcatcactntcgtccagactacgtacggaactggttacgtcgttagtttaggtttaattaatttacgttttcgtcctacgtcggtaaccaacgacgtaccaaccgagaaccaaaccgtaaccccaaactacgttaagtttaattacgtacggtaacgtacttaaacgtaacgtcccggtacctacggtaggttacctttaagtaccgttccgtactttccgtcggtacgtaccttaaccgtaacgttccgtacggaacccgtaaccgtcccgtcctttacccggagtaccggtctacgttcccggtacgggttcggaccgttaccggtaaccgggtgtaacggggtaggaccggtagttaccgtagttaacgtttacgtcgagtaccgtagtacctaagtcttaagttacgaacgttacagttacggttacgttgggtttacggtacggacggtaacgttacggactacggtttccgacgttacggcaaccgtccgtacgcccgttaccgcgtacgtctacgtcccttacccg

SEQ ID NO: 236110 - DNA, 719 bp, Homo sapiens
  misc_feature: GYAE6OF01DM7UL.14.3.A03.1.454.CMB.1.raw
  modified_base (211)..(211): a, c, t, g, unknown or other
  misc_feature (211)..(211): n is a, c, g, or t
  modified_base (220)..(220): a, c, t, g, unknown or other
  misc_feature (220)..(220): n is a, c, g, or t
  modified_base (239)..(239): a, c, t, g, unknown or other
  misc_feature (239)..(239): n is a, c, g, or t
  modified_base (339)..(339): a, c, t, g, unknown or other
  misc_feature (339)..(339): n is a, c, g, or t
  modified_base (449)..(449): a, c, t, g, unknown or other
  misc_feature (449)..(449): n is a, c, g, or t
  modified_base (457)..(457): a, c, t, g, unknown or other
  misc_feature (457)..(457): n is a, c, g, or t
tcagcgtctagtaccacgaccggtgctcgatttagagagcgtcacgaggggggggtctcaggaggcagcgctctcaggacatctccaccatggcctggctctgctgctcctccacctcctcactcagggcaccgagggtcctgggcccagtctgccctgactcaggcctgcctcgtgtctcgggtctcgtcggacaggtcgatccgacctntcctccgtnccacgtggaacctggtagngtaaccggtttgttaattagtaacgttttgtccttacgtagtaccaacgacgtccaaccgacgacgaaaccgtacccccaaactcttaactttaagtttntaggacggttaactaagtaacggtcccggtacctccgtaggttaatttctaacgtcctctcgttcgtcggtcctaccgtaagttctacgggacaacgaccggtcctacgnggacctanccttcgcgtgacctgaacgtgtaggacggacgtggtctacgtacttagtactgcacggtcttacgaccttattacgttacgtacgtactaaggtcgtttcggtttaacgggttccgggtacgggggaaacccgttaggaaacccggggttccgtaaacccgttcgggtttacgggaaccgtacccggtacccgggtttaacgccccgtttaccccggacccccggttttaacggtaccttccccggttaccgtttcccccgg

SEQ ID NO: 236111 - DNA, 703 bp, Homo sapiens
  misc_feature: GYAE6OF01D2QWX.14.3.A03.1.454.CMB.1.raw
  modified_base (524)..(524): a, c, t, g, unknown or other
  misc_feature (524)..(524): n is a, c, g, or t
  modified_base (534)..(534): a, c, t, g, unknown or other
  misc_feature (534)..(534): n is a, c, g, or t
tcagcgtctagtaccacgaccggtgctcgatttagagagcgtcacgaggggggggtctcaggaggcagcgctctcaggacatctccaccatggcctggctctgctgctcctcaccctcctcactcgagggcacgagggtcctcgggcccagtctgccctgactcagcctgcctcgtgtcgtggtctctggacagtcgatccaccatcctcctgccacgtacggaacctagtagtgtacgttaggtttattattaattttcgtcctctacggtacctaacagccaccaggaccaaccgacccccaaactcctatttactttataggtacggtactaaagttacgtaccggtccctacgtaggttaactttacgtaacttcgtcctttactccgttcggtccttaccgtaacgtccgtacggacccaaccgacccgtccctacccgtaggaacgctacgttcgtacgtcggtcctaccggcgcggtaggacggacgagtactagtactttatactgtacacgtacnttaataactnttaagtcgactaaggttacgttcgggttacgggtttcgggacggtaacgggtaccggtaaaggttacccggaccggttaccggtaacggtaccgaccgggaccccgtaacgggtcccctacccgggtaccccccgttacgtcccgttaaccgttcccgttaccccccgg

SEQ ID NO: 236112 - DNA, 752 bp, Homo sapiens
  misc_feature: GYAE6OF01DIOTE.14.3.A03.1.454.CMB.1.raw
  modified_base (232)..(232): a, c, t, g, unknown or other
  misc_feature (232)..(232): n is a, c, g, or t
  modified_base (330)..(330): a, c, t, g, unknown or other
  misc_feature (330)..(330): n is a, c, g, or t
  modified_base (563)..(563): a, c, t, g, unknown or other
  misc_feature (563)..(563): n is a, c, g, or t
tcagcgtctagtaccacgaccggtgctcgatttagagagcgtcacgaggggggggtctcaggaggcagcgctctcaggacatctccaccatggcctgggctctgctgcctcctccaccctcctcactcgagggcacgagggtcctgggcccagtctgccctgactcagcctgcctccgtgtcgtggtctccgtgactagtcgatccacctatcctcctgctacgtggaaccngtagtgtacggtttgttatattatttgtctccgtagtaccaacgcgaccacccgaggaccaaaaccgtcccccaaactccttaagttttaatttaacnggtaacggttactaaagttaaccgtccggtccctacgtacggttacgttttaactaacgttccgtctttacctccgtcggtccttaaccgtaagttcgtaggaaccctaaacggtcccgtccccttccgtaggaacgtactacgttccgttaccgtcgggtacccttacccggacggtcgtacggggaacggtaccgggaacggtcttaacggttaatttaaccgtttaccgnggtaaccttaccgtacgttacaacttttaactacgtttaattaacgcgtaacggttacgttgggtttacgggtttaccgggacggtaaccgggtaccgtaaagggtccgtaacccggttacgtacggccgtaaaccgcccggtaacgccgttccccgacccgtccggtacctaccgttccggttacccc

SEQ ID NO: 236113 - DNA, 840 bp, Homo sapiens
  misc_feature: GYAE6OF01CVPG9.14.3.A03.1.454.CMB.1.raw
  modified_base (212)..(212): a, c, t, g, unknown or other
  misc_feature (212)..(212): n is a, c, g, or t
tcagcgtctagtaccacgaccggtgctcgatttagagagcgtcacgagggggggtctcaggaggcagcgctctcaggacatctccaccatggcctggctctgctgctcctcaccctctcactcgagggcacgagggtcctgggcccagtctcgccctgactcagcctcgcctccgtgtctcgggtcctccgtggactagtcgactcaacctntcctcgtgacacgtaggaacctagtgtagtacgttgttattattactttcgtctcgtcgtaacactacgcgaccacgacaaccgacccctaactctaatttactttagtagtacgtaactaagtaacgtcggacctacgagttacgttgtaactcgtacttcgtcgtgtcctacgtaacggtcgtacgaacctaaccgtaccggtccccgtaccgttacggacgtaccgtaacgttcccgtacggttaccccgggtcttaacccggcggggttcggaacgggtaccgggtaacgggtaacggtcgtttaacggtacttttaaacgttcggtacgtacgtaacggtaccttaacgttaacttaacgtttaacgtaacgtttacgaaccgggttaacgttaaacgggtttccggggttttaacgggtttacccgggacgggggttaaaaccggtaccggttaaaacccggggtcgggttaaaccccggtttcggggtaaaccggttttacccggaaaccccggttaacccggggtaacccgggttttaccccccggggtaccccgttttaacccccggggttaacccggttcccgttaaccccgttcccccggtttttaaacccccccgg

SEQ ID NO: 236114 - DNA, 862 bp, Homo sapiens
  misc_feature: GYAE6OF01DQCQ6.14.3.A03.1.454.CMB.1.raw
  modified_base (175)..(175): a, c, t, g, unknown or other
  misc_feature (175)..(175): n is a, c, g, or t
  modified_base (177)..(177): a, c, t, g, unknown or other
  misc_feature (177)..(177): n is a, c, g, or t
  modified_base (234)..(234): a, c, t, g, unknown or other
  misc_feature (234)..(234): n is a, c, g, or t
tcagcgtctagtaccacgaccggtgctcgatttagagagcgtcacgagggggggggtctcagggaggcagcgctctcaggacatctccaccatggcctgggctctgctgctcctccaccctctcactcgacgggcaacgagggtccctcgggacccagtctccgaccctgactcncnccgtgccctcggtgtcgtcgggtcctccgtggactagtccgacttccacctcttccnccgtacgacacgtaggaacctaggtttacggacgtttacgggttaggttttatttaacgtttttaacggtttccttaccgttaccgttaacggtaaccaacgaccggaacccgaaccggaaccgaacccgaaaccccgtacccttaaaccgttagtttaactttaacgtttacggaacggttaacgttaactaacggtaccggtacccggtacgtacgttacggttactttacgtacgtccgttacttacgtcgtacgtaccgtacgtacgtacggacgtaacgacccgtaccgtccgttacgcgaactccgtacgtccggtcggttccggtacgtccggtacggtcggtacgggaacggtacggtaacgttacgttaacgttacgtttaacgttacctacgcgtaacgttacgttaacttaagttaacgttaacgttaacgtacgtaacggttacggttaacggtttcggggtttaaccgggtacgggaacgggttaccggtaaccgggtaaccgggtaccggttacccggtacggtacgggtaacccgtaccggaacccggttacccgggtcccggttaccccgttaccccggttaccgttacccgttcccggttcccgtaccccg

SEQ ID NO: 236115 - DNA, 668 bp, Homo sapiens
  misc_feature: GYAE6OF01CCU1O.14.3.A03.1.454.CMB.1.raw
  modified_base (134)..(134): a, c, t, g, unknown or other
  misc_feature (134)..(134): n is a, c, g, or t
  modified_base (184)..(184): a, c, t, g, unknown or other
  misc_feature (184)..(184): n is a, c, g, or t
  modified_base (198)..(198): a, c, t, g, unknown or other
  misc_feature (198)..(198): n is a, c, g, or t
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (271)..(271): a, c, t, g, unknown or other
  misc_feature (271)..(271): n is a, c, g, or t
tcagcgtctagtaccacgaccggtgctcgatttagagagcgtcacgaggggggggtctcaggaggcagcgctctcaggacatctccaccatggcctggctctgctgctcctcaccctctcactcagggcaacgngggtcctgggcccagtctgccctgactcagcctgcctcgtgtctgggtcncgtggacagtcgancacnctctccgtncacgtagaaccagtagtgtacgtttaggtattattagttttcgtctccgtagtaaccaanacgacaccgaggaccaaaccgccccaaactctatttattactgacgtacaagtacgtccgtcctagagttacgtttctaacgtcgtccttcgtcgtcgtactaccgtagtcgtacgaccaaaccgtccggtaccctcgtacgactcgtactcgtcgtccggctaccggtcgcgtaggacggtagcgtacgtatattacgtcgtacgactcgtactactaacgttacttacgttaactaggaaccttagtacggtttggttacgggttacgggtaaccgacggtaaccggtacggtaccggttacccggtaacgtacccggtacggcccgtaacggttacccggtccttaccccgggcccccgtttaagggtcccctaacgttcccggtttaaccccg

SEQ ID NO: 236116 - DNA, 923 bp, Homo sapiens
  misc_feature: GYAE6OF01D35S5.14.3.A03.1.454.CMB.1.raw
  modified_base (197)..(197): a, c, t, g, unknown or other
  misc_feature (197)..(197): n is a, c, g, or t
tcagcgtctagtaccacgaccggtgctcgatttagagagcgtcacgaggggggggtctcagggaggcagcgctctcaggacatctccaccatggcctgggctctgctgcctccctcaccctcctcactcgagggcacgagggtcctgggcccagtctgccctgactcagcctgcctcgtgtctggtctccgtggacngtcgactcacctatcctccgtgcctacgtggaacctaggtacgtggtacgttttggttaatttattatttttcgtcttccttaggtaaccaactagccaccgaggaccaaacgcccccaatctatttattatgacgtacaaataacgtcggcctagtaggtacgtttactaagtcgtctttacgtcgtcggtacctaccgtaagttcccgttagggaccctaaaaccgtcccgggtcccctacccgttacgaacggtcctaacgtttcccgtacggttccgggtacccgtttaccccggaacgggtccgttaacggggaacgggtaacccgggtaacggggtacccgtttaagggttaaccttttttaaacggtttaaccggtttaccggtacccgtaacgggtttcccctttaacggttaaactttaaaaccgtttaaccgttttaaagttttaaccggaaccgtttaaaccgggtttaaacccgttttggggtttttaacccgggggtttttaccgggggaaaccgggggttaaaccggggtaaaccccggttaaaacggggggtttcccggtaacccggggttttaacccggttaccggggttaacccggtacccgggttaaccccccggtaaaacggttccccggttaccccccgggttaccccccccgggtttaccgggtttaacccccgttaccggtttcccccgttttaaccccccggg

SEQ ID NO: 236117 - DNA, 626 bp, Homo sapiens
  misc_feature: GYAE6OF01DELAO.14.3.A03.1.454.CMB.1.raw
  modified_base (194)..(194): a, c, t, g, unknown or other
  misc_feature (194)..(194): n is a, c, g, or t
  modified_base (215)..(215): a, c, t, g, unknown or other
  misc_feature (215)..(215): n is a, c, g, or t
  modified_base (227)..(227): a, c, t, g, unknown or other
  misc_feature (227)..(227): n is a, c, g, or t
  modified_base (279)..(279): a, c, t, g, unknown or other
  misc_feature (279)..(279): n is a, c, g, or t
  modified_base (392)..(392): a, c, t, g, unknown or other
  misc_feature (392)..(392): n is a, c, g, or t
tcagcgtctagtaccacgaccggtgctcgatttagagagcgtcacgaggggggggtctcaggaggcagcgctctcaggacatctccaccatggcctgggctctgctgctcctcaccctcctcactcgagggctacgagggtcctgggcccaggtctgccctgactcagcctgcctcgtgtcgtgggtcctccgnggacagtcgatcaccatctcngcagtacgaacngtagtgtacgtttgttaattattacgttttgtcctccgttaggtacctaacncgaccaccgacggaccaaaccgaccccctaaatctaactttattacgtgacggtacaatacgccgtccctagaggttacgttctaatcgtcttacgtctcggctacgagttcngacaacgaccggtcctccgtgacgctactcgtcggtcgaccgtcgacgtcgtagggaacggtaccggagttctaggttaactttcgttaacgtcggtactacgttcctagtaacttaacgtaccttaaggtccagtaagtaccgttggttacgggttcggacggacggacgtagtccgacgttcgatacgacaccggacgccgtcccgtacccgtgtacctgtcccgttacccg

SEQ ID NO: 236118 - DNA, 817 bp, Homo sapiens
  misc_feature: GYAE6OF01AMQXX.14.3.A03.1.454.CMB.1.raw
tcagcgtctagtaccacgaccggtgctcgatttagagagcgtcacgaggggggggtctcaggaggcagcgctctcaggacatctccaccatggcctgggctctgctgctcctcaccctcctcactcagggcacgagggtcctgggcccagtctgccctgacctcacgcctgtccctccgttgtcgtgggtcctccgtggactagtcgatcaccatcctccgtgccacgtacggaacctaggtagtggtacgttttaggtttaattatttaattttcgtccttacccgtacggtaaccaacgacgaccgacccacggacccaaaccgtaccccccaaattcctaattttaagtttactagaacgtactaaattaaccgtcccggtaccctacgtaagggttacgtttacttaacgtccgttctttcctacgttcggtacctaccgtaggttccgtacggtacccaacccggtacccggtaccccgttaccccgtagtaaccgtcctacgttcccgttacggtccggggtcctaccgggacgggtccgttaggggaacgggaccgggtagtaccgttagttaagtttaccgtacgtcgacgtacgtctaacttaattaacgttacgttaagttacgaacgttaacggttacggttcggggttttaccgggttacggggaccgggtaacgggtaaccggttacgggtacccggtaacccggttcggtaacggtacccgaccggtacccccggtaaggtcccccgttccccgggttacccccgtagggttcccctacccggttttccccgttccccccggg

SEQ ID NO: 236119 - DNA, 618 bp, Homo sapiens
  misc_feature: GYAE6OF01AYF6P.14.3.A03.1.454.CMB.1.raw
  modified_base (232)..(232): a, c, t, g, unknown or other
  misc_feature (232)..(232): n is a, c, g, or t
  modified_base (286)..(286): a, c, t, g, unknown or other
  misc_feature (286)..(286): n is a, c, g, or t
  modified_base (300)..(300): a, c, t, g, unknown or other
  misc_feature (300)..(300): n is a, c, g, or t
  modified_base (325)..(325): a, c, t, g, unknown or other
  misc_feature (325)..(325): n is a, c, g, or t
  modified_base (332)..(332): a, c, t, g, unknown or other
  misc_feature (332)..(332): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (468)..(468): a, c, t, g, unknown or other
  misc_feature (468)..(468): n is a, c, g, or t
  modified_base (576)..(576): a, c, t, g, unknown or other
  misc_feature (576)..(576): n is a, c, g, or t
tcagcgtctagtaccacgaccggtgctcgatttagagagcgtcacgagggggggggtctcagggaggcagcgctctcaggacatctccaccatggccgtgggctctgctgcctcctcaccctcctcactcgacgggcacgacgggtccgtcgggcccagtctcgccctgacctcacgccgtcgccttccgtgtcgtcgggtctcgtcggacagtgactccacctatcctccngccactacggaacagtagtgttagttgttattattattgtcctcgtagtaccanacgcctaaccgganaccaaaccgcccaatctattagttnagactanaaatacgccgtcagtagtatttacatcgttctntccggtnacctacaagtcgtaggaccaacgtctcccgtcagcctcgaattcggtgcggtctcggagtcgtagggacgaggactagtagtaacttacgttagcnagtcgataatactatacgtacagttaactggtttacggtagggttcgggaaggtaccggaacggtacgtcggtaacccgttcgtacgggtacaaccggacccggtaancccgtaccgtacccccgtaggtcccttaccgttgtacccccg

SEQ ID NO: 236120 - DNA, 909 bp, Homo sapiens
  misc_feature: GYAE6OF01A6IY2.14.3.A03.1.454.CMB.1.raw
  modified_base (201)..(201): a, c, t, g, unknown or other
  misc_feature (201)..(201): n is a, c, g, or t
tcagcgtctagtaccacgaccggtgctcgatttagagagcgtcacgaggggggggtctcaggaggcagcgctctcaggacatctccaccatggcctggctctgctgctcctcaccctctcactcgagggcacgagggtcctgggcccagtctcgccctgacgtcacgtcctcgcctccgtgtcgtcggtcctccgtggacngtcgatccacctatccgtcctagccacgtacggaacctaggttaggtcgttacggtttaggtttatttaagtttaagttttcggtccttaccgttaacgggtaacccaaacgtcgacctaacccggagaaccctaaaacccgaccccctaaactcttaaagttttaactttaagtacggttaaccggttaactaaaacgttaaccggtccccggtaccgtacggtaaacggtttaaccgttttaaccgtaacgttccgttccttttccgtacggtaccgtcccgttaaccgtaacgttaccgtacggtaaaccctaaccgggtcccgtacccttcccggtagtacggtaaccttcgttacgttccgggtcggtaccgtacccgggtcggtacgtacgggaacgggccggtaacggttcgttaaggttaacgttttacgttacggacgttacggacttacctaggttaaacttaacgtttaacttaacggttccgaaacggttacggttttaacggtttccggggtttaagggttacccggggaaccggttaacgggaaccggttagggttaacccccggttaccggggtttaaacccgtacccggggtactaacccccgggtacccggtaaaccggttcccccgttaaccccgggttacccccgtttaccggttaaccccgtttcccggtaccccgtttccccccggg

SEQ ID NO: 236121 - DNA, 643 bp, Homo sapiens
  misc_feature: GYAE6OF01DNU3E.14.3.A03.1.454.CMB.1.raw
  modified_base (205)..(205): a, c, t, g, unknown or other
  misc_feature (205)..(205): n is a, c, g, or t
  modified_base (220)..(220): a, c, t, g, unknown or other
  misc_feature (220)..(220): n is a, c, g, or t
  modified_base (259)..(259): a, c, t, g, unknown or other
  misc_feature (259)..(259): n is a, c, g, or t
  modified_base (374)..(374): a, c, t, g, unknown or other
  misc_feature (374)..(374): n is a, c, g, or t
tcagcgtctagtaccacgaccggtgctcgatttagagagcgtcacagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcncctgcactggaaccngtagtgagtttgtattattatttgtctctggtaccaacngcacccaggacaaacgccccaaactcctatttatttatagacggtacaataatcggccctcaggtacgtttactaatcgctttctctcggtcctctaaagtcgttaggcaaaccnccggccctcccgtgacgtctactcttcgagggtcctcccgaaggctagggacgacgacgctaggtatttataactgacaggtctactaataagttacttaagtacgaactaggtaaaccttggtttccgggttttacgggacggggtaaacgggtaaccggtaacgggttcccggaacccgtttacccgtagggtacccgtaccggtaacccgtaaccggtcgttaccccgacccccgttaggtcccaaccgtttccgttaacccccgg

SEQ ID NO: 236122 - DNA, 780 bp, Homo sapiens
  misc_feature: GYAE6OF01A60G3.14.3.A03.1.454.CMB.1.raw
  modified_base (542)..(542): a, c, t, g, unknown or other
  misc_feature (542)..(542): n is a, c, g, or t
  modified_base (565)..(565): a, c, t, g, unknown or other
  misc_feature (565)..(565): n is a, c, g, or t
tcagcgtctagtaccacgaccggtgctcgatttagagagcgtcacgagggggggggtctcaggaggcagcgctctcaggacatctccaccatggcctggctctgctgctcctcaccctcctcactcagggcacgagggtcctgggcccagtctcgccctgactcacgcctgccttcgtgtcgtgggtcctccgtggacagtcgactccacctacttcctcctgcctacgtacggaaacctaggttacggttaggttacggttttaggtttaattttaattttaagttttttcgtccttcccgttacggtaacccaaacgtacgacccaacccgaacggaacccgaaaaccccgacccccctaaaacttaccttaattttactttagtaggtaacggttaacaaaagttaaccgtcccggtaccctagtaacggttacgtttactaacttccgtccttcctcgtcgtcctaccgtacgtcgtacgacctaaccggacccgtccctcccgtagacgtctacttccgtcggtcggtcctaccggnggtcgtaggacgggacgtcggtnttaggttacttacttacgtcgacgtagtctactaacttaacgtacttaagttacgacgtaaacgttcggtttcgggtttacggggtttaccggggacgggtaacggggaacgttacggggtaccgtaacccggttccgtaggtacccgaccgggaaccgtacggttcccgtacccggtacccccgttacggtacccttccgttccgttacccccg

SEQ ID NO: 236123 - DNA, 855 bp, Homo sapiens
  misc_feature: GYAE6OF01CEC2V.14.3.A03.1.454.CMB.1.raw
tcagcgtctagtaccacgaccggtgctcgatttagagagcgtcacgaggggggggtctcaggaggcagcgctctcaggacatctccaccatggcctgggctctgctgctcctcaccctcctcactcagggcacgagggtcctgggcccagtctgccctgactcacgcctgcctccgtgtcgtgggttctccgtggacagtcgatccaccattctcctgctacgtggaaccagtagtgtacgtttggtttaatttatttaattttcgtccttaccgtacggtaaccaacacgccacccgaggaaccctaaaccgaccccctaaacttacctaatttttaacgttttaagacgggtaacggttaacctaaaacgtttaaccgttaccccgggtacccttacggttaaagggtttaccgtttttacgtaaacttccggttaccttttccgttaccgttacggtacccttaaccgtaacgttccgtaccggtaacccaaacccgtcccggtccccttacccggtagtacgtacctacgttccgtcgggtaccggtcttacccggacggtacgtaggaacgggacgtacggttacgttacgttaactttaaacgtttcgcgtaaccgtagtcccgttaaactattaacgttaaccgtttaaagtaccgtacggttaaccggtttaacggtttcggggttttaacgggtttacccggggaacgggtaaaccgggtaaccgggtttacgggtaaccccggttacccggttccggttacggaaccggtacccgaacccgggtacggttcccccttacccgggtccccccggttattaccctacccgtttcccgttaccccccg

SEQ ID NO: 236124 - DNA, 791 bp, Homo sapiens
  misc_feature: GYAE6OF01B1ACI.14.3.A03.1.454.CMB.1.raw
  modified_base (215)..(215): a, c, t, g, unknown or other
  misc_feature (215)..(215): n is a, c, g, or t
  modified_base (468)..(468): a, c, t, g, unknown or other
  misc_feature (468)..(468): n is a, c, g, or t
tcagcgtctagtaccacgaccggtgctcgatttagagagcgtcacgaggggggggtctcaggaggcagcgctctcaggacatctccaccatggcctggctctgctgcctcctcaccctcctcactcgagggcacgtagggtcctgggcccaggtctcgccctgacctcagtcctgcctcgtgtcgtggtctccgtggacagtcgatccaaccgtntccgtccgtcgacctacgtagaaccgtaggtacgtggtacgtttaggtttaatttagtttaagttttcgtccttacgttacggtaaccaacgtacgccaacccgaggaaccaaaccccgtaccccaacttacctagtttatttagtagtaacggtactaaatacggtccgtcccgtacgtaaggttcttactaacgtccttacttcttcgtcggtactccgtaagttcacggtacgaacgccggtaccctcgngtacgccttatcgtacggtcggccgttacgcggtacgtgggacggacggtcggtacgttaggttaactttcgttacgacgtacctggtacctattaacttaacttacgttaacgtagtaacgtacgttaccgggtttggttttccggggttaccggaacggggtccggggtaacctaacgggggttaccccgtaccgggttaccggttacgttaaccccgggaaccggttaccccggtaaaccggggtttcccccgaccccccggggttaccccggttaacccgttccccgttccccggttttcccgggtttaccccccccgg

SEQ ID NO: 236125 - DNA, 789 bp, Homo sapiens
  misc_feature: GYAE6OF01A6GNF.14.3.A03.1.454.CMB.1.raw
tcagcgtctagtaccacgaccggtgctcgatttagagagcgtcacagggggggggtctcaggaggcagcgctctcaggacatctccaccatggcctggctctgctgctcctcacccctcctcactcagggcacgagggtcctgggcccagtctcgccctgactcagcctgcctccgtgtctgggtcctcgtggacagtcgataccacctactcctcctcgacacgtacggaaaccaggttacggtgtaacggtttggttaatttaagtttaaatttttcgtcttaccgtaggtaaccaacacgaccaacccgaaggacaaaaccgacccccaaaacgtacctaatttaatttaacgtagtacggttaacaaacgtaacgtcccgaccctacgaaggttaacgtttactaacttccgtactttccgtcgtacggtcctaccgtaaggtcctaggacgaaacccgtacccggaccctcccgtagacgacctacgtctacgtcggacctaccggagtacgtacggaacggtaacgacggtcttaaggtaactttaacgttacgtacgtaccgacgtacgtaccttaacttacttaacgttaagttaacggtacctaaagttaacgtttgggtttaccggggttttaccgggaacgggtaacgggtaaacgtaaccgggttaccgggaacccgttcggtaacgggtacccgtaaacccggtacccgtaaaccggttcccggtaaccccggttacccccgtacggtttaacccgtaccgttcccgttacccccg

SEQ ID NO: 236126 - DNA, 800 bp, Homo sapiens
  misc_feature: GYAE6OF01DYZI3.14.3.A03.1.454.CMB.1.raw
  modified_base (144)..(144): a, c, t, g, unknown or other
  misc_feature (144)..(144): n is a, c, g, or t
  modified_base (217)..(217): a, c, t, g, unknown or other
  misc_feature (217)..(217): n is a, c, g, or t
tcagcgtctagtaccacgaccggtgctcgatttagagagcgtcacgaggggggggtctcaggaggcagcgctctcaggacatctccaccatggcctgggctctgctgctcctccaccctcctcactcgagggcacgagggtccngggcccagtctgccctgactcagcctgcctcgtgtcgtggtctccgtggacagtcgatccaccagtcctccgngcacgtacggaacctagtagtcgttacggtttgtttaattaatttaacgttttcgttccttaccgttacggtaaccctaaacgtacgaccaacccgaacggacccgaaaaccgtaccccccaaaacgttacccttaattttaacgttttacgtagggtaacggttaactaaaacttaaaccggtacccgggtacccttacggtaacgggttaacgtttttaaccgtaaattccgtacgttttaccgttccgttacggtcccttaaccgtaagttcccgtacgggaccaaacgtacccggtcccgttcccgtagacgtacgtattcccgttggtccgggtaccttccggaacgggtcgtagggaaccgggacgtacggtaccgttagtaactttaacgttacgtacgacttaacgccttaagtaactaactttaacttaagtctaacggtaacgttaacggttggtttacgggttacgggacgggtaaccgtacggtaacggtaccgtaccggttacgtacggacgtcggacccgtacggaccgtcccggaccccggttaccgtacgtcccgttcgtcccccgg

SEQ ID NO: 236127 - DNA, 585 bp, Homo sapiens
  misc_feature: GYAE6OF01COGSY.14.3.A03.1.454.CMB.1.raw
  modified_base (139)..(139): a, c, t, g, unknown or other
  misc_feature (139)..(139): n is a, c, g, or t
  modified_base (168)..(168): a, c, t, g, unknown or other
  misc_feature (168)..(168): n is a, c, g, or t
  modified_base (211)..(211): a, c, t, g, unknown or other
  misc_feature (211)..(211): n is a, c, g, or t
  modified_base (217)..(217): a, c, t, g, unknown or other
  misc_feature (217)..(217): n is a, c, g, or t
  modified_base (275)..(275): a, c, t, g, unknown or other
  misc_feature (275)..(275): n is a, c, g, or t
  modified_base (307)..(307): a, c, t, g, unknown or other
  misc_feature (307)..(307): n is a, c, g, or t
  modified_base (386)..(386): a, c, t, g, unknown or other
  misc_feature (386)..(386): n is a, c, g, or t
  modified_base (409)..(409): a, c, t, g, unknown or other
  misc_feature (409)..(409): n is a, c, g, or t
  modified_base (448)..(448): a, c, t, g, unknown or other
  misc_feature (448)..(448): n is a, c, g, or t
tcagcgtctagtaccacgaccggtgctcgattttagagagcgtcacgaggggggggtctcaggaggcagcgctctcaggacatctccaccatggcctggctctgctgcctcctccaccctcctcactcgagggcaacgngggtcctgggcccagtctgccctgactcngtcctgcctcgtgtcgtgggtcctcgtggacagtcgatccacntctccngcacgtaggacctaggtagtgtacgtttgtaattagttatttgtcttcgtagaccaancgcaccgagacaaacaccccaatcattaattntagagtacaagtactaccggcctacgagtacttactatccgtcttcgtctgactctaagctagacacgccgcctccgtnacgtctactctcgtgtccaccgngtcgtagaggaccgtgtactagtagttagtactgactcnctatatattactatacgtacgtagtagttgggttcggtttacggacggtaacggccgtaaggtccgtaacccgtcgtaaggactaccgaccgtacgccgttacccgcccgttaacgtcctacgttaccggttccccg

SEQ ID NO: 236128 - DNA, 737 bp, Homo sapiens
  misc_feature: GYAE6OF01E0QQD.14.3.A03.1.454.CMB.1.raw
  modified_base (194)..(194): a, c, t, g, unknown or other
  misc_feature (194)..(194): n is a, c, g, or t
tcagcgtctagtaccacgaccggtgctcgatttagagagcgtcacaggggggggtctcagggaggcagcgctctcaggacatctccaccatggcctgggctctgctgctcctcaccctcctcactcagggcacagggtcctgggcccagtctgccctgactcagcctgcctccgtgtcgtgggtctcctggacngtcgatccaaccatcctcctgccacgtacggaacctaggtaggtcgtacggtttggtttaatttaatttaatttttcgtccttccgttacggtaacccaacgtaccgccaaccccgagggaacccaaaaccgaccccccaaatacttaactttaatttagaggtaggtactaaagttaacgtccggtccctacggaggtacgttttactaattcctcttctcgtcggtaccttacgaagttccgtacggacctaaccggtacccgtcccttccgtagacgtactcttaccgtcggtcggtcctccgtacgtcgtacgggacgggacggtacggtacgtacgttatttaacttacgtcgtcgtacgtactactagttaacttaacgttaagttacgtacgtaaggtacgtttacggtttaggggttacgggtacgggtactaaccggggggggggggtactaccgggtacccggtaccggtacggtaccggacgacccgtacggtccgtcccgtccccgtaccgtcctccgttcgttacccccg

SEQ ID NO: 236129 - DNA, 578 bp, Homo sapiens
  misc_feature: GYAE6OF01D9VBQ.14.3.A03.1.454.CMB.1.raw
  modified_base (221)..(221): a, c, t, g, unknown or other
  misc_feature (221)..(221): n is a, c, g, or t
  modified_base (258)..(258): a, c, t, g, unknown or other
  misc_feature (258)..(258): n is a, c, g, or t
  modified_base (290)..(290): a, c, t, g, unknown or other
  misc_feature (290)..(290): n is a, c, g, or t
  modified_base (307)..(307): a, c, t, g, unknown or other
  misc_feature (307)..(307): n is a, c, g, or t
  modified_base (311)..(311): a, c, t, g, unknown or other
  misc_feature (311)..(311): n is a, c, g, or t
  modified_base (314)..(314): a, c, t, g, unknown or other
  misc_feature (314)..(314): n is a, c, g, or t
  modified_base (324)..(324): a, c, t, g, unknown or other
  misc_feature (324)..(324): n is a, c, g, or t
  modified_base (352)..(352): a, c, t, g, unknown or other
  misc_feature (352)..(352): n is a, c, g, or t
  modified_base (526)..(526): a, c, t, g, unknown or other
  misc_feature (526)..(526): n is a, c, g, or t
  modified_base (560)..(560): a, c, t, g, unknown or other
  misc_feature (560)..(560): n is a, c, g, or t
  modified_base (566)..(566): a, c, t, g, unknown or other
  misc_feature (566)..(566): n is a, c, g, or t
tcagcgtctagtaccacgaccggtgctcgatttagagagcgtcacgaggggggggtctcaggaggcagcgctctcaggacatctccaccatggcctgggctctgctgctcctcaccctcctcactcagggcacagggtcctgggcccagtcctgccctgactcagcctgcctccgtgtctgggtctcctggacagtcatcacatctcctgcacgtgaaccngtagtgagttgttattattatttgtctctggtaccangcaccagacaacgccccaaatctattatttangagtcaatactcgcctnagtnttntatcgcttcnctggcctacagctgacaacgacgtcccnctacgacgtcacttcgtacgttcggccttccgaggtcgtacgggtaaggaccggacggtcgtacgtaattttcgtaacgtcggactacgacttactattacgttataacgttacgaacgtacgttaacgttggtttacggttcggacggtacggaccgtaggtcgtacccggtntacggctacggcccgaagtccgtccgtaccccgngttccncgttcgtccccg

SEQ ID NO: 236130 - DNA, 772 bp, Homo sapiens
  misc_feature: GYAE6OF01BAFMA.14.3.A03.1.454.CMB.1.raw
  modified_base (264)..(264): a, c, t, g, unknown or other
  misc_feature (264)..(264): n is a, c, g, or t
tcagcgtctagtaccacgaccggtgctcgatttagagagcgtcacaggggggggtctcaggaggcagcgctctcaggacatctccaccatggcctgggctctgctgctcctcaccctctcactcagggcacagggtcctgggcccagtctgccctgactcagcctgcctccgtgtctgggtctcctggcagtcgatcacccatctcctgcacgtgaaccagtagtgcgttggtttattattaattttcgtctctggtaccaacngcacccaggcaaacgccccctaaactcacttatttataggtagtacaattaacgtccggtcctacgtaggtacgtttactaactccgtacttctcttcggtacctacctaagtcgtaggacaacgcgtccctcccgtagtacgctatcctaccgtcggtccttacccgagggtcctagggacggacgtacggtacttacgtaagtttacgttacgtcgacgtacgttcgtacctaagttaactaacgtttaacgtttacgacgttaaacgttaaccgggtttacgttacgggggtttttacccgggacggggttaaaacccggggtaccggttaaaacgggggtttacccggtaaccccgggttacccggggtttaaacccgggttaccccgtaaccggggttaacccccggtaaacccggggtacccccggttttccccggggtaccccccccgttttaaccccggggtccctttaaaccccggtttcccggtttaccccccccggg

SEQ ID NO: 236131 - DNA, 720 bp, Homo sapiens
  misc_feature: GYAE6OF01A9N3O.14.3.A03.1.454.CMB.1.raw
  modified_base (121)..(121): a, c, t, g, unknown or other
  misc_feature (121)..(121): n is a, c, g, or t
  modified_base (224)..(224): a, c, t, g, unknown or other
  misc_feature (224)..(224): n is a, c, g, or t
  modified_base (478)..(478): a, c, t, g, unknown or other
  misc_feature (478)..(478): n is a, c, g, or t
tcagcgtctagtaccacgaccggtgctcgatttagagagcgtcacgaggggggggtctcaggaggcagcgctctcaggacatctccaccatcggcctgggctctgctgctcctcacctccncactcgagggcacgcgggtccgtcgggcccagtctcgccctagactcacgcctcgcctccgttgtccgtgggtctccgtagggacaggtacgactccaacctntccttaccgcgacctacgttacgggaaacctaggttacgttaggtacgttttaggttttaattaattttaacgttttcgttccttaccggtacggttaaaccaacgtaccgactaacccgaggtaaccaaaccgacccctaacttacttagtttacttagtagtacgtaacaatacgtcgtacctgtaggttattactacgtctcttactcgacgtactacaagtcgacggacaacgtccgtactccgagtacnctacgtcgtcggtaggtcctagtccgggacgtacggacggtaccggtagtcgtaactacgtttacgtacgtacggtactcggtaactaccttaagttaacttaccgtaatacggtaactaacgttcgttaggttaccgggttcgggaaacggtacggtaccggtacggttccgaaccggttccgtaggacgttacgacgaccggtactccccggtacctacggtccttaccgtaccggtccc

SEQ ID NO: 236132 - DNA, 664 bp, Homo sapiens
  misc_feature: GYAE6OF01ARAIC.14.3.A03.1.454.CMB.1.raw
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
  modified_base (227)..(227): a, c, t, g, unknown or other
  misc_feature (227)..(227): n is a, c, g, or t
tcagcgtctagtaccacgaccggtgctcgatttagagagcgtcacgaggggggggtctcaggaggcagcgctctcaggacatctccaccagtggcctgggctctgctgctcctcaccctctcactcgagggccacgtagggtcctggggccctagtctgaccctgactcagcctgcctcgtgtctggtctcctggacngtcgatccacntcncctgcacgtgaaccngtagtcacgttagttattatattttgcttccaggtaccacacgcaccgaggaccaaacgccccaaatcatttatactgacgtcaatatccggcctagacggtatttcaactcgtcttctcgtacgcttacccgtaagtcttaggacccaaccgtacgggtcccctaccgtagaacgcctaagttcctccggtggtacccttaccggacggttcgtaaggaccggtaacggtacggaccgttaggtaactttacgttacgacgtcgtacgtcttatagttaacttataacgttagacctaaaggttacgttaggtttcggtttacgggaaccgggtacggtaaccgtaacgggtaccggtaccgtaccggtaggtacgaacccggaccgtaagcccgtttccccggacccgtacgggtaccttcgttcgttacccccg

SEQ ID NO: 236133 - DNA, 778 bp, Homo sapiens
  misc_feature: GYAE6OF01CJW1D.14.3.A03.1.454.CMB.1.raw
  modified_base (157)..(157): a, c, t, g, unknown or other
  misc_feature (157)..(157): n is a, c, g, or t
  modified_base (429)..(429): a, c, t, g, unknown or other
  misc_feature (429)..(429): n is a, c, g, or t
tcagcgtctagtaccacgaccggtgctcgattttagagagcgtcacaggggggggtctcaggaggcagcgctctcaggacatctccaccatggcctgggctctgctgcctcctcaccctcctcactcgaggcacgaggtccgtcgggcccagttccncgccctagactcacgcctagcccgtcgtgttcgtgggtcctccgtggactacgtcgactccaacctcgtcctcctacgctaacgtacggaaccgagtaggttcgtacgtttaggtttaatttatttagttttcgtaccttacgtacgtaaccacgacgacccaaccgaacgaccaaaccgaccccgaacttactaatttatttacgtagtacgtaactaaacgtacgttcccgaactagtacggttacgttttacgtacctcttcgtttacncgttcgtaccgtacgtacgtcgtagaccctaaccggtaccgtcccctagtacgacgcctacgtccgtacgtccggtctacccggacgtacgtacggacggtaacggtacgtacgtaacgtttacgttacgttacgtaccgtacgtacgtacttaactactaacgtttaacgtaacgttacgtaacgttaggttaccggtttagggttcgggtttacgggacgggtaaaccgggttacggtacgggttaccgtaccggttacggtaaccgaccggttaccggaaccggttaccggtcccgttacccccggttcccgttagggttccccgtcgttaccccggtttccccgg

SEQ ID NO: 236134 - DNA, 506 bp, Homo sapiens
  misc_feature: GYAE6OF02IQ2RS.14.3.A03.1.454.CMB.1.raw
  modified_base (316)..(316): a, c, t, g, unknown or other
  misc_feature (316)..(316): n is a, c, g, or t
  modified_base (336)..(336): a, c, t, g, unknown or other
  misc_feature (336)..(336): n is a, c, g, or t
tcagcgtctagtaccacgaccggtgctcgatttagagagcgtcacaggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaaatcattatttatgaggtcaataatcggccctnaggagtttctaatcgcttcnctggctccaagtctggcaacacggcctccctgagcatctctgggctcaggctgaggacgaggctgattattactgcagctcatatactattagcagaactgttggttttcggcggagggaccaggtgaccggtctaggtcagccaaggctcgcccctggtccactctccg

SEQ ID NO: 236135 - DNA, 539 bp, Homo sapiens
  misc_feature: GYAE6OF02HJLV9.14.3.A03.1.454.CMB.1.raw
  modified_base (331)..(331): a, c, t, g, unknown or other
  misc_feature (331)..(331): n is a, c, g, or t
tcagcgtctagtaccacgaccggtgctcgatttagagagcgtcacaggggggtctcaggaggcagcgctctcaggacatctccaccatggcctgggctctgctgctcctcaccctcctcactcagggcacagggtcctgggcccagtctgtcctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcagtaatcggccctcaggggtttctaatcncggggttctctggctccaagtctggcaacacggcctccctgaccatctctgggctccaggctgaggacgagtctgattattattgcagctcatatgcacctggcagcaatcaatgtgggttttcggcggggggtaccgaagggttcggaccggtcccgttagggtccaggcccgaaggccgtacggccccctccggttccacttcccg

SEQ ID NO: 236136 - DNA, 503 bp, Homo sapiens
  misc_feature: GYAE6OF02HBML5.14.3.A03.1.454.CMB.1.raw
tcagcgtctagtaccacgaccggtgctcgatttagagagcgtcacaggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaatcattattatgaggtcaataatcggccctcaggagtttcaatcgcttctctggctccaagtctggcaacacggcctccctgagcatctctgggctccaggctgaggacgaggctgattattactgcagctcatatactattagcagaactgtggttttcggcggagggaccaggtgaccgtctaggtcagcccaaggctcgcccctcggtcactctccg

SEQ ID NO: 236137 - DNA, 516 bp, Homo sapiens
  misc_feature: GYAE6OF02JSYFT.14.3.A03.1.454.CMB.1.raw
tcagcgtctagtaccacgaccggtgctcgatttagagagcgtcacaggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctgtacaacagcaccaggcaaagcccccaaatcatgattatgaggtcagtaatccggccctgaggggtttctaatcgtacttctctggctccaagtctggacaacacggcctcctgaccatctcgtgggcctccaggctggaggacgagtctgacttattattgctagtctctatatgctacctggactagcaaatcatgttggtttcggcggggtacaggtcgacgttcgtaggtcagcccaaggcctcgcccctggtctaccg

SEQ ID NO: 236138 - DNA, 547 bp, Homo sapiens
  misc_feature: GYAE6OF02I9VJH.14.3.A03.1.454.CMB.1.raw
  modified_base (305)..(305): a, c, t, g, unknown or other
  misc_feature (305)..(305): n is a, c, g, or t
  modified_base (309)..(309): a, c, t, g, unknown or other
  misc_feature (309)..(309): n is a, c, g, or t
  modified_base (388)..(388): a, c, t, g, unknown or other
  misc_feature (388)..(388): n is a, c, g, or t
  modified_base (404)..(404): a, c, t, g, unknown or other
  misc_feature (404)..(404): n is a, c, g, or t
tcagcgtctagtaccacgaccggtgctcgatttagagagcgtcacagggggggtcggtcgaggaggcgagcgctctcaggacatctccaccatggcctgggctctgctgctcctcaccctcctcactcaggcacagggtcctgggcccagtctgccctgactcagcctgcctcgtgtctgggtctcctggacagtcgatcaccatctctgcactggaaccagtagtgacttggtattataattttgtctctgtacacagcaccagcaagaccccaactcacttattatgagtcaataatcgcctnaggngtttctatgcttctctgctcaagtctaggcacacgcctcctgacgcatctctggctccaggctgaggcgaggctgattnttaacgtgcagctacntatactattagcaagtaattcggttggtttttcggacggggagggtaccgaagggttcggaacccgggttccgttacggtacgtacggaccccgaaagggtccgtccggtacccccttcggggtcctaccttccgttacccgg

SEQ ID NO: 236139 - DNA, 518 bp, Homo sapiens
  misc_feature: GYAE6OF02G1HM6.14.3.A03.1.454.CMB.1.raw
  modified_base (295)..(295): a, c, t, g, unknown or other
  misc_feature (295)..(295): n is a, c, g, or t
  modified_base (414)..(414): a, c, t, g, unknown or other
  misc_feature (414)..(414): n is a, c, g, or t
tcagcgtctagtaccacgaccggtgctcgatttagagagcgtcacagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcaccaggcaaagcccccaaatcattatttangaggtcaataatcggcctcaggatttctaatcgcttctctgctccaagtctggcaacacggcctccctgagcatctctgggctccagctggaggacgaggctgattattactgcagctnatatactattagactagtaacttgttacggttttcggacggtagggacctagggtcgaccgtcgtaggtcacgccgaagctcgccccgtggtacctactctccg

SEQ ID NO: 236140 - DNA, 525 bp, Homo sapiens
  misc_feature: GYAE6OF02GS940.14.3.A03.1.454.CMB.1.raw
  modified_base (348)..(348): a, c, t, g, unknown or other
  misc_feature (348)..(348): n is a, c, g, or t
tcagcgtctagtaccacgaccggtgctcgatttagagagcgtcacaggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacaacacccaggcaaagcccccaaatcatcatttatgaagtctctaagcggccctcagggtatctaatcgcttctctggctccaagtcnggcaacacggcctccctgaccgtctctcggcctcagactgacggacgaggctgattatactgccactcatatagaagtagtactactcctgttggtttcggcggagggaccaagctgaccgtctacggtcaggcccaaggcctcggccccctcggtccacctcttcgtcccgtcccc

SEQ ID NO: 236141 - DNA, 536 bp, Homo sapiens
  misc_feature: GYAE6OF02F44NR.14.3.A03.1.454.CMB.1.raw
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataagtatgtctcctggtaccaacaacacccaggcaaagcccccaaactcatgatttatgaggtcagtaatcggccctcaggggtttctaatcgcttctctggctccaagtctggcaacacggcctccctgaccatctctggctccaggctgaggacgagtctgattattattgcagctcatatgcacctgcagcaatcagttgtggttttcggacgggggtaccgtaagggtacggtaccggtaccgttacggtcgtacgacccggtaacggccgtccggtcccccgtcggtacccg

SEQ ID NO: 236142 - DNA, 645 bp, Homo sapiens
  misc_feature: GYAE6OF02G1QJN.14.3.A03.1.454.CMB.1.raw
  modified_base (255)..(255): a, c, t, g, unknown or other
  misc_feature (255)..(255): n is a, c, g, or t
  modified_base (315)..(315): a, c, t, g, unknown or other
  misc_feature (315)..(315): n is a, c, g, or t
  modified_base (338)..(338): a, c, t, g, unknown or other
  misc_feature (338)..(338): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
tcagcgtctagtaccacgaccggtgctcgatttagagagcgtcacagggggggtcgtcaggaggcagcgctctcaggacatctccaccatggcctgggctctgctgctcctcaccctcctcactcaggcacagggtcctgggcccagtctgccctgactcagcctgcctcgtgtctgggtctcctggacagtcgatcaccatctcctgcactggaaccagtagtgacgttggtattatattttgctctgtaccanagcaccaggcaaacgccccccaaaatcattaagtttatagaggttcaataatcggccctnaaggagtttctaatcgtcttctntggctaccaagtccttggctaaacgcggcccttccctggagcctaattctcccgtgggtcctccgaggctcggaggtacgaggtctgaattattacncgtanacgtctacattactacgttaattgacgtagtaacgttggttacggttttcgggacgggtaacggggtaaccctaagggggttaccgtaacccggttccgttaacggggtacccgtacggaaacccccggttaacgggtacccgtttcccgggtaccccccccgttcggggtttaacccttaccccgttcccgttttaacccccgg

SEQ ID NO: 236143 - DNA, 540 bp, Homo sapiens
  misc_feature: GYAE6OF02F2RZR.14.3.A03.1.454.CMB.1.raw
  modified_base (306)..(306): a, c, t, g, unknown or other
  misc_feature (306)..(306): n is a, c, g, or t
  modified_base (313)..(313): a, c, t, g, unknown or other
  misc_feature (313)..(313): n is a, c, g, or t
  modified_base (354)..(354): a, c, t, g, unknown or other
  misc_feature (354)..(354): n is a, c, g, or t
tcagcgtctagtaccacgaccggtgctcgatttagagagcgtcacagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcaccaggcaaagcccccaaactcattattatgagtcaataancggcctnaggagtttctaatcgcttctctggctccaagtctggcaacncgcctccctgagcatctctggctcgaggctgaggacgaggctgattattactgcagctacatatactattagcaagtaacttgttggttttccggcggtacgggacctagggtcgaccggttccgtaggtccgacgacccgaaggtccgtccggccccccgttcggtcctaccgttccgttcccgg

SEQ ID NO: 236144 - DNA, 518 bp, Homo sapiens
  misc_feature: GYAE6OF02HQZPF.14.3.A03.1.454.CMB.1.raw
tcagcgtctagtaccacgaccggtgctcgatttagagagcgtcacagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagccccccaaaactcattatttatgaggtcaataatcggccctcaggagtttctaatcgcttctctggctccaagtctggcaacacggcctccctgagcatctctgggctccgaggctggaggacgaggctgattattactgcagctcatatacttattagcagacttgttggtttcggcggtaggaccaggtcgaccgtcctaggtcacgcccgaggctcgcccctcggtcctactcttccg

SEQ ID NO: 236145 - DNA, 555 bp, Homo sapiens
  misc_feature: GYAE6OF02JJU64.14.3.A03.1.454.CMB.1.raw
  modified_base (263)..(263): a, c, t, g, unknown or other
  misc_feature (263)..(263): n is a, c, g, or t
  modified_base (296)..(296): a, c, t, g, unknown or other
  misc_feature (296)..(296): n is a, c, g, or t
  modified_base (314)..(314): a, c, t, g, unknown or other
  misc_feature (314)..(314): n is a, c, g, or t
  modified_base (353)..(353): a, c, t, g, unknown or other
  misc_feature (353)..(353): n is a, c, g, or t
  modified_base (435)..(435): a, c, t, g, unknown or other
  misc_feature (435)..(435): n is a, c, g, or t
  modified_base (513)..(513): a, c, t, g, unknown or other
  misc_feature (513)..(513): n is a, c, g, or t
tcagcgtctagtaccacgaccggtgctcgatttagagagcgtcacagggggggtcgtcaggaggcagcgctctcaggacatctccaccatggcctgggctctgctgctcctcaccctcctcactcaggcacagggtcctgggcccagtctgccctgactcagcctgcctccgtgtctgggtctcctggacagtcgatcaccatctcctgcactggaaccagtagtgacgtttggttattataattttgtctctggtaccaacngcaccagcaaagcccccaaactcaattatttangagtcaataatcggcctnaggtatttctaatcgcttctctgctcaagtctggcaacncgccctcctgacgctagtctctcgggctccgaggcctaggacggtacgaggcctgaactttagttacgtgtcacggtcttanattataccttagttacgactaagaacttggttggttttccggacgggtagaccgtaggtacggaccttccgtaaggtnaccgacccgtaaggcctcgccccctggtaccacgttcctccg

SEQ ID NO: 236146 - DNA, 530 bp, Homo sapiens
  misc_feature: GYAE6OF02HWB1G.14.3.A03.1.454.CMB.1.raw
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
tcagcgtctagtaccacgaccggtgctcgatttagagagcgtcacagggggggtctcaggaggcagtgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattattangaggtcaataatcggccctnaggtagtttctaatcgcttctctggctccaagtctggcaacacggcctccctgagcatctctgggctccaggctgaggacgaggctgattattactgcagctcatatactaattagctagaacttgttgggttttcggcgggtagggaccgaaggtcggaccgtcgtaggtcacgcccgaaggcctcggccccctcgggtcctacgtccttccg

SEQ ID NO: 236147 - DNA, 513 bp, Homo sapiens
  misc_feature: GYAE6OF02IDMXU.14.3.A03.1.454.CMB.1.raw
  modified_base (263)..(263): a, c, t, g, unknown or other
  misc_feature (263)..(263): n is a, c, g, or t
  modified_base (317)..(317): a, c, t, g, unknown or other
  misc_feature (317)..(317): n is a, c, g, or t
  modified_base (357)..(357): a, c, t, g, unknown or other
  misc_feature (357)..(357): n is a, c, g, or t
  modified_base (420)..(420): a, c, t, g, unknown or other
  misc_feature (420)..(420): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaanagcacccaggcaaagcccccaaatcattatttatgaggtcaataatcggccctnaggagtttctaatcgcttctctggctcaagtctggcaacncggcctccctgacgcatctctgggctccaggctgaggacgaggctgtattattactgcagctnatatactattagactagacttgttggttttcggcggagggaccaggtcgaccgtcgtaggtcagcccaggctcgcccctcggtcacctctccg

SEQ ID NO: 236148 - DNA, 505 bp, Homo sapiens
  misc_feature: GYAE6OF02IUYM4.14.3.A03.1.454.CMB.1.raw
  modified_base (295)..(295): a, c, t, g, unknown or other
  misc_feature (295)..(295): n is a, c, g, or t
tcagcgtctagtaccacgaccggtgctcgatttagagagcgtcacaggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaatcattatttangagtcaataatcggcctcaggagtttcaatcgcttctctggctccaagtctggcaacacggcctaccctgagcatctctgggctccagctgaggacgaggctgattattactgcagctcatatactaattagcagaactgtggtttcggcggaggaccaaggtgaccgtctaaggtcaacgcccaaggctacgcccctggtcactctccg

SEQ ID NO: 236149 - DNA, 526 bp, Homo sapiens
  misc_feature: GYAE6OF02H8JBM.14.3.A03.1.454.CMB.1.raw
  modified_base (315)..(315): a, c, t, g, unknown or other
  misc_feature (315)..(315): n is a, c, g, or t
  modified_base (348)..(348): a, c, t, g, unknown or other
  misc_feature (348)..(348): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgtttggttattataattttgtctcctggtaccaacagcaccaggcaaacgcccccaaatcattatttatgagtcaataatcgcctnaggtagtttctaatcgcttctctgctcaagtcnggcaacgacgcctcctgacgcatctctgggctccgaggctggaggacgaggctgtattattactgacagtctcattatactattagcagtaacttgttggtttcggacgggaggaccgaggtcgaccgtcgtacggtcacgcccaaggcctccgccccgtcggtacctcctcttcccg

SEQ ID NO: 236150 - DNA, 590 bp, Homo sapiens
  misc_feature: GYAE6OF02HNYAJ.14.3.A03.1.454.CMB.1.raw
  modified_base (427)..(427): a, c, t, g, unknown or other
  misc_feature (427)..(427): n is a, c, g, or t
tcagcgtctagtaccacgaccggtgctcgatttagagagcgtcacagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggacaaacgcccccaaactcattattatgagtcaatatcggcctcagtagtttctaatcgtcttctctcggtctaccaagtctggacaaacgaccggtcctccctgacgccatcctcgtggctccgaggctgaggacgaggctagattattactganagctacattatacttaatacgacaagtaacgtttgttacgggttttcggacgggtaacgggtaccaagggttcggacccggttccggttaacggttccaacggtaccccggaaggtcccgtcccggtacccccttccgggtacgtacccttaccgttccccgg

SEQ ID NO: 236151 - DNA, 543 bp, Homo sapiens
  misc_feature: GYAE6OF02F3YLG.14.3.A03.1.454.CMB.1.raw
  modified_base (313)..(313): a, c, t, g, unknown or other
  misc_feature (313)..(313): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggtattataattttgtctcctggtaccacagcacccaggacaagcccccaaatcattattatgaggtcaataatcggcctnaggtagttttcaatcgcttctctggctccaagtctggcaacacggcctccctgacgcatctcgtgggctcgaggctggaggacgaggctgatttacttactgacagctacattatactagttagctaagtaacttggttcggtttacgggcggtaacgggacctagggtcgaccggttcgtaggtcaacggcccgtaaggcctacggcccctggtcctactccttacccg

SEQ ID NO: 236152 - DNA, 515 bp, Homo sapiens
  misc_feature: GYAE6OF02HNMWA.14.3.A03.1.454.CMB.1.raw
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
  modified_base (432)..(432): a, c, t, g, unknown or other
  misc_feature (432)..(432): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgtttggttattataattttgtctcctggtaccaacagcacccaggcaaacgcccccaaatcattatttatgaggtcaataatcggccctcaggtagtttcaatcgcttctctgctccaagtctggcaacacggcctcctgagcatctctggctcgaggctgaggacgaggctgattattactgacngctnatatactataganagacttgtggtttcggcggtaggacgaggtcgaccgtcgtacggtcacgacccgaaggccgtcgccccgtcggtcactctccg

SEQ ID NO: 236153 - DNA, 518 bp, Homo sapiens
  misc_feature: GYAE6OF02IYCU0.14.3.A03.1.454.CMB.1.raw
  modified_base (363)..(363): a, c, t, g, unknown or other
  misc_feature (363)..(363): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattatattttgtctctggtaccaacagcaccaggcaaagcccccaaactcattattatgaggtcaataatcggccctcaggagtttctaatcgcttctctgctcaagtctggcaacacggcctcccngagcatctctgggctcaggctgaggacgaggctgattattactgcagctcatatactattgacagtaactgttggtttcggcggtagggacctaggtcgtaccgtcgtacggtcgacgcccgaaggcctcggcccctcggtaccacgttctcccg

SEQ ID NO: 236154 - DNA, 564 bp, Homo sapiens
  misc_feature: GYAE6OF02IRG75.14.3.A03.1.454.CMB.1.raw
  modified_base (324)..(324): a, c, t, g, unknown or other
  misc_feature (324)..(324): n is a, c, g, or t
  modified_base (436)..(436): a, c, t, g, unknown or other
  misc_feature (436)..(436): n is a, c, g, or t
  modified_base (556)..(556): a, c, t, g, unknown or other
  misc_feature (556)..(556): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggacaaacgacccccaaactcattatttatgaggtacaataactccggccctnaggtagttttactaatcgtctttctctggcctaccaagtctggacaacgacggcctccctgacgcatctcgtgggcctccgaggctggacggacgaggtctgtattattacngcagctcatatactatagacaagtacttggtttggtttacggcgggtaacggacagggttcgaccggtccgtaggtcgaacgcccgtaagccgtccggcccccttcgggtactacccgtnttccccgg

SEQ ID NO: 236155 - DNA, 533 bp, Homo sapiens
  misc_feature: GYAE6OF02ITXQ6.14.3.A03.1.454.CMB.1.raw
  modified_base (320)..(320): a, c, t, g, unknown or other
  misc_feature (320)..(320): n is a, c, g, or t
  modified_base (426)..(426): a, c, t, g, unknown or other
  misc_feature (426)..(426): n is a, c, g, or t
  modified_base (439)..(439): a, c, t, g, unknown or other
  misc_feature (439)..(439): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagccacccaggcaaacgccccccaaatcattatttatgaggtcaataatccggcctnaggtagtttctaatcgcttctctggctccaagtctggacaacacggcctccctgacgcatctctggctcgagtctggaggacgaggctagattattactgcagctnatatactataganagacttgttggtttcggcggtacgggaccgtaggtcgaccggtcgtacggtcacgcccgaaggtcctccggccccgtcggtcctactcgtcccg

SEQ ID NO: 236156 - DNA, 589 bp, Homo sapiens
  misc_feature: GYAE6OF02GLHZQ.14.3.A03.1.454.CMB.1.raw
  modified_base (256)..(256): a, c, t, g, unknown or other
  misc_feature (256)..(256): n is a, c, g, or t
  modified_base (258)..(258): a, c, t, g, unknown or other
  misc_feature (258)..(258): n is a, c, g, or t
  modified_base (310)..(310): a, c, t, g, unknown or other
  misc_feature (310)..(310): n is a, c, g, or t
  modified_base (441)..(441): a, c, t, g, unknown or other
  misc_feature (441)..(441): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctcgtgtctgggtctctggacagtcgatcaccatctcctgcactggaaccagtagtgacgttggttattatattttgtctctgtacanancaccagcaaacgccccaaactcattattatgaggtacaataactcggccctnaggtagtttctaatcgtcttctctcggctaccaacgtctcggacaacgaccgtccctccctagacgctactctcgtcgggctccgaggtctaggacggacggaggctagtatttaacttactgctacgctnattatactagttagacaagtaacgttggttacggttttcgggacgggtaacggaccgtaaggtccgtaccggttaccgtaggtaccaacggaccccgtaagggtccctccgggttacccccgtggttccctaccgttccgttccccgg

SEQ ID NO: 236157 - DNA, 553 bp, Homo sapiens
  misc_feature: GYAE6OF02FWRH0.14.3.A03.1.454.CMB.1.raw
  modified_base (300)..(300): a, c, t, g, unknown or other
  misc_feature (300)..(300): n is a, c, g, or t
  modified_base (323)..(323): a, c, t, g, unknown or other
  misc_feature (323)..(323): n is a, c, g, or t
  modified_base (433)..(433): a, c, t, g, unknown or other
  misc_feature (433)..(433): n is a, c, g, or t
  modified_base (442)..(442): a, c, t, g, unknown or other
  misc_feature (442)..(442): n is a, c, g, or t
  modified_base (478)..(478): a, c, t, g, unknown or other
  misc_feature (478)..(478): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgtttggttattattattttgtctcctggtaccaacagcacccaggacaaacgcccccaaatcattatttangaggtacaataatccggaccctnaggtatttactaatccgtcttctctggctcaagtctgcaacgacggcctccctgacgcactcctcgtcgggcctccgaggctggacggacgaggctgtatttacttacgngacagctanatactatattagacaagtacgttgttggtttacggngggacggaccgtaggtcgaccgttcgtaggtacacgtaccgagtcgtccgtccccgtgtacctaccgtctacccg

SEQ ID NO: 236158 - DNA, 676 bp, Homo sapiens
  misc_feature: GYAE6OF02GZLC7.14.3.A03.1.454.CMB.1.raw
  modified_base (205)..(205): a, c, t, g, unknown or other
  misc_feature (205)..(205): n is a, c, g, or t
  modified_base (383)..(383): a, c, t, g, unknown or other
  misc_feature (383)..(383): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccgtntcctgtcactacggaaccgacgtaggtagtacgttaggttatttaattaattttagttcctccttacggtaccgaaacaacgtacaccccacggacgaaaccaaccccctaaacctactacttaatttatagaggtacaataactcggtcctcaggtagttctaatacgtcttcttcncggtctccgaactcgtcggtacaaccaacggtcccgtacctcgacgacgtacttcctcgtcggggcctccgacgggtacgtggacgggaacggtagggctaggtaatttaattacgttacgcagactctaagtacttactaattaccgagacgtaacgtttgttcgggttttacgggacgggtaaacggaccgtaagggttcgtaacccggttcggtaacggtacgacggtacccgtaacggtccgtacccgtccccggttccggtacttacccgtaccgttccgtacccccg

SEQ ID NO: 236159 - DNA, 615 bp, Homo sapiens
  misc_feature: GYAE6OF02GXZJU.14.3.A03.1.454.CMB.1.raw
  modified_base (264)..(264): a, c, t, g, unknown or other
  misc_feature (264)..(264): n is a, c, g, or t
tcagcgtctagtaccacgaccggtgctcgatttagagagcgtcacgaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattattaattttgtctcctgtaccaanagcaccagacaaacgcccccaaactcattattatgagtacaataagtccggcctgaggtatttactaatcgtcttctctcggtctaccaagtcgtggaccaacgaccggtccctccgtagacgctatctcgtcggcctccgaggtcgtaggaggacgaggctagtatttagttacgtgacagtctatatacttaattagtagactaagttaacttggtttgggtttccggaacggggtacgggaaccgtagggtccggtaccggtaccggtaacggttaccgaccggtaacccggtaacggccgtaccccggtccccggttaccggtccctacccgttccggttacccccg

SEQ ID NO: 236160 - DNA, 646 bp, Homo sapiens
  misc_feature: GYAE6OF02I5XO6.14.3.A03.1.454.CMB.1.raw
  modified_base (290)..(290): a, c, t, g, unknown or other
  misc_feature (290)..(290): n is a, c, g, or t
tcagcgtctagtaccacgaccggtgctcgatttagagagcgtcacagggggggtctcaggaggcagcgctctcaggacatctccaccatggcctgggctctgctgctcctcaccctcctcactcaggcacagggtcctgggcccagtctgccctgactcagcctgcctccgtgtctgggtctcctggacagtcgatcaccatctcctgcactggaaccagtacgtgacgttggtattataatttgtctctgtacaacagcaccagacaaagccccaaatcaattacttanagtaggtcaaataatccggccctagaggtagtttataagtcgcttactctggactaccgtaagtctggaccaacgacggccctccctagacgtaccagtcgtacgtcgggccttaccgaaggtcctaggaacggtaccggaacgggtcgtagtaacgtttagttaaccgtcgtcgtaaacgtctacctagtaacttaactaagtttacgaactaaggtaacttcggttgggtttacccggagggtaacgggtaccctaagggtccgtaaccggttccacgggttaacaacggtaccccgtaaggcccttacccggtacccccgttaccgggtaccctaccgtaccgtttaccccgg

SEQ ID NO: 236161 - DNA, 566 bp, Homo sapiens
  misc_feature: GYAE6OF02GAG1U.14.3.A03.1.454.CMB.1.raw
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
  modified_base (371)..(371): a, c, t, g, unknown or other
  misc_feature (371)..(371): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaacgcccccaaatcattattatgaggtcaataatcggccctcaggtagtttctaatcgcttctctggctccaagtcngacaacncgcctcctgacncatctcgtggctccgaggctggacggacgaggtctagtaatttacttactcgctacgctactattacttaacttattagactaagtacgttggttcggtttcgggacgggtacgggaccgtagggtcgaccggttcgtaggtaccacggaccgaaggcctccggacccccgttcggtcctaccgttgttccccgg

SEQ ID NO: 236162 - DNA, 657 bp, Homo sapiens
  misc_feature: GYAE6OF02HAPE1.14.3.A03.1.454.CMB.1.raw
  modified_base (264)..(264): a, c, t, g, unknown or other
  misc_feature (264)..(264): n is a, c, g, or t
  modified_base (299)..(299): a, c, t, g, unknown or other
  misc_feature (299)..(299): n is a, c, g, or t
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
  modified_base (338)..(338): a, c, t, g, unknown or other
  misc_feature (338)..(338): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcgtggacaggtcgatcaccatctcctgcactggaaccagtagtgacgtttggttattataattttgtctctggtaccaanagcaccaggcaaacgccccctaaatcattattacnggagtacaatancggcctnaggtatttcaatcgctttcnctaggctacaagtctgacaacgacggtcctccgtgacgcacttcgcgtcgggctaccgagggctagggaacgggacgacgggaccttaggtaacttttaacttaaccgtggtacaacggttcctacgtaattaacgttaaccttaatttaacggccgtaaaagtaacgtttcgggtttaggggttttccggaccgggggtaacgggtaacccgtagggttaccgggaaccccggttacggttaacggtacgtaaccgggtacccgtaaggggtcccttaccggtcccccggtacggtaccgtaccttcccggttacccg

SEQ ID NO: 236163 - DNA, 549 bp, Homo sapiens
  misc_feature: GYAE6OF02FXAWJ.14.3.A03.1.454.CMB.1.raw
  modified_base (295)..(295): a, c, t, g, unknown or other
  misc_feature (295)..(295): n is a, c, g, or t
  modified_base (313)..(313): a, c, t, g, unknown or other
  misc_feature (313)..(313): n is a, c, g, or t
  modified_base (367)..(367): a, c, t, g, unknown or other
  misc_feature (367)..(367): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctgtaccaacagcaccaggcaaacgcccccaaatcattattangagtcaataatcggcctnaggtagtttcaatcgcttctctggctccaagtctggcaacgcggcctcctgacnctatctcgtgggctccgaggctggaggacgagtctgattattactgcagctacattatactattacgactaagtaacgttggttggtttcggcggtaagggaccgtagggtcgtaccggtcgtaacggtccgaacgtacccgaaggtcctccgtacccccgtggtccctacctcgttacccg

SEQ ID NO: 236164 - DNA, 543 bp, Homo sapiens
  misc_feature: GYAE6OF02IS9KU.14.3.A03.1.454.CMB.1.raw
  modified_base (260)..(260): a, c, t, g, unknown or other
  misc_feature (260)..(260): n is a, c, g, or t
  modified_base (310)..(310): a, c, t, g, unknown or other
  misc_feature (310)..(310): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataatttgtctctggtaccanagcaccagcaagccccaaactcattattatgaggtcaataatcggccctnaggtagtttctaatcgcttctctgctcaagtctgacaacacggtcctccctgacgcactctcgtcgggctcgaggctggaggacgaggctagattattacgtgcagctacatatactagttagctaagtacttggttggtttcggacggacggtacagggttcgacccggtcgttaacggtcaacggacccgtaaggctaccggtcccccgtacggtcctacctcgttcccgg

SEQ ID NO: 236165 - DNA, 506 bp, Homo sapiens
  misc_feature: GYAE6OF02H2A8T.14.3.A03.1.454.CMB.1.raw
  modified_base (297)..(297): a, c, t, g, unknown or other
  misc_feature (297)..(297): n is a, c, g, or t
  modified_base (314)..(314): a, c, t, g, unknown or other
  misc_feature (314)..(314): n is a, c, g, or t
  modified_base (334)..(334): a, c, t, g, unknown or other
  misc_feature (334)..(334): n is a, c, g, or t
  modified_base (420)..(420): a, c, t, g, unknown or other
  misc_feature (420)..(420): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgtttggttattataattttgtctcctggtaccaacagcaccaggcaaagcccccaaatcattatttangagtcaatatcggcctnaggtatttctaatcgcttcnctgctcaagtctggcaacacgcctcctgacgcatctcgtgggcctccgaggctggaggacgaggctgtatttattactgcagctanatatcgcaccgtggcagcaatctatgttggtttcgggcgggacaaggtcgacgtcgtagtcacggccaggcctccgcccgtgtacc

SEQ ID NO: 236166 - DNA, 521 bp, Homo sapiens
  misc_feature: GYAE6OF02FGK7V.14.3.A03.1.454.CMB.1.raw
  modified_base (263)..(263): a, c, t, g, unknown or other
  misc_feature (263)..(263): n is a, c, g, or t
  modified_base (296)..(296): a, c, t, g, unknown or other
  misc_feature (296)..(296): n is a, c, g, or t
  modified_base (313)..(313): a, c, t, g, unknown or other
  misc_feature (313)..(313): n is a, c, g, or t
  modified_base (375)..(375): a, c, t, g, unknown or other
  misc_feature (375)..(375): n is a, c, g, or t
  modified_base (420)..(420): a, c, t, g, unknown or other
  misc_feature (420)..(420): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctacctccgtgtctgggtctcctggacagtcgatcaccatcctcctgcactggaaccagtagtgacgttggttattataattttgctcctggtaccaanagcaccaggcaaacgcccccaaatcattattangagtcaatatcggcctnaggtatttctaatcgcttctctgctccaagtctggacaacacggtcctccgtgacgcattcncgtcgggctccgaggtctaggacggacgaggctagacttattacngctagcctatatatacttatagacagtaactgtttgggtttcgacgggtaggactaggtcaccgtcgtaggcacgccgagctcgccctgtcactctctccc

SEQ ID NO: 236167 - DNA, 523 bp, Homo sapiens
  misc_feature: GYAE6OF02GU8AM.14.3.A03.1.454.CMB.1.raw
  modified_base (221)..(221): a, c, t, g, unknown or other
  misc_feature (221)..(221): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngtagtgacgtttggttattataattttgtctcctgtaccaacagcaccaggcaaagcccccaaatcattattangaggtcaataatcggccctnaggatttctaatcgcttctctggctccaagtctgcaacacggcctcctgagcatctctgggctccgaggctggaggacgaggctagattattactgcagctacattattactattagctaagtacttgttacgttcggcggagggaccaggtcgaccgtcgtaaggtcagacccaggtctcggcccccgtggtccaccgtcttcccgg

SEQ ID NO: 236168 - DNA, 592 bp, Homo sapiens
  misc_feature: GYAE6OF02H5SSJ.14.3.A03.1.454.CMB.1.raw
  modified_base (204)..(204): a, c, t, g, unknown or other
  misc_feature (204)..(204): n is a, c, g, or t
  modified_base (428)..(428): a, c, t, g, unknown or other
  misc_feature (428)..(428): n is a, c, g, or t
  modified_base (439)..(439): a, c, t, g, unknown or other
  misc_feature (439)..(439): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccntctcctgcactggaaccagcagtgacgttggtggttataagtatgtctcctggtaccaacaacacccaggcaacgccccaaactcatgatttatgaggtcagtaactccggtccctcgtaggggtttctaatcgtcttctctggcctacaagtctgcaacgccgtcctcctcgacctatcctcgtcggcctccgacggctggaggacgagttctgtatttattnttgctagtctnattatcgactaccgtgacacgactaactcgtaagttcgggtttgggtttaccggggaccgggggtaacgtaacgggtaccggtacccggttaccgttacgggtaccgacggtaccccggaacggttcccggtccgtcccccgtggttaccccg

SEQ ID NO: 236169 - DNA, 591 bp, Homo sapiens
  misc_feature: GYAE6OF02G5T6H.14.3.A03.1.454.CMB.1.raw
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataatttgtctctgtacaacagcaccagcaacgcccccaaactcattattatgaggtacaataactcggccctcgaggtagtttactaatcgtcttctctgctacctaagtctggacaacgaccgtcctcctgagctatctcgtcgggctccgacggcgtcggacggacgaggtctagtattacttacgtgcagctactatattaactattacgacgtaagtacttggttcgggttttacggacgggtacgggtaaccgtaggtacggtaccggttccggtaacggtaccgtaccgacccgtaaggtccgtaccggtcccccgttacggtccctaccgttccgttaccccgg

SEQ ID NO: 236170 - DNA, 602 bp, Homo sapiens
  misc_feature: GYAE6OF02HDXCK.14.3.A03.1.454.CMB.1.raw
  modified_base (298)..(298): a, c, t, g, unknown or other
  misc_feature (298)..(298): n is a, c, g, or t
tcagcgtctagtaccacgaccggtgctcgatttagagagcgtcacagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgtacgttggttattattaattttgtctcctggtaccaacagcaccagcaaacgccccaaactcattattangagtcaatatcggccctcaggtagtttctaatcgtacttctctcggctccaagtctggacaacgaccggcctccctgacccattcctcgtcgggcctccgaggctggacggacgagtcctgtaattattagttcgctagctactatatcgaccaccgtcggcagacctaagtctagttgggtttcgggtttcggggaccggggggtaaccgtacgggtcccggtaaccggttaccgttacgggtaccgacggtaacccggaacgggtccgtccccggtacccccggttcggtaccttaccccgg

SEQ ID NO: 236171 - DNA, 673 bp, Homo sapiens
  misc_feature: GYAE6OF02HZ9WC.14.3.A03.1.454.CMB.1.raw
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
  modified_base (303)..(303): a, c, t, g, unknown or other
  misc_feature (303)..(303): n is a, c, g, or t
tcagcgtctagtaccacgaccggtgctcgattttagagagcgtcacagggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctctgcactggaaccagtagtgacgttgttattatatttgtctctgtacacngcaccagacaacnccccaaatcattattangagtnaatatcgcctnaggtatttctaatcgcttctcgtggcctaccgaagtctggacaaccgacggccctcctgacgtcctatcctcgtcggtcctccgaggctaggacggacgaggcttagtaatttacttacgtgactagtctacaaatttacttaaacttaagttaacgaccgtaacggtaaacgttcgggttttacggggttttaccggggaccggggtaaacggggtaacccgttaaggggttccgggtaacccgggtttacccggttaaacggggttacccgaacccgggtaacccccgtaagggggttacccccttacccggggtaccccccccgtttaccggggtaccccttacccggttcccgtttaaccccccgg

SEQ ID NO: 236172 - DNA, 611 bp, Homo sapiens
  misc_feature: GYAE6OF02FTGWM.14.3.A03.1.454.CMB.1.raw
  modified_base (360)..(360): a, c, t, g, unknown or other
  misc_feature (360)..(360): n is a, c, g, or t
  modified_base (392)..(392): a, c, t, g, unknown or other
  misc_feature (392)..(392): n is a, c, g, or t
tcagcgtctagtaccacgaccggtgctcgatttagagagcgtcacagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcacatctcctgcactggaaccagtagtgacgtttggttaattattaattttgtctcctggtaccaacagcacccaggcaaacgcccccaaatcattattatgaggtacaataatcggcctcaggtagtttctaatcgcttctctggctcagtctggcaacncgcctcctgagcatctcgtggctccgaggtcngacggacgaggctgaactttattacgtgtacgagtctcaattacttaactaacgtttacgactaaaggtaaccgtttggggtttacgggttttccgggaacgggtaagggtacccgtaaggggttccgtaacccggttcggtaacgggtaccaccggaccccggtaagggtcccttccggtccccccgttcgggtacctacccggttccgttaccccgg

SEQ ID NO: 236173 - DNA, 593 bp, Homo sapiens
  misc_feature: GYAE6OF02HIPU4.14.3.A03.1.454.CMB.1.raw
  modified_base (297)..(297): a, c, t, g, unknown or other
  misc_feature (297)..(297): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattattaattttgtctctgtaccaacagcaccaggacaaacgcccccaaatctattattangagtacaataactccggccctgaggtatttactaactcgtcttctcgtggcctacgaagttcctggacacgacgccctcctgactctatcgtcgtcgggcctcgaggtctggacggacgaggtcgtagtattactactgctacgctactattactaattacgttagactaagtacgtttaggttcgggtttacggacggggtacggtaccgtagggtcgtacccggtacggtacgacgtaaccggtacccgaaggtcccgtaccggtccccgtacggtacctccgtccgttccccg

SEQ ID NO: 236174 - DNA, 571 bp, Homo sapiens
  misc_feature: GYAE6OF02F4UVW.14.3.A03.1.454.CMB.1.raw
  modified_base (320)..(320): a, c, t, g, unknown or other
  misc_feature (320)..(320): n is a, c, g, or t
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgtttggttattattaattttgtctcctggtaccaacagcacccaggcaaacgccccccaaactcatttattatgagtcaataatccgcctnaggtagtttcaatcgtcttctctggctcctaagtctggacaacgacggccctcctgacgctatcgtcgtggctccgagcgtgaggacgaggctagatttacgttacngacngtctcattatactattgactagtaacgttgtttacggtttcggacgggtacggacgagggtcgtaccggttcctacggtcgaccggaccgtaacgggccgttacccggtcccccgttacggtcctaccctccgttacccg

SEQ ID NO: 236175 - DNA, 693 bp, Homo sapiens
  misc_feature: GYAE6OF02HP7IH.14.3.A03.1.454.CMB.1.raw
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgccactggaaccagcagtgacgttggtgttaataagtatgtctctggtaccaacacaccagcaaacgcccccaaaatcatgtatttacgtggaggtcagtaactccgggtccctcgtaacggggtttctaattccggtactttcgtctcgggtcctacctaaggttcctacgggtactaaaccgaccgggtccccttaccccgtacgacccgtaacttccgttcgtacggggccctttaccgaagggtccgtaacgggaacggtaccggtaaggttcctaaggttaacgtttaacttacgttttacggaccgttacggtacctataacgttactacgtaccgtaccgtggacctaacgacgtaacttcgagtttacgggttacgggttttaccggggacggggtaaccgtaaggttcccgggtaaccggtccgttaacggccacgggaccctaaggtccgtacccggtccccgtggttacccg

SEQ ID NO: 236176 - DNA, 930 bp, Homo sapiens
  misc_feature: GYAE6OF02GWHCZ.14.3.A03.1.454.CMB.1.raw
  modified_base (104)..(104): a, c, t, g, unknown or other
  misc_feature (104)..(104): n is a, c, g, or t
tcagcgtctagtaccacgaccggtgctcgatttagagagcgtcacaggggggggtctcaggaggcagcgctctcaggacatctccaccatggcctgggctccgngtgctcctcctaccctccctcctactaccagggacgacaacgggtccggtccggtcccggacgtcgttcgtcccgtccgtacgtacctacgaccgtccgtcccgtcccgttccggttcgttcgggttccggtccttcggtacgacgtcgtacgtaccaccactcttcctcgcgaccgtcggaaccgtaacgtaggtggtacggttacggtttaagttaattaagttttcgtttctaccgttacggtaaccgtaaaccaaggcctaaccccgaacggacgaaaaccgaacccccccgtaaaacctacttaatttaaactttttagtaacggtagggtaaccttaaaaacttaaacgttccgggcccccgttacaaaggggtttaaccggttttaccttaaaacgtccggtcctttacgttccgtacgggtacctttacccaaagggtttcctagggtaacccgaaaacgtaacccggggttccctcccccttagggtaaacgccgttaaccgttaccttccgggttaacggtacccggttccgtaaccgggtccgtaacgggtacgggtaaccggacgggtacgtaaggtaacgtttaacgttacgttacgcggttaactccgttaacgtacttaaattacgttaacgttaacggttactaacgtaacgtttaacggttcggggtttttaaccggggacgggtaacggggtaaccggttaagggtaccggttaaccggtaccggttcggttaacggacgtacccgaacggttaccgcccgttacccggtcccggttaccgtacccgttccgttacccggttccccgg

SEQ ID NO: 236177 - DNA, 616 bp, Homo sapiens
  misc_feature: GYAE6OF02I3SIH.14.3.A03.1.454.CMB.1.raw
  modified_base (223)..(223): a, c, t, g, unknown or other
  misc_feature (223)..(223): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacgagggtcctgggcccagtctgccctgactcagcctgcctccgtgtctgggtctccgtggacagtcgatcaccatctcctgcactggaaccngcagtgtacgttggtggttataagtatgtctctggtaccaacacaccgagcaaacgccccaaactcatgtatttagtgaggtcaagtaacgtccggccctcgtagggtttctaatcgtcttctcgtcggcctaccgtaacgtccgtacggacaaccgtaccggtccctacccgtcgaccctatccgtcgtcgggacctccgaggtcgtggacggacgtacgttctagtattattagtcgactacgtcgtacagttactcgacctaccgtcggactacgtactaacgtacgtagttggtttcgggttcggggaccggggtacctagggttaccggtaccgtcgtacggtccgtacggtacccgtaacggtccgacccggttccccgtggtaccc

SEQ ID NO: 236178 - DNA, 613 bp, Homo sapiens
  misc_feature: GYAE6OF02I5V92.14.3.A03.1.454.CMB.1.raw
  modified_base (205)..(205): a, c, t, g, unknown or other
  misc_feature (205)..(205): n is a, c, g, or t
  modified_base (416)..(416): a, c, t, g, unknown or other
  misc_feature (416)..(416): n is a, c, g, or t
  modified_base (470)..(470): a, c, t, g, unknown or other
  misc_feature (470)..(470): n is a, c, g, or t
tcagcgtctagtaccacgaccggtgctcgatttagagagcgtcacaggggggggtctcaggaggcagcgctctcaggacatctccaccatggcctgggctctgctgctcctcaccctctcactcagggcacgagggtcctgggcccagtctgccctgactcagcctgcctcgtgtctgggtctctggacagtcgatcacatctcngctacgtggaacctagtagtgacgtttggttaattagtaattttcgtctcctggtacctaacagcctaccaggacaaacgacccccaaactctaattactttatgtaggtacaaagtaacgtccggacctacgtaggtactttactaactcggtcttcgtcgtcgctactaagtctacggacaacgacggtcctccgtgagctactctcgnggctccgagtccgtagtacggagtacgctagtattacttatcgtactagtactntattatacgtatacgactaagtaacgttggtttacgggtttcggacggtacggacgtaggttccggaaccgttcggtaacgtccgaagtacccgacggttccgtccggaccccgttcggtaaccgtaccttcgttaaccccgg

SEQ ID NO: 236179 - DNA, 577 bp, Homo sapiens
  misc_feature: GYAE6OF02FZ70B.14.3.A03.1.454.CMB.1.raw
  modified_base (320)..(320): a, c, t, g, unknown or other
  misc_feature (320)..(320): n is a, c, g, or t
  modified_base (366)..(366): a, c, t, g, unknown or other
  misc_feature (366)..(366): n is a, c, g, or t
  modified_base (409)..(409): a, c, t, g, unknown or other
  misc_feature (409)..(409): n is a, c, g, or t
  modified_base (416)..(416): a, c, t, g, unknown or other
  misc_feature (416)..(416): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaacgcccccaaactcaatttattatgaggtcaataatcggccctnaggatttctaatcgcttctctgctccaagtctgcaacacgcctccngagcatctcgtggctcgagctgaggacgaggctgattattacngcagctnatagtactattagactagaacgttgttcggttttcggacgggtagggtaaccgtaagggtcggtaacccgttcggttaacggtaccgtaacggaccccgaaacgggtcccgttcccggtaccccccggttcggtaccccgtaccgtttaccttacccccgg

SEQ ID NO: 236180 - DNA, 631 bp, Homo sapiens
  misc_feature: GYAE6OF02JTZ1U.14.3.A03.1.454.CMB.1.raw
  modified_base (220)..(220): a, c, t, g, unknown or other
  misc_feature (220)..(220): n is a, c, g, or t
  modified_base (313)..(313): a, c, t, g, unknown or other
  misc_feature (313)..(313): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccngtagtgacgtttggttattataatttgtctctggtacaacagcaccagacaaacgccccaaactcattattatgagtacaataactcggcctnaggtagttactaatcgcttctctggctaccaagtcgtcggacaacgacgtcctccctgacgcacttcgtacgtcggactccgaaggtcgtaggacggtaacgagggtccgtaggttaatttacgttacgtacgttacaacgcttacaaattacttaacttaagttacgactaacgttaacgttagtttcgggttttaccggacgggtacggaaccgtagggttaccgtaacccggttcgttaacggtacgaacccggtacccgtaacggtacccggtccgtaccccccgttgggtacccttaccgttccggttacccc

SEQ ID NO: 236181 - DNA, 632 bp, Homo sapiens
  misc_feature: GYAE6OF02GEKY2.14.3.A03.1.454.CMB.1.raw
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattattaattttgtctctgtaccaacagccaccaggacaaacgcccccaaactcattattatgagtacaatatcggcctcgagtagtttctaatcgtcttctctcggctacaagtctggacaacgacggccctcctacgacctactccgtcgtcgggtcctaccgacggtcgtaggacggtacgtagtcgtagtatttattagttcgactagtctacatactacgaccgtaccgtgacaggtactaacgttacctagttcgggtttacggggttttacgggggaccgggggtaaccgtaacggggttccggtacccggttacggtaaccggttaccgtaaccggtacccggaacggtcccgtaccccggtacccccggttacggtaccctacccgg

SEQ ID NO: 236182 - DNA, 661 bp, Homo sapiens
  misc_feature: GYAE6OF02GCMBT.14.3.A03.1.454.CMB.1.raw
tcagcgtctagtaccacgaccggtgctcgatttagagagcgtcacagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattattaattttgtctcctggtaccaacagccacccaggacaaacgccccccaaactctattatttatgagtcaatatcggcctgaggtatttactaatcgcttctctggctccaagtctcggacaacgaccggcctcccgtgacgctactctccgtcggtcctacgaggtctggaacgggaccggagggtcctaggaacttttacgttaacgtggaccagtacctactaagttaacttaaccttaattacggtacgtaaagtaaccgtttgggtttacgggtttttacggggaccgggtaacggggtaaccgtaagggtaccggtaacccggtttccgtaacgggttacccgaaccggtacccggtaaccggtccgttacccggtccccccgttaccggtccctaccttcccggtttaccccg

SEQ ID NO: 236183 - DNA, 500 bp, Homo sapiens
  misc_feature: GYAE6OF02FXOXN.14.3.A03.1.454.CMB.1.raw
  modified_base (316)..(316): a, c, t, g, unknown or other
  misc_feature (316)..(316): n is a, c, g, or t
  modified_base (442)..(442): a, c, t, g, unknown or other
  misc_feature (442)..(442): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattattatgaggtcaataatcggcctnagagttctatacgcttctctgctcagtactgcaacacgcctcctcgagcatctctggctccagctgaggacgaggcgtgattattactgcagctcatatactattagtcagaactgtggtttcggnggacgggacaggtgaccggtctaggtcacgccaaggctcgcccctcggtcacgtctcg

SEQ ID NO: 236184 - DNA, 517 bp, Homo sapiens
  misc_feature: GYAE6OF02I30U1.14.3.A03.1.454.CMB.1.raw
  modified_base (192)..(192): a, c, t, g, unknown or other
  misc_feature (192)..(192): n is a, c, g, or t
  modified_base (265)..(265): a, c, t, g, unknown or other
  misc_feature (265)..(265): n is a, c, g, or t
  modified_base (356)..(356): a, c, t, g, unknown or other
  misc_feature (356)..(356): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacngtcgatcaccatctcctgcactggaaccagtagtgacgtttggttattataattttgtcttcctggtacaacngcaccaggcaaagcccccaaatcattatttatgagtcaataatcggcctcaggtatttctaatcgtcttctctggctcaagtctggcaacncggcctcctgacgcatctacgtggctcaggctgaggacgaggctgtattatacgtgcagctacatatactatacgcagattgtggtttcggcgagggtacgtagcgtacgtcgtacggtcacgaccgaagccgtcgtccccgtcggtcctactcgttcccg

SEQ ID NO: 236185 - DNA, 620 bp, Homo sapiens
  misc_feature: GYAE6OF02HNNN7.14.3.A03.1.454.CMB.1.raw
  modified_base (262)..(262): a, c, t, g, unknown or other
  misc_feature (262)..(262): n is a, c, g, or t
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
  modified_base (366)..(366): a, c, t, g, unknown or other
  misc_feature (366)..(366): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcacatctctgcactggaaccagtagtgacgtttggttattattaattttgtctctggtaccaacngcaccaggcaaacgcccccaaactcatttattatgaggtcaataatccggcctcgaggtacgtttctaatcgtcttctctgctcaagtcngcaacncgcctccngacgcatctcgtcgggcctcgacggctacggacgggacgtaggtctggtacttacgttacgtcggcagtccgtactaattacttattaacgttacgacgtaacgtaacgtttcggtttacggggttttaccgggaacgggtacgggaaccggttaagggtaccggtacccggttaccgttacggtaccgtaaccggacccgtaacggtcccgtaccggccccccgttcggtacctaccgttacccgttccccgg

SEQ ID NO: 236186 - DNA, 673 bp, Homo sapiens
  misc_feature: GYAE6OF02JK7QI.14.3.A03.1.454.CMB.1.raw
  modified_base (488)..(488): a, c, t, g, unknown or other
  misc_feature (488)..(488): n is a, c, g, or t
  modified_base (506)..(506): a, c, t, g, unknown or other
  misc_feature (506)..(506): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcgagggcacgagggtccctgggcccagtctcgccctgactcagcctgccctccgtgtcgtgggtctccgtggactagtcgatcacctatcctcctgaccacgtacggaacctagtagtggtacgtttggttaattattattttcgtcctccgtaggtaccaacagccaacccgtaggaccaaaccgaccccctaaatctatttattacgtggtacgtacaaagttaaccgtccggaccctagtaagggtacttttactaacgtccgtacttcgtcgtcggtacctactacggtcgtcgaactaacgtccgtccctccgtagacgtctacttcgtcggtcggtcctacgaggtctaggaggacgngtctagtattaacgttcngtactagtctacgaattactacttagtacgactaagtacgtttcggttagggttccgggaacggtaacgggacctagggttccgtaccgttcggtaaggaccgtaaccgtaccgtacggtccgttaaccccgggccccttagggtaccgtaccttccgttaccccgg

SEQ ID NO: 236187 - DNA, 674 bp, Homo sapiens
  misc_feature: GYAE6OF02I5G0A.14.3.A03.1.454.CMB.1.raw
  modified_base (255)..(255): a, c, t, g, unknown or other
  misc_feature (255)..(255): n is a, c, g, or t
  modified_base (285)..(285): a, c, t, g, unknown or other
  misc_feature (285)..(285): n is a, c, g, or t
  modified_base (302)..(302): a, c, t, g, unknown or other
  misc_feature (302)..(302): n is a, c, g, or t
tcagcgtctagtaccacgaccggtgctcgatttagagagcgtcacagggggggtctcaggaggcagcgctctcaggacatctccaccatggcctgggctctgctgctcctcaccctctcactcaggcacagggtcctgggcccagtctgcctgactcagcctgcctcgtgtctgggtctctggacagtcatcaccatctcctgcactggaaccagtagtgacgttggttattataattttgctctggtaccaacngcaccaggcaaagcccccaatcattattangagtcaatatcggcctnaggtagttcaatcgcttactctggctccaaagtctaggacaaacgccggacctcccgtgtaacgcaactctctcgggaccttcgaaggtctggaacggtaccgagggtactggtaactttaagttacgtggaccaggaccttacgtaattaataccgtttaaagttacgaccaaaggttaacccttaggggttttacggggtttttaccgggaacgggttaacggggtaaccccgtaagggttacccggtaaccccggttaccggtttaacgggttaaccgaacccggttaaccccgaaaggggttcccttaccccgggtaacccccccgtttccggggtaacccctaccggtttccccgtttaacccccgg

SEQ ID NO: 236188 - DNA, 643 bp, Homo sapiens
  misc_feature: GYAE6OF02F9U0F.14.3.A03.1.454.CMB.1.raw
tcagcgtctagtaccacgaccggtgctcgatttagagagcgtcacagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcacgtggaaccagtagtgacgtttggttaattattaattttgtctcctggtaccaacacgcacccaggcaaacgcccccaaactcattatttatgaggtcaataatcggccctcaggtatttctaatcgcttctctggcctcaagtctggcaacgacgcctcctgcgacatctcgtcggcctccgaggtcgtaggaggacggacgggcttaggtaactttacgttaacgtggaccgtagtccttacgtaacttaacttaacttaagttacgacctaaacggtaacgtttggtttacgggttttaccgggacgggtaacggggtaacccgtaagggttccggtaaccggttccggtacgggttaccgaaccggtacccgaacggtccggtcccggtacccccggttcggtaccctaccgttccgttaccccgg

SEQ ID NO: 236189 - DNA, 609 bp, Homo sapiens
  misc_feature: GYAE6OF02JH7J8.14.3.A03.1.454.CMB.1.raw
  modified_base (174)..(174): a, c, t, g, unknown or other
  misc_feature (174)..(174): n is a, c, g, or t
  modified_base (232)..(232): a, c, t, g, unknown or other
  misc_feature (232)..(232): n is a, c, g, or t
  modified_base (302)..(302): a, c, t, g, unknown or other
  misc_feature (302)..(302): n is a, c, g, or t
  modified_base (331)..(331): a, c, t, g, unknown or other
  misc_feature (331)..(331): n is a, c, g, or t
tcagcgtctagtaccacgaccggtgctcgatttagagagcgtcacagggggggtcgtcaggaggcagcgctctcaggacatctccaccatggcctgggctctgctgctcctcaccctcctcactcagggcacagggtcctgggcccagtctgccctgactcagcctgcctcgtntcgtgggtctccgtggacagttcgatccacctatcctctgcacttcggaaccagttgngacgtttggttaattataattttgtctcttgtaaccactagcaccagcaaacgccccaaatcattattangtagtcaatatcgacctgaagtagtttanaactcgtattcgtctcggtctccgtaatccgtggactaacgaccgtacccgtcctagactaccgattccgtcgtcgggtccttaccgacggtcctaggacgggacacggccgtagtacttattactcgtacacgtctacaattacacgttaacttagactaagtacgttgtttcgggtttacggacggtaggtaccgaggtcgtaccggttacgtacggtacacgtaccccgtaagggtccctaccggtccccgttcggtaccttacgtacctcccgg

SEQ ID NO: 236190 - DNA, 637 bp, Homo sapiens
  misc_feature: GYAE6OF02FRW6W.14.3.A03.1.454.CMB.1.raw
  modified_base (298)..(298): a, c, t, g, unknown or other
  misc_feature (298)..(298): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcacgtggaaccagtagtgacgttggttattatattttgtctctgtaccaacacacccaggacaaacgcccccaaactcatctatttanagatctactaacgcgcctcgagggtatctaatcgtcttctctggtctaccaagtctggaccaacgcgccctcccgtcgacctcctcgtcggcctccgagacgtggaacgggacggtaggcgttagtaatttacttacgtccgtacctacttacaattaagtaacggtaaagttacgttaaccttacttccgttagggttttcgggtttccggggacggtaacgggtaccgtaacgtccgtacgtacccgttccgtacgggtccgaacgtacccgtaacggccgttcccgtcccccggttcgttacccgtaccggttcccttcccgttcccctacccccg

SEQ ID NO: 236191 - DNA, 677 bp, Homo sapiens
  misc_feature: GYAE6OF02GZAAH.14.3.A03.1.454.CMB.1.raw
  modified_base (258)..(258): a, c, t, g, unknown or other
  misc_feature (258)..(258): n is a, c, g, or t
  modified_base (293)..(293): a, c, t, g, unknown or other
  misc_feature (293)..(293): n is a, c, g, or t
  modified_base (365)..(365): a, c, t, g, unknown or other
  misc_feature (365)..(365): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctcgccctgactcagcctgcctcgtgtctgggtctctggacagtcgatcaccatctcctgcacgtgaaccagtagtgacgttgttattattatttgtctctgtaccaanagcaccaggacaaacgcccccaactctattattanagagtcagtatccgcctcgtagggttctaagtctcttctcgtgctcagtctagactagacgcctccgtgacncactctcgtcggactccgaggtcgtaaggacgagtctagtactttagttacagtacacgtactacgttaactaactacgtttaactaacgtaacgtaacggttaccggttggttttaccggggtttacgggtaacggggtaaaccgggtaacccgggttaacgggtacccgggttacccggttacggtttaaccgggtacccggaaccggtaacccggtaaccgggtacccgttcccccggtaccccgggttacccgttacccgtacccggttttccccggtttacccccggtccccgttttaaccccccgg

SEQ ID NO: 236192 - DNA, 621 bp, Homo sapiens
  misc_feature: GYAE6OF02JYNLZ.14.3.A03.1.454.CMB.1.raw
  modified_base (317)..(317): a, c, t, g, unknown or other
  misc_feature (317)..(317): n is a, c, g, or t
  modified_base (337)..(337): a, c, t, g, unknown or other
  misc_feature (337)..(337): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccagtagtgacgttggttaattataattttgtctcctggtaccaacagcacccagacaaagcccccaaatcattattatgagtacaataagtcgccctanagtagttctaatcgtcttcncgtgcctacaagttccaggaccaactaccggcccttcccgtagacgctatcgtcgtcggctccagggcctaggacggacgtagtctagtaattattacgttagactcgtactacagtaattcgactaccgtggtaccaacgactaatcctaagttcggttacgggttttaccgggacggggggttaaacccgaaggtttaccggaacccggttaacccgtagggtacccgttaccgggacccggtaaacggtcccgtacccggttacccccctcggttaccccg

SEQ ID NO: 236193 - DNA, 584 bp, Homo sapiens
  misc_feature: GYAE6OF02FU2X2.14.3.A03.1.454.CMB.1.raw
  modified_base (367)..(367): a, c, t, g, unknown or other
  misc_feature (367)..(367): n is a, c, g, or t
  modified_base (428)..(428): a, c, t, g, unknown or other
  misc_feature (428)..(428): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttgtattatattttgtctctgtacaacagcaccagacaaacgccccaatcattattatgaggtacaataatcggccctagaggtatttactaatcgtacttctctggcctcaagtctaggacaacgacggcctccgngacgctactctcgtgggcctaccgaggcgtaggacggacgaggtctagtatttagttacgngtcagctacatacgtacttagtacgctaagtaacgttgggttacggtttaccgggaggtaacgggacctaagggtccgtaacccggttcgtaacggtccaacggacccgtaaggtcccgtcccgtcccccgttggtaccctaccgtcgttaccccg

SEQ ID NO: 236194 - DNA, 731 bp, Homo sapiens
  misc_feature: GYAE6OF02G69XT.14.3.A03.1.454.CMB.1.raw
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgccacgtggaaaccagttagtgtacgtttggttaattataattttcgtcttcctaggtaccaacagccaccgaggaccaaaccgcccccaaatctaactttattatgaggtacaagtaacgtcgacctcaggtagtttactaactcgtacttctcgtggtacctactaagtctaggacctaacgaccggtccctacctgacgtacctactcgttcgtcgggtcccttcgacggtccgtaggaccggacgacggtactagttaatttagttacgttggacctacgtaccttagaacttaacttaaacttacgttaagtacgtaacgttaacgggtttggttttacgggtttaccgggaacgggttaacggggaaacccgttaaggggttacccgggtaaccccggttaaccggtttaagggtccccgttaaaccgggaccccggtaaacgggttccccgttaccccgggtccccccggttaaccgggtttccctaacccggttttccccgttaaccccccggg

SEQ ID NO: 236195 - DNA, 730 bp, Homo sapiens
  misc_feature: GYAE6OF02FRB9N.14.3.A03.1.454.CMB.1.raw
  modified_base (392)..(392): a, c, t, g, unknown or other
  misc_feature (392)..(392): n is a, c, g, or t
tcagcgtctagtaccacgaccggtgctcgatttagagagcgtcacagggggggtctcaggaggcagcgctctcaggacatctccaccatggcctggctctgctgctcctcaccctcctcactcagggcacagggtcctgggcccagtctgccctgactcagcctgcctccgtgtctgggtctcctggacagtcgatcacatctcctgcactggaaccagtagtgtacgttggttattattaattttgtctccgtgtaccaacacgcacccgaggcaaacgcccccaaactcatttatttatgaggtcaataacgtccggccctacgaggtacgtttactaatccgtacttctctacggcctacctaagtctgacaacgacgcctccctgacnccgattccgtcgttcggggtcctaccgacgggtccgttacgggagggaaccggacggtaccgttaggttaaacgttttaactttaaccgttcggtaccgtacggtacccttacgtaactttaacttaaaccttaagtttaacgtacgttaacggtaaccgtttgggtttacggggttttttaccgggaccgggggtaacggggtaaccggtaacgggttaccggtaaccccgggtttccggttaacgggttacccgaaccggtaccccgttaagggtacccgttacccgggtccccccgttacccgggttacccgtacccgttcccgtttacccccgg

SEQ ID NO: 236196 - DNA, 709 bp, Homo sapiens
  misc_feature: GYAE6OF02IKFCW.14.3.A03.1.454.CMB.1.raw
  modified_base (134)..(134): a, c, t, g, unknown or other
  misc_feature (134)..(134): n is a, c, g, or t
  modified_base (140)..(140): a, c, t, g, unknown or other
  misc_feature (140)..(140): n is a, c, g, or t
  modified_base (184)..(184): a, c, t, g, unknown or other
  misc_feature (184)..(184): n is a, c, g, or t
  modified_base (193)..(193): a, c, t, g, unknown or other
  misc_feature (193)..(193): n is a, c, g, or t
  modified_base (207)..(207): a, c, t, g, unknown or other
  misc_feature (207)..(207): n is a, c, g, or t
  modified_base (228)..(228): a, c, t, g, unknown or other
  misc_feature (228)..(228): n is a, c, g, or t
  modified_base (263)..(263): a, c, t, g, unknown or other
  misc_feature (263)..(263): n is a, c, g, or t
tcagcgtctagtaccacgaccggtgctcgatttagagagcgtcacgagggggggtctcaggaggcagcgctctcaggacatctccaccatggcctgggctctgctgctcctcaccctcctcactcgagggcacnggtccnggcccagtctcgccctgactcagcctgcctccgtgtcgtggtcnccgtggacngtcgatcaccatcncctgcacgtagaaccagtagngacgtttgtattattaatttgtctctcggtacaanagcaccaggacaaacgaccccaaactcgaattactttagagagtacaataacgttccgacctcgaggtacgtttacctaacgtcgtcttccgtacgtcggtcctaccgtaacgttcgtacggtacgaaccgtaaccgggtccctacccgtagtaccactacggttctcgggtacggtccgtttccgaccgggttacgacggtacgggtaaaccgggaggtacgttaacgttaacttaacgttacgtacgaccgtagtacctacctaagtaacttaacgtaagtacgtacgtaacgttaacggtttcggttacgggttacggaaccgggtaacgtaaccgggtaggtaaccgtaaccggttcggtaacggtacccgaaccggtaacccgaaccggttcccgtcccggtaccccgttaccggtttacctacccgttacccgttacccg

SEQ ID NO: 236197 - DNA, 749 bp, Homo sapiens
  misc_feature: GYAE6OF02G350K.14.3.A03.1.454.CMB.1.raw
  modified_base (264)..(264): a, c, t, g, unknown or other
  misc_feature (264)..(264): n is a, c, g, or t
  modified_base (296)..(296): a, c, t, g, unknown or other
  misc_feature (296)..(296): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcacgtcggaaccagtagtgacgtttggttattattaattttgtctctgtaccacngcaccaggacaacgaccccaatcatttattangtagtacaataacgtccggaccctagaggtagtttactaactcgtacttctacgtggtcctacgtaagttctaggaccaacggtaccggtccctaccgtgacgactacgttcctcggtcgggtacctacgacgggtcgtaggaacgggtacgagggtccttaggtaaacttttacgttacgacgtaccgagtacccgttactaacgttaacttaacgttaacgttaacggaccttaaaaggttacggtttacgggtttttccggggtttaaaccggggaaccgggggttaacccggggtaaacccgtttacgggggttaccggttaacccgggttacccgttaacggggttacccaaacccggggttacccccgtaaacgggttcccccgttaccgggttaccccccccgtttaggggtacccccttaccgttttccccggttaaccccccgg

SEQ ID NO: 236198 - DNA, 644 bp, Homo sapiens
  misc_feature: GYAE6OF02HHQX8.14.3.A03.1.454.CMB.1.raw
  modified_base (308)..(308): a, c, t, g, unknown or other
  misc_feature (308)..(308): n is a, c, g, or t
  modified_base (314)..(314): a, c, t, g, unknown or other
  misc_feature (314)..(314): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctctggacagtcgatcaccatctcctgcacgtaggaaccagtagtgtacgttggttaattattaattttgtctcctggtaccaacagcaccaggcaaagccccaaatcattatatgagtcaataancgcctnaggatttcaatcgtcttctctaggcctaccagttctaggaccaacgaccggtcctacccgtgagtcgtaactcgtacgtgggccttaccgaggtactgggaacggtaccggaagggtcctaggtaatttaacgttaacgttcgacgtacgcttacgtaacttaagttaaccttagtttaacgaccgtaagtaaacgttgtttacggggttttcggaacggggtacgggtaaccgtagggtacggtaccccggttacgtaacggtcaaccggtacccgtaaggtcccgtacccgtaccccggttccggtaacctacccgtcgttaccccgg

SEQ ID NO: 236199 - DNA, 700 bp, Homo sapiens
  misc_feature: GYAE6OF02GEDEG.14.3.A03.1.454.CMB.1.raw
  modified_base (224)..(224): a, c, t, g, unknown or other
  misc_feature (224)..(224): n is a, c, g, or t
  modified_base (265)..(266): a, c, t, g, unknown or other
  misc_feature (265)..(266): n is a, c, g, or t
  modified_base (386)..(386): a, c, t, g, unknown or other
  misc_feature (386)..(386): n is a, c, g, or t
  modified_base (391)..(391): a, c, t, g, unknown or other
  misc_feature (391)..(391): n is a, c, g, or t
tcagcgtctagtaccacgaccggtgctcgatttagagagcgtcacagggggggggtctcaggaggcagcgctctcaggacatctccaccatggcctgggctctgctgctcctcaccctcctcactcagggcacagggtcatgggcccagtctgccctgactcagcctgcctccgtgtctgggtctccgtggacagtcgatcaccatcctcctgcactggaaccngtagtgacgttggttaattatattttgtctcctggtaccanncaccagcaaacgcccccaaatcatttattatgtaggtcaagtaactccggaccctgaggtacgtttctaagtcgtcttctctggcctacgaagtctacggacaaccgacgtccctacccngtacnctatcgtcgtcgggtcctaccggaggtctacgggaacggacggtacgggctaggtaactttaacgttccgtacggtacaacggtcttaaccgtaacgtttaacgtaaccgtttagtttaacggacctaacgttaacggtttcgggtttacggggttttacccgggacggggtaaccgggtaacccgtaaggggttaccgtaaccccgggttaccggttaacggggtacccgtacggtacccccggtaaacgggtcccgtttaaccccggcccccccggtttaggttacccccgtacggtttacccccgg

SEQ ID NO: 236200 - DNA, 764 bp, Homo sapiens
  misc_feature: GYAE6OF02F7QN6.14.3.A03.1.454.CMB.1.raw
  modified_base (263)..(263): a, c, t, g, unknown or other
  misc_feature (263)..(263): n is a, c, g, or t
tcagcgtctagtaccacgaccggtgctcgatttagagagcgtcacagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcacatctcctgcacgtggaacctagtagtgacgttggttattataattttgtctcctggtaccaanacgcaccaggacaaacgcccccaaatcattattatgagtacaataactccggcctcgaggtagtttctaaatcgtctttcgtcgtcggtcttccctaaagtcctacgggtacaaaccggtaccgggacccttccccgtagacggtccaacttcctcgttccggggaccttacccggtaacgggtccgttacgggaaacgggaccggtacgggtccgttaggtaaattttacgtttaccgtaggtacctaacggtaccgttacctaagttaacgttaacttaaacgtttacgtaacgaaacgttaaccgttttagggtttacgggtttttaccgggacggggttaaaccggggtaaccggttaacggggttaccggtaacccgggttcccggttaacgggttacccgaaccgggttaacccccgtaaacgggtaccccgttaccggtaccccccccggtttaggggttaccccttaacccgggtttccctttaacccccggg

SEQ ID NO: 236201 - DNA, 614 bp, Homo sapiens
  misc_feature: GYAE6OF02FT09H.14.3.A03.1.454.CMB.1.raw
  modified_base (221)..(221): a, c, t, g, unknown or other
  misc_feature (221)..(221): n is a, c, g, or t
  modified_base (282)..(282): a, c, t, g, unknown or other
  misc_feature (282)..(282): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngtagtgacgttgtattatatttgctctgtacacagcaccagcaagccccaatcattattangagtacaataatcggacctcgagtagtttctaatcgtcttctctggctaccaagttctggactaacacggtcctcctagacgctactctcgtggcctcgaggtctaggaggacgaggtctagatttacgttacgtcgtaccgtagtcctacgtattaattaccgttaatttacgactaaggtacgttggtttcgggttttacgggacgggtacgggtaaccgtagggtaccggtaaccggttccggttaacggtcccgtacggaccccgtaagggtcccgttacccggtcccccggtttacgggtaccccttaccgttcccgtttaccccgg

SEQ ID NO: 236202 - DNA, 686 bp, Homo sapiens
  misc_feature: GYAE6OF02JNM0W.14.3.A03.1.454.CMB.1.raw
  modified_base (203)..(203): a, c, t, g, unknown or other
  misc_feature (203)..(203): n is a, c, g, or t
  modified_base (324)..(324): a, c, t, g, unknown or other
  misc_feature (324)..(324): n is a, c, g, or t
tcagcgtctagtaccacgaccggtgctcgatttagagagcgtcacagggggggtctcaggaggcagcgctctcaggacatctccaccatggcctgggctctgctgctcctcaccctcctcactcaggcacagggtcctgggcccagtctgccctgactcagcctgccttccgtgtctgggtctccgtggacagtcgatcaccntctcctgcactcggaaccaggtagtgtacgttaggtttattattaagttttcgtcttccgttaggtaccaactaggtaccacccaggtcaaaccgaccccctaaatctaatttatttaacngtaggtacaagttaactccgcctacgtggtacgtttactaactctacttctacgtgcctacaacgttcgtcgacaaaccgtcggtcccttccgtagacgtcctactctacgtcggtccttacgacggtcgtacggaacggtacgaacgggtctacgtaactttacttacgtagtcaacgtctacagttactacgtacttagacgtagtaacgttcgggtttacggttttacgggacgggtaaccgggtaaccgacgggttaacgaccccgggttactacggttaacccaccggtaacccgtacgggtacccttccgggtaccccccgttacgggtaccccttacttcccggtttacccccgg

SEQ ID NO: 236203 - DNA, 650 bp, Homo sapiens
  misc_feature: GYAE6OF02IQX3N.14.3.A03.1.454.CMB.1.raw
  modified_base (233)..(233): a, c, t, g, unknown or other
  misc_feature (233)..(233): n is a, c, g, or t
tcagcgtctagtaccacgaccggtgctcgatttagagagcgtcacagggggggggtctcaggaggcagcgctctcaggacatctccaccatggcctgggctctgctgctcctcaccctcctcactcagggcacgagggtcctgggcccagtctgccctgactcagcctgcctccgtgtcgtgggtctccgtggacagtcgatccaaccatcctctgcacgtggaaccagtagngtacgttggtggttataagtatgtctcgtcgtaaccaacaacaccagacaaaccgaccccaaatcatagtatttagagagtacagtaactccggtacctacgtagggtttactaacgtcgtctttcgtcgtcggtccttaaccgaagtctaggaacaaaccgaccggtcctaccccgtagaaccctactccgtcggtcgggtcctcgaacggtcgtacggaacggtcgtaacgttcgtaagtaagttttaattacgttcgactagtcttacatacgtcaccgtacgtcggacagtacctaatcgtaagtcgggttacgggttacggggaccgggggtaactacgggtcgtacccgtacggtaacggtaccgacgacccggtacggcccttacccggtccccgttacgaccttacccg

SEQ ID NO: 236204 - DNA, 596 bp, Homo sapiens
  misc_feature: GYAE6OF02HWURL.14.3.A03.1.454.CMB.1.raw
  modified_base (210)..(210): a, c, t, g, unknown or other
  misc_feature (210)..(210): n is a, c, g, or t
  modified_base (222)..(222): a, c, t, g, unknown or other
  misc_feature (222)..(222): n is a, c, g, or t
  modified_base (292)..(292): a, c, t, g, unknown or other
  misc_feature (292)..(292): n is a, c, g, or t
tcagcgtctagtaccacgaccggtgctcgatttagagagcgtcacgaggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatccaccatctccngcactggaaccngtagtgtacgttgttatattaatttgtctctggtacaacagcaccagcaaacgccccaaatcattattangagtcaatatcgcctagagtacgttctaatcgtcttctctcgcctacaagtctggacaacgcgcctccctgagcatctcgtcggctcgagtctaggacggtacgaggcgttagtaactttattacgtgacacgtcctataattattaacgttaagttacgactagtaacgttggtttgggtttacggacgggtacgggaacgtaacgggtcgtacccggttacgtaagggtaccaaccggacccgtaaggtcccgttacccggcccccgttacgggtaccctacccggttccgtttacccccgg

SEQ ID NO: 236205 - DNA, 592 bp, Homo sapiens
  misc_feature: GYAE6OF02JOX5Q.14.3.A03.1.454.CMB.1.raw
  modified_base (201)..(201): a, c, t, g, unknown or other
  misc_feature (201)..(201): n is a, c, g, or t
  modified_base (220)..(220): a, c, t, g, unknown or other
  misc_feature (220)..(220): n is a, c, g, or t
  modified_base (257)..(257): a, c, t, g, unknown or other
  misc_feature (257)..(257): n is a, c, g, or t
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
  modified_base (382)..(382): a, c, t, g, unknown or other
  misc_feature (382)..(382): n is a, c, g, or t
  modified_base (393)..(393): a, c, t, g, unknown or other
  misc_feature (393)..(393): n is a, c, g, or t
  modified_base (418)..(418): a, c, t, g, unknown or other
  misc_feature (418)..(418): n is a, c, g, or t
tcagcgtctagtaccacgaccggtgctcgatttagagagcgtcacaggggggggtctcaggaggcagcgctctcaggacatctccaccatggcctgggctctgctgctcctcaccctctcactcagggcacagggtcctgggcccagtctgccctgactcagcctgcctcgtgtctgggtctcctggacagtcgatcaccnttcctcagcacgtcgaacngtagtgacgtttggttatattatttgtctctgtacanancaccngacaaacgccccaatctagttattatgagtacaatactcgccctcgaaggtctttactaagtcgtcttctcgtcggtctaccgtagtctcgggacaaccgtacgtcctaccctaggcntacgtcttcgnggtcctcgaaggtcgtgacggacgngtctgtaattcttacgtgcgttcgctactataacttacgttatacgatagtagttcgggtttggttacgggcgaacggtacgtacggtacgtaccggtacgtacggtacacccgtaccgtaaccgtccggtcccgtccccgttacggaccgtttaccgtccccgtttaacccgg

SEQ ID NO: 236206 - DNA, 682 bp, Homo sapiens
  misc_feature: GYAE6OF02F5VOS.14.3.A03.1.454.CMB.1.raw
  modified_base (268)..(268): a, c, t, g, unknown or other
  misc_feature (268)..(268): n is a, c, g, or t
  modified_base (448)..(448): a, c, t, g, unknown or other
  misc_feature (448)..(448): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctcgtgtctgggtctcgtggacagtcgatcaccatcctcctgcacgtggaaccagtagtgtacgtttggttattagttattttgtctccgtgtaccaacngccaccgagacaacgcccccaactctattattatgaggtacaataactccggccctcgaaggtagttttactaagtccgtctttcctcgttcggtcctaccgtaagttccgtacgggaccaaccgtaccggtccccttcccgtcggacgccttactcctccggttcggcccttacccggngggtaccgtacgggacgggtacggacggtctagtaactttacgttacgtcgtacgcgtaccttacctaattaaccttaacttaagtttacgacctaaggttaacgtttcggtttagggtttaccggacgggaacgggtaacgtacggttaccggacccgttacggtacggtaccaccggaccggtacggcccgtacccggtccccgttcggtcccttaccgttcccgttcccgg

SEQ ID NO: 236207 - DNA, 674 bp, Homo sapiens
  misc_feature: GYAE6OF02FLQCR.14.3.A03.1.454.CMB.1.raw
  modified_base (316)..(316): a, c, t, g, unknown or other
  misc_feature (316)..(316): n is a, c, g, or t
  modified_base (469)..(469): a, c, t, g, unknown or other
  misc_feature (469)..(469): n is a, c, g, or t
tcagcgtctagtaccacgaccggtgctcgatttagagagcgtcacaggggggggtctcaggaggcagcgctctcaggacatctccaccatggcctggctctgctgctcctcaccctcctcactcagggcacagggtcctgggcccagtctgccctgactcagcctgtcctccgtgttctgggtctcctggacagtcgatcaccatcctcctgcacgtggaaccagtagtcgtacgttaggttaattattaattttgtctaccgtggtaccaacagccaacccgaggacaaaccgacccccaactactatttattangtagtacaatatccgcctacgaggtatttactatcgtcttcgtctggtacctcgtaagtcgtcggacaacgtccgtccctcctgacgtcactcgtacgtcgggtacctcgaggtctaggacggacggaggtactagtaactttacttaacgtntacgtacgtaccgtatacttaacgttacttaacgttaacgacgtaacggttacgtttacgggttttcggggtttaccggaccgggttaacgggaaccgtacgggttacgtacccggtcggttaaccggttaccgaccgggtaacccgaaccggtccttaccccggtcccccggttacgtaccgttaccgttcccgtttaccccgg

SEQ ID NO: 236208 - DNA, 827 bp, Homo sapiens
  misc_feature: GYAE6OF02G49IQ.14.3.A03.1.454.CMB.1.raw
  modified_base (808)..(808): a, c, t, g, unknown or other
  misc_feature (808)..(808): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctcgtgtctgggtctccgtggacagtcgatcaccatctcctgccacgtcggaaccaggtagtgtaccgtttggttaattataatttttcgtcttccttaggtaccaactagaccaccccgaaggaccaaaacgacccccccaaaactccgtaatttaacgttttataggtaacgggttaacaaattaaacgtcccgggtaccccttacgaacgggttacgtttttacctaaacgttccgtccttttacgttccgttcggtaccctaccgtaaacggttcctacggggtacctaaaccggacccggtccctacccccgttaggaaccgtaccaacgtttcccggttaccgtacggggtcccttaccggtaacggggtccgtttacggggaaacgggttaccgggacggggtaccgttaggtaaacgttttacgttaaccggttggtccctaaaccggtcttacctaaacgtttaacgtttaaacgttaacttacggtactaaaggttaaccgttgggttttaacgggttttccgggacgggtaaccgggtaaccggtaagggttccggtaaacccgggttccgttaacgggtaccaccggtaacccgtaacgggtccgtacccggtaccccgtcggtaccnccgtttacccgtccccggg

SEQ ID NO: 236209 - DNA, 665 bp, Homo sapiens
  misc_feature: GYAE6OF02IWEQV.14.3.A03.1.454.CMB.1.raw
  modified_base (303)..(303): a, c, t, g, unknown or other
  misc_feature (303)..(303): n is a, c, g, or t
  modified_base (461)..(461): a, c, t, g, unknown or other
  misc_feature (461)..(461): n is a, c, g, or t
  modified_base (474)..(474): a, c, t, g, unknown or other
  misc_feature (474)..(474): n is a, c, g, or t
tcagcgtctagtaccacgaccggtgctcgatttagagagcgtcacagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtaatgtacgttggttattattaattttgtctctggtaaccaacagccaccagacaaacgcccccaaactcattaatttangaggtacaaataactccggccctacgaaggtacgtttactaagtcgtcttcctctcggctaccaagtctacggacaacgaccggtcctcccgtagagacacttctcgtcgggcctccgaggccgtaggacgggacgaggtcgtagtaattacttacgngtacgagtcctanaacttattacgttaattaggaacctaaggtaaccgttgggtttacgggtttaccgggacgggtaacggggtaacccggtaagggttaccggtaacccgggttaccggttaacggtaccggaaccggtacccgtaaacgggtcccgtaccggtccccccgttaccgggtacctacccgttaccgttccccgg

SEQ ID NO: 236210 - DNA, 648 bp, Homo sapiens
  misc_feature: GYAE6OF02JM6HX.14.3.A03.1.454.CMB.1.raw
tcagcgtctagtaccacgaccggtgctcgatttagagagcgtcacaggggggggtcgtcaggaggcagcgctctcaggacatctccaccatggcctgggctctgctgctcctcaccctcctcactcagggcacgagggtcctgggcccagtctgccctgactcagcctgcctccgtgtctgggtctctggacagtcgatcaccatcctctgccactggaaccagtagtcgtacgttggttaattattaattttcgttcttcttcgtacctaacacgtccaccacgacaacgaccccaacctactacttattatagtacggtactaataatacctaccggggggggtactacggtagtttacttaactacgtacttacttctacggtctacctaacgtacgtcgacgtaacgaccggtacctaccctcgtacgactactctacgtcggctccgtacgtcgtacggacgtacggacgtacgtgtattacgttacgtcgtacgtacgtctactagttactacttattacgtactacgtaacgttacgttcgggtttacggtacgggtacggacgtacggtacgtaccgtcgtacgtacgacgtaccgacggtcgtaccggcccgttaccggtaccgtacgtccgttacccg

SEQ ID NO: 236211 - DNA, 728 bp, Homo sapiens
  misc_feature: GYAE6OF02ILUVV.14.3.A03.1.454.CMB.1.raw
  modified_base (204)..(204): a, c, t, g, unknown or other
  misc_feature (204)..(204): n is a, c, g, or t
  modified_base (310)..(310): a, c, t, g, unknown or other
  misc_feature (310)..(310): n is a, c, g, or t
  modified_base (321)..(321): a, c, t, g, unknown or other
  misc_feature (321)..(321): n is a, c, g, or t
  modified_base (436)..(436): a, c, t, g, unknown or other
  misc_feature (436)..(436): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccntctcctgcactggaacctaggtagtgtacgttgttattatattttgtctctggtaccaacagcaccagacaaacgccccaaatctattattatgaggtcaattacnccggtccctanaggtagtttactaaacgtcgtcttcctcgtggtccttacccgaagttccgtacggacctaaacgaccgggtccctacccgtgaaccgtctaacttccgtcgtcgggccttaccgngggtactgggaacgggacgacggtcttaggtacttttaacttacgtggactacgtactaccgaatttaactaactttaacgtttaacggaccttaaacggtaacgttttcggggttttacgggttttacccggggacggggttaaccgggtaaccggttaagggttacccggttaacccgggttacccggtttaacggttaccggtaaccggtaccccgtaaaccgggtcccggttaccccggttacccccggttcgggttacccttacccggttacccgttttcccccggg

SEQ ID NO: 236212 - DNA, 621 bp, Homo sapiens
  misc_feature: GYAE6OF02HJFGB.14.3.A03.1.454.CMB.1.raw
  modified_base (393)..(393): a, c, t, g, unknown or other
  misc_feature (393)..(393): n is a, c, g, or t
  modified_base (402)..(402): a, c, t, g, unknown or other
  misc_feature (402)..(402): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcacgtggaaccagtaggtgtacgttttggttaattattaattttgtccttccgtggtaacccaacacggccaacccgaggaccaaaccgaccccccaaatcctaatttattatggacggtactaataacgtccggaccctagtaggtatttcaatcgtcttctcgtcgctacaagtctgacacncgtcctccngacgcactctcgtcggtctcgagtctaggacgacgacgctagtattacttacgtgactacgtctactattatactagtacgactagtacgttggtttacggtttcgggacggtaacgggtaccgtacgggtaccgtacccggttcggtaccggtacgaccggtacccggaggtcccgttcccgcccccggttacggtcccttaccgtcctttaccccgg

SEQ ID NO: 236213 - DNA, 646 bp, Homo sapiens
  misc_feature: GYAE6OF02JJIRJ.14.3.A03.1.454.CMB.1.raw
  modified_base (243)..(243): a, c, t, g, unknown or other
  misc_feature (243)..(243): n is a, c, g, or t
  modified_base (416)..(416): a, c, t, g, unknown or other
  misc_feature (416)..(416): n is a, c, g, or t
  modified_base (493)..(493): a, c, t, g, unknown or other
  misc_feature (493)..(493): n is a, c, g, or t
  modified_base (502)..(502): a, c, t, g, unknown or other
  misc_feature (502)..(502): n is a, c, g, or t
tcagcgtctagtaccacgaccggtgctcgatttagagagcgtcacaggggggtctcaggaggcagcgctctcaggacactctccaccagtcggccgtgggctctgctgcctcctccaccctctcactcgacggcacgaggtcctcggacccagtctcgccctagacctcacgcctggcctccgtgtcgtggtctcgtggactagtcatccgaccatcctcgtgacacgtaggaaccagttagngtacgttgttaacttattagtttcgtctcgtacggtacaactgaccaccgagaccaaccgacccaactctattatatgtagtacaagtactcgacctcgaagtagttactaagtctacttctacgtcggtactacgtaagtctacggaccaaccgcgtacctccgtacgaccncgtactccgtcggtacggtctaccggagtccgtaggtacggacgagtccgttagtaagttaccttacggtcgtaacncgaccttanagttaactaacgttacttacgactaaggtacgttggtttacgggttacggcgggaacgtacgacgttacgaccgttcgtacgtccgaacgtacccgtagtacccgtcccggcccgttaccggtacccttagtcccgttaccccg

SEQ ID NO: 236214 - DNA, 676 bp, Homo sapiens
  misc_feature: GYAE6OF02IA8BE.14.3.A03.1.454.CMB.1.raw
  modified_base (200)..(200): a, c, t, g, unknown or other
  misc_feature (200)..(200): n is a, c, g, or t
  modified_base (278)..(278): a, c, t, g, unknown or other
  misc_feature (278)..(278): n is a, c, g, or t
tcagcgtctagtaccacgaccggtgctcgatttagagagcgtcacgagggggggggtctcaggaggcagcgctctcaggacatcctccaccatggcctgggctctgctgctcctcaccctcctcactcgagggcacgagggtcctcgggcccagtctgccctgactcagcctgccctcgtgtcgtgggtctccgtggacngtcgatcacatctctgcacgtggaaccagtacgtgtacgttggttattagttaattttcgtctaccgtggtaaccaanacgacaccaaggaccaaaaccgaccccctaaactctaatttaatttacgtaggtacggtaacaaagtaacgtccggtacctcgtaaggtactttacctaagtcgtcttactcgtacggtccttacgaacgtcgtacggaacctaacggacccggtacctacctagggactacctagtccgtcgtcgggacctaccggtaacgtcggtacgacgggacgtacgggattaacgtatttaacgtacgtagaccgagtacataactattaacctagttacagttaacggtacttgggttcggttaggaacggtacggaacgtacgtcggtacccgtcggtaaggtcaaccgtaccgtacggtacgtcccgaacccgtttcggaacctcgttaccgttccccg

SEQ ID NO: 236215 - DNA, 646 bp, Homo sapiens
  misc_feature: GYAE6OF02FKRZ1.14.3.A03.1.454.CMB.1.raw
  modified_base (232)..(232): a, c, t, g, unknown or other
  misc_feature (232)..(232): n is a, c, g, or t
  modified_base (274)..(274): a, c, t, g, unknown or other
  misc_feature (274)..(274): n is a, c, g, or t
  modified_base (451)..(451): a, c, t, g, unknown or other
  misc_feature (451)..(451): n is a, c, g, or t
  modified_base (474)..(474): a, c, t, g, unknown or other
  misc_feature (474)..(474): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctcgccctgactcacgcctgcctccgtgtcttgggtcctccgtggacaggtcgactccacctatctcctgccactcggaaccngtagtgtacgtttgttattattaatttgtctctggtacacancaccagacaaaccgcccccaaactctattacttatcgaggttacaaatacgtcggccctagacggtagtttaccaagtccgtcttctcgtcgctaccgaagtctgggaccaaacgtccgcccgttccctgaccgtactactcgtaccgtcggcctccgacgcgtcgggacggtacgnggtacgtacgtatttacttacgngacacgtactactaattagttaacttaagttctaacgtacgtaacgttttcggttgggtttaccgggacgggtaacgggaccgtacgggttaccgtacgttaccgtacggccgtaccggtacccgacggtcctacccggtccccgtcgtacccgtacccgttgtacccccgg

SEQ ID NO: 236216 - DNA, 683 bp, Homo sapiens
  misc_feature: GYAE6OF02GH1OM.14.3.A03.1.454.CMB.1.raw
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgtacgtttgttattatattttgtctctgtaccacagcaccagcaaagccccaatcattattatagaggtacaatatccggtcctcgagtagtttactaacgtcgtcttctcgtcgctaccgaagttctagggacaaccgaccggtcctccctaggacgctacgttcctacggttcgggcctccgacgggtactagggacggaccggaacgggttccgtagttaacgtttattaacgtcgaccgtaacgtcttacgtaattaacttaaccgttaagtttacgacgtaacggttacgtttacgggttttcggggtttaccgggcgggtaacgggtaccgtaacggggtccgttacccgggtaaccggttaagggtacccgaaccggttaccccggaaaccgggttcctaccccgggttccccggttaccgtacccgttacccgttcgtttaccccccgg

SEQ ID NO: 236217 - DNA, 702 bp, Homo sapiens
  misc_feature: GYAE6OF02FMJ8D.14.3.A03.1.454.CMB.1.raw
  modified_base (266)..(266): a, c, t, g, unknown or other
  misc_feature (266)..(266): n is a, c, g, or t
tcagcgtctagtaccacgaccggtgctcgatttagagagcgtcacagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcacgtcggaaccagtagtgacgtttggttattataatttgtctcctggtaccaanagcaccgagacaaacgacccccaaactcacttattatgagtcaataatcggaccctcgaggacgttttacaattccgtctttacgtcgtaggtacctacgtaagttctaggaccctaaacgaccgggtcctaccctgaacggtcctagtcttccgtacgggtccgtcccgaaggtcccgttaggacgggtaaccgaagggtccttggaaacgtttttacttaacgtcggtaaccgtaggtacctacctaaaggttaacttaaaccttagtttaagaccttaacggtaacgttcggtttcggggttttaccgggacgggaaacggggttacctaagggttccggtaacccgtccggtaacggttacgaaccggtaccccggtaaaggtcccgttccgttacccccggtaacggtcgtaacccgttcgttacccccgg

SEQ ID NO: 236218 - DNA, 632 bp, Homo sapiens
  misc_feature: GYAE6OF02FX1MU.14.3.A03.1.454.CMB.1.raw
  modified_base (319)..(319): a, c, t, g, unknown or other
  misc_feature (319)..(319): n is a, c, g, or t
  modified_base (375)..(375): a, c, t, g, unknown or other
  misc_feature (375)..(375): n is a, c, g, or t
  modified_base (378)..(378): a, c, t, g, unknown or other
  misc_feature (378)..(378): n is a, c, g, or t
  modified_base (391)..(391): a, c, t, g, unknown or other
  misc_feature (391)..(391): n is a, c, g, or t
  modified_base (424)..(424): a, c, t, g, unknown or other
  misc_feature (424)..(424): n is a, c, g, or t
tcagcgtctagtaccacgaccggtgctcgatttagagagcgtcacagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatccaccatctcctgccactggaaccagtagtgtacgttgttattatattttgtctctggtaccaacagcaccagcaaacgaccccccaaactcattatttatgagtacaataagtccgccctnaggtagtttctaatcgtcttctctggacctcacgtctggacaacgaccgcctcccnganctatctcgtggcncgaggctgacggagaggtctagtattacttagngctagcctctaattacttaacttaagttacgactaacgtaacgttgggtttacggttttaccggggacgggaaccgggggtaaccgtaacgggttcggtaacccggttacccggttaagggacccgtaacgggaccccggttaacggtcccgtacccggttacccccccggttacggtaccccgttacccgtttccgtttacccccgg

SEQ ID NO: 236219 - DNA, 720 bp, Homo sapiens
  misc_feature: GYAE6OF02JAK8B.14.3.A03.1.454.CMB.1.raw
  modified_base (207)..(207): a, c, t, g, unknown or other
  misc_feature (207)..(207): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcgaggcacaggtcctcgggcccagtctcgccctgactcagcctgcctcgtgtctgggtcctcgtggactagtcgatccacctntctcctgacctacgtcggaacctaggtagtgtacggtttaggttaattaattaattttcgtccttcctacggtaccaactcgtaccaccgaacggacctaaaccgaccccctaaactactatttaatttagtaggtacgtactaaactacgtccggtccctacgtaggttactttacaacttcgtacttctacgtcgtccgtaactacgtcgtacgaaccgtaacgtacccgtcctaccgtacgaccgtacctacttcgtaccggtccggtccttaccggagtaccggtcggacggtacgtacggtacctgttaacgttaagttccgtacgtacaccgttctactaaccttataacttactacgaattaacggttacgttcgggttacgggttacggaccgggtaacgggtaaccgtacgggtaccggtacccgtcggtaccgtaccgaaccgtacccggaaccgttccgtccccggtacccttccggtacctccggtttacccgtaaccccg

SEQ ID NO: 236220 - DNA, 707 bp, Homo sapiens
  misc_feature: GYAE6OF02I45UE.14.3.A03.1.454.CMB.1.raw
  modified_base (183)..(183): a, c, t, g, unknown or other
  misc_feature (183)..(183): n is a, c, g, or t
  modified_base (222)..(222): a, c, t, g, unknown or other
  misc_feature (222)..(222): n is a, c, g, or t
  modified_base (513)..(513): a, c, t, g, unknown or other
  misc_feature (513)..(513): n is a, c, g, or t
  modified_base (656)..(656): a, c, t, g, unknown or other
  misc_feature (656)..(656): n is a, c, g, or t
  modified_base (685)..(685): a, c, t, g, unknown or other
  misc_feature (685)..(685): n is a, c, g, or t
tcagcgtctagtaccacgaccggtgctcgatttagagagcgtcacaggggggggtcgtcgaggaggcagcgctctcaggacatctccaccatggcctgggctctgctgctcctcaccctcctcactcagggctacaggtcctgggcccagtctgccctgactcagcctcgcctcgtcgttcgngggttcctccgtggactagtcgactcaccatctcctgcncgtacggaaccaggtagtcgacgtttaggttaacttattaacttttgtcttccgttaggtaacctaacaacgtccaacccgaggtaccaaaccgaccccctaaaactccgtaattttaacgtttacgaggttaacggttaactaaagtaaacgttccggtaccccgtacgtaggtaacgttttactaaatccgttactttctctcggacttaccgaattcgtcggactaacgacgccgttacccgtagacgtactacgtctagtcggcctaccgagtcgacgaggtaacgnggtctacggtatttaacgtatacggtctacggtctaacggtacttaattaacgtacgtttacataaacggttcgttacgtttaagggtttcgggaaccggaggtaccggtagtacgggtaaccgtccggtaagtcccggtaanacccggtagggcccttacccggtacccgngtaccgtaccttcggttccccg

SEQ ID NO: 236221 - DNA, 584 bp, Homo sapiens
  misc_feature: GYAE6OF02JV7HS.14.3.A03.1.454.CMB.1.raw
  modified_base (223)..(223): a, c, t, g, unknown or other
  misc_feature (223)..(223): n is a, c, g, or t
  modified_base (339)..(339): a, c, t, g, unknown or other
  misc_feature (339)..(339): n is a, c, g, or t
  modified_base (477)..(477): a, c, t, g, unknown or other
  misc_feature (477)..(477): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
  modified_base (553)..(553): a, c, t, g, unknown or other
  misc_feature (553)..(553): n is a, c, g, or t
  modified_base (565)..(565): a, c, t, g, unknown or other
  misc_feature (565)..(565): n is a, c, g, or t
  modified_base (572)..(572): a, c, t, g, unknown or other
  misc_feature (572)..(572): n is a, c, g, or t
tcagcgtctagtaccacgaccggtgctcgatttagagagcgtcacaggggggggtcgtcaggaggcagcgctctcaggacatctccaccatggcctgggctctgctgctcctcaccctcctcactcagggcacagggtcctgggcccagtctgccctgactcagcctgcctccatgtctgggtctcctggacagtccgatcaccatctcctgcactggaaccngtaacgtgacgttggttattactaaattttgtcttcctggttaccaactagcaacccacggcaaagccccctaaaatccaattattatcgtaggtacaaataattacggcccttanaggtaggtttactaaactcggtacttcctcttggcctaccaaacggttctaagggtccaaacgaacgggtccctccttacggagccaatcctcgtggtctccgacggtcctgagggaccgaggacttggaattattangtacncgtntctatactataacttaagcagaacttgtacgttcgtacgagtccgaagttcggacgtactgggtacnggacctaggacngtccccncggttcgactcg

SEQ ID NO: 236222 - DNA, 716 bp, Homo sapiens
  misc_feature: GYAE6OF02HPYO1.14.3.A03.1.454.CMB.1.raw
  modified_base (550)..(550): a, c, t, g, unknown or other
  misc_feature (550)..(550): n is a, c, g, or t
  modified_base (670)..(670): a, c, t, g, unknown or other
  misc_feature (670)..(670): n is a, c, g, or t
tcagcgtctagtaccacgaccggtgctcgatttagagagcgtcacaggggggggtctcaggaggcagcgctctcaggacatctccaccatggcctgggctctgctgctcctcacctcctcactcaggcacagggtcctgggcccagtctgccctgactcagcctgcctccgtgtctgggtctcctggacagttcgatcaccagtcttccagccacgtggaacctaggtactggtacgtttaggttatttaactaacttttgttcttaccgtacggttaccaacacgacacccaggacaaaccggaccccaaactctaacttatttagtagtaacggttacaaatacgtaccggtcccacgtaagggtacgtttacctaaacgttccgtaccgtttacttcgttcggtccgttaaccgtaaacggttctttacgggaacccttaacgaaccggttcccgtaccgttcgacgtacgtactccgtacgtcggtcctaccgtacggctacgggacggacgtacgggtactacgtaacgttattaaccgtgacgngttaccctatacttaacgtaacttaagttacgaactacggtactttagggttccggttcggtacgggaaccgttacgtaacggtcgtaccggttaactagggtacctacggttaacccgnggtacccgttaccgtcccggtaccggtactaccgttccgttacccg

SEQ ID NO: 236223 - DNA, 640 bp, Homo sapiens
  misc_feature: GYAE6OF02GQGB7.14.3.A03.1.454.CMB.1.raw
  modified_base (192)..(192): a, c, t, g, unknown or other
  misc_feature (192)..(192): n is a, c, g, or t
  modified_base (462)..(462): a, c, t, g, unknown or other
  misc_feature (462)..(462): n is a, c, g, or t
  modified_base (469)..(469): a, c, t, g, unknown or other
  misc_feature (469)..(469): n is a, c, g, or t
tcagcgtctagtaccacgaccggtgctcgatttagagagcgtcacaggggggggggtctcaggaggcagcgctctcaggacatctccaccatggcctgggctctgctgctcctcaccctcctcactcagggcacagggtcctgggcccagtctgccctgactcagcctgcctcgtgtctgggtctctggacngtcgatcaccatctcctgcactggaaccagtagtgtacgtttgttaattattaattttgtctccgtggtaaccaacagccaccgagacaaacggcccccaaactcatttattatggagtcaaatacgtccggtcctagaggtacgtttactaacgtcgtctctcgtcggctcaagtctacggactaacgcggtcctccgtagacgtctacttcgtcgtcgggacctccgagtcgtaggacggacgaggtctagtaagtttacttatcganaccggtntactagttaactcttaagttacgataacggtacttgggtttcgggtttaccgacggggtaacggtaccgtaacgggttccgtaacccggtttcggacggtaccgaaccggtaccccgtaaggcccttacccggtaccccgttacggtccttaccgtccggtttacccccgg

SEQ ID NO: 236224 - DNA, 669 bp, Homo sapiens
  misc_feature: GYAE6OF02FP6VE.14.3.A03.1.454.CMB.1.raw
  modified_base (194)..(194): a, c, t, g, unknown or other
  misc_feature (194)..(194): n is a, c, g, or t
  modified_base (206)..(206): a, c, t, g, unknown or other
  misc_feature (206)..(206): n is a, c, g, or t
  modified_base (272)..(272): a, c, t, g, unknown or other
  misc_feature (272)..(272): n is a, c, g, or t
  modified_base (407)..(407): a, c, t, g, unknown or other
  misc_feature (407)..(407): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacgagggtcctgggcccagtctgccctgactcagcctgcctccgtgtctgggtctccgtggacngtcgactcaccntctcctgcacgtcggaacctgtagtgtacgtttggttaattataattttcgtctctggtaccaacngcaccgagaccaaacgccccaaactcatttattatgagtacaatacgtccggtacctacgaggtactttactaacgtccgtactttctcgtcggcctaccgtaagtcctggaccaacgtccgtcctccctagacntactcgtcgtcggcctccgaggtcctggacggacgtaggtctagtatttaacgtcgtacgacctgtcctactaagttacttaaccgttaagttacgaacccgttaaggttacccgtttgggttttaccgggtttaccggacgggtaaaccgggtacgtagggttacccggtaaccggttccggaacggttaccggaacccgtaccggaacgggttccgtccccggttaccccgcgggttaccctccgtttacccgtccccgg

SEQ ID NO: 236225 - DNA, 778 bp, Homo sapiens
  misc_feature: GYAE6OF02I2FF0.14.3.A03.1.454.CMB.1.raw
  modified_base (156)..(156): a, c, t, g, unknown or other
  misc_feature (156)..(156): n is a, c, g, or t
  modified_base (220)..(220): a, c, t, g, unknown or other
  misc_feature (220)..(220): n is a, c, g, or t
tcagcgtctagtaccacgaccggtgctcgatttagagagcgtcacgagggggggggtctcaggaggcagcactctcaggacatcctccacatggcctgggctctgctgctcctcaccctcctcactcgaggcacgaggtcagtcgggacccagtcncgccctgacctcgacgcctcgtcccgttccgtgtcgtcggtcctccgtggactacgttacgacncctaactctcctcgtcgaccactacggaactagtagttccgtaggtttagttaacttaatttacgtttacgttacctcgtaacgtaaccgaactacgacccaccgaacggtaacccaaacccgtaacccctaaacttacttaatttaacgttatacggtaatacaaatcgaccgtccgagtaggttactacgtaactcgtacttcgtacgtcgtactacggatcgtagaaccgtaaccgccgtacctaccggtagacccgtactacgttccgtacggtaccgtaccgtacgggtacgtaacggtacgggaccgtaacgggtacctaacgggtttacttaaaccgtttcgttaaccgcggttaccgtacgttacttaaccgaagtttaccttaaacgtactaacggtaaccttaacggttacggttaacggggttttcggaaacgggtaccggtaacggttacgtaaccgttacggtacccgttaacggtaacgtaccgtacccggaacgtccggtaaccccgtccggtttaccgacccgttccggttaaccgttcccg

SEQ ID NO: 236226 - DNA, 708 bp, Homo sapiens
  misc_feature: GYAE6OF02F2E21.14.3.A03.1.454.CMB.1.raw
  modified_base (269)..(269): a, c, t, g, unknown or other
  misc_feature (269)..(269): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacgagggtcctgggcccagtctgccctgactcagcctgcctccgtgtctgggtcctcctggacagtcgatcacatctcctgcactaggaacctagtagtgtacgtttggttaattattatttgtctcgtcggtacaacngcaccagacaaccgacccctaaactctatttacttatggtagtacaatacgtccggcctcgaggtactttactaatcgtcttctcgtcggtcctaccgtaagtcgtacggactaaaccgtccgaccctccgtagacgtactactccgtacggtcggtcctacggaggtcgtaagggacggacggacggtctacgtatttacttacgtcgacgtacgtacttataacgttaacttaacgttacgttacgacgttaaacgttaacggttttcgggtttacgggtttaccggggaaccgggtaacggggtaaccgttacggggtaccggtaccccggtttaacggtaacgggtacccgtaaccggtacccggtaaccggttcccggttacccggtacccccggtttacgggtacccttacccggttacccggtttcccccgg

SEQ ID NO: 236227 - DNA, 742 bp, Homo sapiens
  misc_feature: GYAE6OF02IWNLS.14.3.A03.1.454.CMB.1.raw
  modified_base (467)..(467): a, c, t, g, unknown or other
  misc_feature (467)..(467): n is a, c, g, or t
tcagcgtctagtaccacgaccggtgctcgatttagagagcgtcacgagggggggggtctcaggaggcagcgctctcaggacatctccaccatggcctgggctctgctgcctcctcaccctcctcactcgaggcacgagggtcctgggccctagtctcgccctgactcacgcctcgcctccgtgtcgtgggtctccgtgactcgtcgatccaccactcctcctgcctacgtacgaaccaggtagttcgtacgtttaggtttaattattaagttttcgttccttccgtacgtaacccaactacgccgaccgaacggaccaaccgaccccctaactctaatttattagtgagtactaatactccgcctagtaggtactttactatcttccttcgtcgtcgtctacctacgtcgtacgaccaacgtccgtaccctaccgtagacgtacctctttccgtcggtcggttcccncgtacgggtcggtacggaacgggtacggtacggtcggttacggttaacttaccgttagtacgtcgtacgtctacgtaacttaacgttacttaacgttacgaacgttacggttaaccggtttgggtttccggggtttacgggaacggggttaaccgggtaaccggtacgggttacccggttcccggtaaccggtccgggtaaccgtacccggtaccggttacgtcccgttacccggtacccccggtcgttaacccgttcccttcccgtttaccccg

SEQ ID NO: 236228 - DNA, 824 bp, Homo sapiens
  misc_feature: GYAE6OF02FTL4R.14.3.A03.1.454.CMB.1.raw
  modified_base (239)..(239): a, c, t, g, unknown or other
  misc_feature (239)..(239): n is a, c, g, or t
tcagcgtctagtaccacgaccggtgctcgatttagagagcgtcacgagggggggggtctcagggaggcagcgctctcaggacatctcccaccatggcctgggctctgctgctcctcaccctcctcactcgagggcacgagggtcctgggcccagtcctcgccctgactcagcctgccctcgtgtcgtgggtctccgtaggactagtcgactccaccattcctcctgcacgtcggaaccngttagtgtacgtttggttattattaagttttgtcctccgtacggtacaactacgccaacccgagaccgaaccaccccctaaactacgtatttatttagtagtacggtactaaacgttaacgtccggtacccgttacgacggtttacgtttaccttaacgttccggtccttttacctcgttcggtaccctaccgtaaacggttcgtacgggtaacctaaacccggacccgggtacccctttaccccgtacggaaccgggtaccctacgtttacccgttaccggttacggggtaaccctacccgtacgggtacccggttaggaacggggaccgtaacgggtacgtttaaccggtacgttttaacgttacgttaccggtaccgtacgtaccgttacgttacgtaatttaaaccgttacgttacgtaacgttaacggttaaccggttgggttttaacgggttacccgggtacgggtaaccgggtaaccgttacgggtacggtacccggttacggtacggtaccgtacccggtacgtaacggtcccgtacccgtacccggtccgtaccgttaccccgttcgttcccccgg

SEQ ID NO: 236229 - DNA, 578 bp, Homo sapiens
  misc_feature: GYAE6OF02F6WSH.14.3.A03.1.454.CMB.1.raw
  modified_base (210)..(210): a, c, t, g, unknown or other
  misc_feature (210)..(210): n is a, c, g, or t
  modified_base (430)..(430): a, c, t, g, unknown or other
  misc_feature (430)..(430): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctncactggaaccagtagtgacgttggttattataattttgtctcctggtaccaacagcacccaggcaaacgcccccaaactcatttatttatgaggtcaataatcggccctcgagtagtttctaatcgtcttctctggctcctaagtctggacaacacgcctccgtgagcatctcgtgggcctcgaggctaggaggacgtacggctgtaactttattaacgngctagctcagttactactagttacgctagtaacttggttacggtttcggcgggtacgacgagggttcacccggttcgtaggttccaacggacccgtaacgggcctcccgggtccccccgttacggttccaccgttccgttaccccggg

SEQ ID NO: 236230 - DNA, 749 bp, Homo sapiens
  misc_feature: GYAE6OF02GVC0L.14.3.A03.1.454.CMB.1.raw
tcagcgtctagtaccacgaccggtgctcgatttagagagcgtcacagggggggggtctcaggaggcagcgctctcaggacatctccaccatggcctgggctctgctgctcctcaccctcctcactcagggcacagggtcctgggcccagtctgccctgactcagcctgccctccgtgtctgggtctcctggacagtcgatcaccatctctgcactggaaccagtagtgtacgtttggttattattaattttgaccttcctaggtacctaaacgacgaccacccgaggacccaaaaccgacccccaaaacttcctaatttacgtttaagtgtaggtacctaaataaccgtccggcccctagtaacggtagtttacctaatccgtcttcctcgtcggtcctaccgtaagttcgtgggacaaccggaccggtccctcccgtagacgctatcctcgtacgggctaccggagtcgtacggaggtacggacggtgtagttagtttacgttacgtgcgtacgtaccgttactaacttaacgttaccttaacgttacgaacgtaacgtaacgttttcggggttaacgggttttccggggaggggttaaccggggaaccgttaaacggggtcccggtttaacccgggttcccggttaacgggttaccggaaacccggttaacccggaacggtttcccgggtcccccggtccccccggtttacccgggtacccttacccggttccctttaccccccggg

SEQ ID NO: 236231 - DNA, 611 bp, Homo sapiens
  misc_feature: GYAE6OF02GAIR8.14.3.A03.1.454.CMB.1.raw
  modified_base (222)..(222): a, c, t, g, unknown or other
  misc_feature (222)..(222): n is a, c, g, or t
  modified_base (281)..(281): a, c, t, g, unknown or other
  misc_feature (281)..(281): n is a, c, g, or t
  modified_base (347)..(347): a, c, t, g, unknown or other
  misc_feature (347)..(347): n is a, c, g, or t
  modified_base (423)..(423): a, c, t, g, unknown or other
  misc_feature (423)..(423): n is a, c, g, or t
  modified_base (447)..(447): a, c, t, g, unknown or other
  misc_feature (447)..(447): n is a, c, g, or t
  modified_base (464)..(464): a, c, t, g, unknown or other
  misc_feature (464)..(464): n is a, c, g, or t
tcagcgtctagtaccacgaccggtgctcgatttagagagcgtcacgagggggggggtctcaggaggcagcgctctcaggacatctccaccatggcctgggctctgctgctcctcacctcctcactcgagggcacgagggtcctgggcccagtctcgccctagactcacgcctcgccttccgtgtcgtggtcctcctggacagtcgatcacctatctctgctntacggaaccagtagtcgtacgttaggttattaattaatttcgtactcgtacgactaacncgacctaccgagaacaaaccgacccctaaactctaatttatttacgaggtacgtactaaattaacnccgtaccttcgaacggttattactaactcgtcttctctacggtctccgtacgtcgtcgacaaccgtcgtcctacgngacgctactctcggcgtctacggnggcgtgacggagtcgtntacgttatagttccgcgtcacgtctacgtaatactaataattcgaatgtaacttgggtacgttcggaacggacgtacggtcggtcaccgggttacaacggctaaccggcctaaggccttcccgccgtacgtcctacgtcccgttccc

SEQ ID NO: 236232 - DNA, 795 bp, Homo sapiens
  misc_feature: GYAE6OF02JDAWG.14.3.A03.1.454.CMB.1.raw
tcagcgtctagtaccacgaccggtgctcgatttagagagcgtcacgagggggggggtctcaggaggcagcgctctcaggacatctccaccatggcctgggctctgctgctcctccaccctcctcactcagggcacgacgggtccgtcgggccctagtcctcggccctagtacgtcacgccctcgtccctccgtgtccgttcgggtccttccgtacggactacggtcgccctaaccgattcctcccttggccaccgttgggaacccctaggttaggtcgaacggttttggtttacttaattaactttttggtaccttccgttcgggttaaccaacgacggtaccaaccccgtagggccaaaacggacccccccaaaagttccaacgtttttaatttagcggtaacggttaccaaagttaacggtccgggtaccctaccgaagggttacgttttaccgtaagttccgtactttccgtccgttacggacccgtttaccgaaacggtttccgttacgggacctaaaccggaaccgggtccctaaccccgtagtaccgtctaacgttccgttacggtcgggtacccttaccggacgggtcgtaaggaccggtacggtacggtcgttaacgttattacttacgcgtccaagtcttacacttactacttataccgagtaagtacgttcggttacgggtttcggaacggtacggacgtaacggtcgtaaccgtcgtaacggcccacggaccgtacggtcgttaccgtcccgtacgttaccgttacgtccttacccggttaccc

SEQ ID NO: 236233 - DNA, 637 bp, Homo sapiens
  misc_feature: GYAE6OF02G0ETX.14.3.A03.1.454.CMB.1.raw
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
  modified_base (458)..(458): a, c, t, g, unknown or other
  misc_feature (458)..(458): n is a, c, g, or t
  modified_base (464)..(464): a, c, t, g, unknown or other
  misc_feature (464)..(464): n is a, c, g, or t
  modified_base (500)..(500): a, c, t, g, unknown or other
  misc_feature (500)..(500): n is a, c, g, or t
tcagcgtctagtaccacgaccggtgctcgatttagagagcgtcacagggggggtctcaggaggcagcgctctcaggacatctccaccatggcctgggctctgctgctcctcaccctcctcactcagggcacagggtcctgggcccagtctcgccctgactcacgcctcgcctccggtgtcgtcgggtctccgtggacagtcgatccaaccatcctcgtgcacgtacggaaccaggtaggtcgtacgtttggttattaattacgttttcgtccttcgtacggtaaccaacacgacccaaccgacggtaccaaaaccgacccccaaactctaatttaattagagtacgtacaacttaacgtccgtacctacgaggttacttactaacgtcctcttccgtcgtcgcctaccgtagtcgacgacaacgccggtccctccganactcncttcctggtcggtcncgacgngtacgacggagcgtactagtaacgttacttacgtcncgtacgtctaactagtaactaacgttactagaactacgtacggttcggtttacgggttacgggacggtacggacggacgtcggaccttcggacgtcgaacgtccgagtcccgtccgcccgtcgcctcgttcctcccg

SEQ ID NO: 236234 - DNA, 1144 bp, Homo sapiens
  misc_feature: GYAE6OF02JWYLP.14.3.A03.1.454.CMB.1.raw
tcagcgtctagtaccacgaccggtgctcgatttagagagcgtcacgagggggggggtctcaggaggcagcgctctcaggacatctccaccatggcctggggcctctgtcgtcgtcctccctaccctaccccttcctaccacctcggacgggacacggtccgggtccggtccgggcccgtacgtccgtcccgtccctacgacctaccgaccgtcctcctcccgtccgttcggtcggtcggttccctcggtacggacgtaggtactactaccctaacctcttcccgtcgtcgaaccgtaccggtaacggtaaccgtaagggttacggttaacggtttacggttttaagtttaagttttaatttttacgtttttccgttcccgttaaccgttaaaccggtaaaccctaacggaacccgtacccccggaaaacccggaacccgggtaaaaccccctaaaaaccccccgtaaacccccttaaacctttaaatttttaaacgttttaaaccgttttaaggaaccggttaaacgttaaaccttaaaacccggtttacccggtaacccccgttaccggtaaaccgggttttagggttttaaaacccttaacgtttaaccgttcccggtttaaccgttttcccgttaccgggtacccggtttaaaccgtaaacccggtttaacggtcccgggttaaacccgaaaccccggttaaaccccggtcccccggtaacccgtttccccggtacgtaaacccggttaacccggttttaaccgtcccgggtttccggggaccccgtttaaccggtccccggggttaggtaagggtaaaccccgggtaacgggtaaacggtttccggtaaacggttttaccgtttaaaatttacccggtacgtccggaacccgtttaccgtaaccttaaagtaaaccgggtttaagttaaaacgtttacccggttacccgtttaaaccgttcccggtttaggggttttaccggggtttaccggggttaccgggaaaccggggaaccgttaacgaaccccgttcggtttacccggttaaccggtaccgaggtaaacccgggaaccccggttcgtaacccggtcccggtacccccggttcccgggttaaacttcccccggttcgtccccccgg

SEQ ID NO: 236235 - DNA, 713 bp, Homo sapiens
  misc_feature: GYAE6OF02G72FP.14.3.A03.1.454.CMB.1.raw
  modified_base (442)..(442): a, c, t, g, unknown or other
  misc_feature (442)..(442): n is a, c, g, or t
  modified_base (446)..(446): a, c, t, g, unknown or other
  misc_feature (446)..(446): n is a, c, g, or t
tcagcgtctagtaccacgaccggtgctcgatttagagagcgtcacagggggggggtctcaggaggcagcgctctcaggacatctccaccatggcctgggctctgctgctcctcaccctcctcactcagggcacgagggtcctgggcccagtctcgccctgactcagcctgcctccgtgtcgtggtctccgtggacagtcgactcaccatctcctgctacgtacggaaccagttaggtgtacggtttggttaatttattaagttttcgtcttccgttacggtaaccaactacgaccaccgacgacaaaccgtacccccaaactctaatttattatggtacgtacaagtacgtccggtcctagtaggttacgtttactaacgttccgtcttacgtcgtcggtcctacgtaacgtcgtacgacgaaccgtaccgtccctacccgngacnctacttccgtcggccgggtcctacggcggtacgtgggaacggacggtagtcttaaggttaccttaacgttccgtgaccgtacgtctactacgttaacgttacttaagttaacggacgttaaacggttaccgtttgggttttaaccggggttcgggaacggggtaccgaacggttacggtaccggtacccggttaacggtagtacccgtacggaccgtacggtcccgtccggtaccccgttacggtcccttaccggttccgtccccgg

SEQ ID NO: 236236 - DNA, 648 bp, Homo sapiens
  misc_feature: GYAE6OF02JHRHP.14.3.A03.1.454.CMB.1.raw
  modified_base (426)..(426): a, c, t, g, unknown or other
  misc_feature (426)..(426): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactcggaaccagtagtgtacgttggttaattattaattttgtctctgtaccaacagccaccaggacaacgacccccaaactctacttattatgtacggtacaataatccggaccctgaggtagttactaactcgtacttctcgtcggctacctaagttcgtacgaccaacgaccgtccctccctcgacgctacttccgtcgtcggtccgtaccgnggtcgtaggacggtacggacggtctagtagtttacttacgtcgtacgacgtctataattactacttacttacgacgtaacggtaacgttggtttacgggtttacggaacgggtacggtaaccgacgggttcggaccgttccggttaacggtcgaaccggtacccgtaaacggtcccgttacccggtaccccggttccggtccgttaccgttccgttaccccg

SEQ ID NO: 236237 - DNA, 1012 bp, Homo sapiens
  misc_feature: GYAE6OF02FR3X9.14.3.A03.1.454.CMB.1.raw
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
tcagcgtctagtaccacgaccggtgctcgatttagagagcgtcacagggggggggtctcaggaggcagcgctctcaggacatctccaccatggcctgggctctgctgctcctcaccctcctcactcagggcacagggtcctgggcccagtctcgccctgactcagcctgcctccgtgtctgggtctcgtggacagtcatcacnctctcctnaccacgtacgaaccagtagtcggtacggtttagtttaattatttaattttcgtccttccgtacggtaaccaactacgcccaaccggtcggaaccaaacccggaccccctaaactacccttaattttaacgtttagtacggtacggttaacctaaagttacgtacccggtacccttacggtaaggtttaaccgttttaactaacgttccgttacctttaccgttccggtgttacccgtacccgtaacggttccgttacggaacccgtaaccgggtaccccggtaccccgtttacccgacggtaaccggtacctaccggttttccgtacgggtttccgggtacccgttaccgggtacggtaaccgggttacggggaacccggggttacgggaacgggttaccgtttacggtttaaaacgttttaccggtttaaacgttcccggttacgtaaccggttaccgttaaacccgttacttttaaacccgttaaaccgttttaaacgtttaaaccgggttaccggttaaaaccggtttaaccggggttttcgggttttttaacccgggggttttaacccggggggttaaccgggggggttaaaccccgggttaaacccggggttaccgggtttaaccccggggttaacccggtttaacccggggttaacggggttaaccccggggtaacccccgggttaacccgggttaaccccggggtcccccgggtttaccccgggttacccccccccgggtttacggggtttaccccccgttaacccggttttccccggtttaaccccccccggg

SEQ ID NO: 236238 - DNA, 638 bp, Homo sapiens
  misc_feature: GYAE6OF02H2SE4.14.3.A03.1.454.CMB.1.raw
  modified_base (142)..(142): a, c, t, g, unknown or other
  misc_feature (142)..(142): n is a, c, g, or t
  modified_base (234)..(234): a, c, t, g, unknown or other
  misc_feature (234)..(234): n is a, c, g, or t
  modified_base (250)..(250): a, c, t, g, unknown or other
  misc_feature (250)..(250): n is a, c, g, or t
  modified_base (344)..(344): a, c, t, g, unknown or other
  misc_feature (344)..(344): n is a, c, g, or t
  modified_base (434)..(434): a, c, t, g, unknown or other
  misc_feature (434)..(434): n is a, c, g, or t
  modified_base (496)..(496): a, c, t, g, unknown or other
  misc_feature (496)..(496): n is a, c, g, or t
  modified_base (588)..(588): a, c, t, g, unknown or other
  misc_feature (588)..(588): n is a, c, g, or t
  modified_base (600)..(600): a, c, t, g, unknown or other
  misc_feature (600)..(600): n is a, c, g, or t
  modified_base (624)..(624): a, c, t, g, unknown or other
  misc_feature (624)..(624): n is a, c, g, or t
tcagcgtctagtaccacgaccggtgctcgatttagagagcgtcacgaggggggggtctcgaggaggcagcgctctcaggacatctccaccatggcctgggctctgctgcctcctcaccctcctcacctcgagggcctaacgngggtccctggggacccagtctcgccctagacctcacgcctcgccctccgttgtcgtcggcctaccgtggactaggtcgatccactatcctcngccacgtaggacagtntagtacgtttgtattacttagttttcgtcttccgtcggtaaccaactacgaccaccgaggtaccaaaccgacccctaatactaattactttagngtacgtaacaacgttacgtccgacctcgtagtacgttactacgtctacttcgtcgcgtactacgacgtcacggacaacgccgtcctccgngtacgctacgtcgtcgtggctaccggagtcgtacgacgtgacgtctagtaacttcgttacgngactaccgtatactaatacgttactataccgactaagtcggttagttcggttacgaacgggtacgacgtaacgtccgttacgcgtacggtancccgggtaaccngttaccgtccgacccgttcgaccnccgttcgtccccgg

SEQ ID NO: 236239 - DNA, 824 bp, Homo sapiens
  misc_feature: GYAE6OF02GSJC5.14.3.A03.1.454.CMB.1.raw
tcagcgtctagtaccacgaccggtgctcgatttagagagcgtcacgaggggggggtctcaggaggcagcgctctcaggacatctccaccatggcctgggctctgctgctcctcaccctcctcactcagggcacgagggtcctgggcccagtctgccctgactcagcctgcctcgtgtccgtgtcctcggacgacgtcgtactactaccactctccttcgacaccgtaacggtaacgtaacttagggtacgtacggtttacggttttagtttaaattaattttacgtttcgtaccttaccggtaaccgtaaccaacgtaccgacccgaacccgacggaaacccaaacccccgaaccccctaaacttactttaattttaacttaggaacgggttacgtaaactaaacgttaccggtccccgtaaccgttaggtaacgggttttactttaacgtaccgttccgttcccgttttacttccggtccgttacctaaccggttaacgttccggtaacgaaccgtaaacccggccgtttccccgttacgaggcctaccttacgtttcggttccgggtaccgggttcccgtaccggtcggttacggtacgggtaacggtaacgggtacgtacgttacgttaacgtttacgttacgtacgtacgtacgtactacgtaattaacttaacgttaacgtacgtacgtaacgttacgtttacggtttcgggttaaaaaacgggtcgggtaacggtacggtacgtacggtaccggtaccggtacgtacgtaccgtacgtaccgtaccgtcccgtccgtccgtacgtccgtccgttcccg

SEQ ID NO: 236240 - DNA, 647 bp, Homo sapiens
  misc_feature: GYAE6OF02GM98I.14.3.A03.1.454.CMB.1.raw
  modified_base (328)..(328): a, c, t, g, unknown or other
  misc_feature (328)..(328): n is a, c, g, or t
  modified_base (479)..(479): a, c, t, g, unknown or other
  misc_feature (479)..(479): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccatgtctgggtctcctggacagtcgatcaccatctcctgcactggaaccagtagtgacgttggttattataattttgtctcctggtaccaacagccacccaggacaaacgccccccaaaatcattaatttatgaggtacaaataactccggaccctnaggtagtttactaaacgtccgtcttctcgtggtcctaccgaagttctggacaaacgtaccggcctcccgtggacgctacgtcgtcgtgggtcctaccgaggtcgtaggacggtacgaggtcctagtaacttaattacgtgacaagtcctanaacgttaataacttagttaacgcgtaacgttaacgttgggtttacggtttacgggtacgggaccgggtacgtaacgggtacgtaaccggttacctacgggtaaccgaccggtacccggtaaggtcccgttaccggaccccccgtagggttaccctacccgttacccgg

SEQ ID NO: 236241 - DNA, 648 bp, Homo sapiens
  misc_feature: GYAE6OF02F2LJJ.14.3.A03.1.454.CMB.1.raw
  modified_base (220)..(220): a, c, t, g, unknown or other
  misc_feature (220)..(220): n is a, c, g, or t
  modified_base (263)..(263): a, c, t, g, unknown or other
  misc_feature (263)..(263): n is a, c, g, or t
  modified_base (365)..(365): a, c, t, g, unknown or other
  misc_feature (365)..(365): n is a, c, g, or t
  modified_base (403)..(403): a, c, t, g, unknown or other
  misc_feature (403)..(403): n is a, c, g, or t
tcagcgtctagtaccacgaccggtgctcgatttagagagcgtcacaggggggggtctcaggaggcagcgctctcaggacatctccaccatggcctgggctctgctgctcctcaccctctcactcagggcacagggtcctgggcccagtctgccctgactcagcctgcctccgtgtctgggtctcctggacagtcgatcaccatctcctgcactggaaccngtagtgacgttggttattagtaattttgtctcctgtaccaacngcaccaggacaaacgcccccaaactcaatttattatgaggtcaaataatcggcctcgtaggggtttctaactcgtcttctctcggctcgaagtctggacacncggccctcctgaccatctcgtcgggacttccgagtcgnggtaacggacggtacgttcgtagtaagtttacttagttacgtactaagtcctatattactcgacctaaccgtcggactaacggtactaacgtactagtttcggtttacgggttttaccgggggaccggggggtaccgtaaacggggtccggttaaccccgggttccgttacgggtacccgaaccggacccggtaacgggtccgtaccccgggtccccgttcccggtaccgtacccgtttccccgg

SEQ ID NO: 236242 - DNA, 738 bp, Homo sapiens
  misc_feature: GYAE6OF02I6E04.14.3.A03.1.454.CMB.1.raw
  modified_base (267)..(268): a, c, t, g, unknown or other
  misc_feature (267)..(268): n is a, c, g, or t
tcagcgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctcgtgtcgtgggtctccgtggacagtcgatcaccagtcctcctgcactggaaccagtagtgtacgttggttattattaattttgtctctgtaccaacnnccaccaggacaacgccccaatcattattatgagtcagtaacgtcggcctgtagggtttactaatcgtctttctcgtggtcctacctaagtcgtcggacaaccgaccggtccctacccgtgaccctattccgtccggtcgggaccttaccgacgggtctacgggtaacggaccgtacggttcgtacgttaatttaacgtttagttacgtacgtacgtaccgttcgttaaacttgttaccggacccttaacccgttcgggtaaccgtaaccgtaccgtaaccgttctaacgggtttcgggtttttacgggggtttacccgggggtacgggggtaaccgtacgggggttacccggtaacccgggtttaccggttaacggggttacccgtaacccgggtaacccggtaacgggttaccccggttaccccggccccccgggtttacggtacccgttaacccggttttcccccggg

SEQ ID NO: 236243 - DNA, 933 bp, Homo sapiens
  misc_feature: GYAE6OF02F73C6.14.3.A03.1.454.CMB.1.raw
  modified_base (225)..(225): a, c, t, g, unknown or other
  misc_feature (225)..(225): n is a, c, g, or t
tcagcgtctagtaccacgaccggtgctcgatttagagagcgtcacgaggggggggtctcaggaggcagcgctctcaggacatctcccaccatggcctgggctctgctgctcctcaccctcctcactgagggcacgtagggtcctgggtcccagttctcgccctgactcacgcctgcccttcggtcgttcgtcgggtctccgtcggacacggtcgactcaaccctnttccgtccggttcgaccgtaccgtaaggaaaccccgtaggttacggtcgttaacggttttggttaatttaacttttaaagttttcggttccttccggttaacggtaaccgaaaccgtacggtacccgaacccgaacggaacccgtaaaaaccccgtaacccccctaaacttaacgttaaacgtttaacgtttacggtacgggtaaacgttactaaaacgttaaccgtaccccggggtacccttacgtaacgggttacccgttttaataaccggttccggtttacttcgtttaccggtacggtttaccgacccttaagtccgttaacggaaccgtaacccgaccggttcccgtacgtacgtaccgctaccgttgtaccgtcgggactcggtacgtacgtacggacgtacggacgttacgtcgtaaacttcgtaaacgtcgtacgtacccgtcgtaactaaggttcctacggtaaccggtacgggtactaccgggtaaaacctaacggttaaccgttaaaccggttagggtttacgggttttacccggggggttaccggggggtaacgggtaaacccggtttaaacccggggtaacccggtttaacccggggtttaacctacccgggggtttaaccgaacccggttcccccgggttaaacggggtacccccgttttacccccggttccccggttacccgggtttaacccc

SEQ ID NO: 236244 - DNA, 159 bp, Homo sapiens
  misc_feature: GYAE6OF01CHSHQ.3.35.D02.1.454.CMB.1.raw
  modified_base (156)..(159): a, c, t, g, unknown or other
  misc_feature (156)..(159): n is a, c, g, or t
tcagagacgcactccacgaccggtgctcgatttagcacacgatagttggttgggctgaccaaggtcaccgtcctaggtcagcccaaggccaacccactgtcactctgttcccgcctcctcgagtgcgtctctgagcgggctggcaaggcgcatagnnnn

SEQ ID NO: 236245 - DNA, 159 bp, Homo sapiens
  misc_feature: GYAE6OF01CFN2U.3.35.D02.1.454.CMB.1.raw
  modified_base (159)..(159): a, c, t, g, unknown or other
  misc_feature (159)..(159): n is a, c, g, or t
tcagagacgcactccacgaccggtgctcgatttagcacacgatagttgggtttgggctgaccaaggtcaccgtcctaggtcagcccaaggccaacccactgtcactctgttcccaccctcctcgagtgcgtctctgagcgggctggcaaggcgcatagn

SEQ ID NO: 236246 - DNA, 160 bp, Homo sapiens
  misc_feature: GYAE6OF01BY1MW.3.35.D02.1.454.CMB.1.raw
  modified_base (160)..(160): a, c, t, g, unknown or other
  misc_feature (160)..(160): n is a, c, g, or t
tcagagacgcactccacgaccggtgctcgatttagcacacgatagttgggtttgggctgaccaaggtcaccgtcctaggtcagcccaaggccaaccccactgtcactctgtttccaccctcctcgagtgcgtctctgagcgggctggcaaggcgcatagn

SEQ ID NO: 236247 - DNA, 537 bp, Homo sapiens
  misc_feature: GYAE6OF01CWXBN.3.35.D02.1.454.CMB.1.raw
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
  modified_base (377)..(377): a, c, t, g, unknown or other
  misc_feature (377)..(377): n is a, c, g, or t
  modified_base (386)..(386): a, c, t, g, unknown or other
  misc_feature (386)..(386): n is a, c, g, or t
  modified_base (407)..(407): a, c, t, g, unknown or other
  misc_feature (407)..(407): n is a, c, g, or t
  modified_base (409)..(409): a, c, t, g, unknown or other
  misc_feature (409)..(409): n is a, c, g, or t
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
  modified_base (530)..(530): a, c, t, g, unknown or other
  misc_feature (530)..(530): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaaagcctcgtgtacggtgatgggaaaacacctaattgaattggtatcagcagaggccaggccaaatcnccaaggcncctaaatctataaaggttttcaaaccgggacgctggggtccccagacagattcagcggcactggtcaggcactnattcacacngagaatagagaggtgggaggngngaggagtgttggtagtttatttntgtcatgnaagacacacactacgacgtacgtacgttacgtcgtacgggaccggaacgacgaggagagtaacaaacgaaacgtaagtacggacgtagcnccactac

SEQ ID NO: 236248 - DNA, 502 bp, Homo sapiens
  misc_feature: GYAE6OF01CFGXC.3.35.D02.1.454.CMB.1.raw
  modified_base (402)..(402): a, c, t, g, unknown or other
  misc_feature (402)..(402): n is a, c, g, or t
  modified_base (491)..(491): a, c, t, g, unknown or other
  misc_feature (491)..(491): n is a, c, g, or t
  modified_base (495)..(495): a, c, t, g, unknown or other
  misc_feature (495)..(495): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggttctaacggacgctggggtccagacagattcagcggcactgggtcaggcactgatttcacactgagaattagcagggtgaggctgaggntgttggatttagttctgcatgcaagctacactactggccgtacacgtttggcctaggggacccaagcgtggagatcaaacgactgtggntgcncgattcc

SEQ ID NO: 236249 - DNA, 490 bp, Homo sapiens
  misc_feature: GYAE6OF01C5PUV.3.35.D02.1.454.CMB.1.raw
  modified_base (483)..(483): a, c, t, g, unknown or other
  misc_feature (483)..(483): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagagccaggcaatctccaagcgcctaatctataaggttctaaccggacgctggggtcccagacagattcagcggcactggtcaggcactgatttcacactgagaattagcaggtggagctgagatgttggattattctgcatgcaagctacactactgcgtacacgtttgccagggacccaagctggagatcaaacgactgtgactgcnccgatcg

SEQ ID NO: 236250 - DNA, 162 bp, Homo sapiens
  misc_feature: GYAE6OF01C2RHT.3.35.D02.1.454.CMB.1.raw
  modified_base (159)..(162): a, c, t, g, unknown or other
  misc_feature (159)..(162): n is a, c, g, or t
tcagagacgcactccacgaccggtgctcgatttagcacacgatagttgggtttgggctgaccaaggtcaccgtcctaggtcagcccaaggccaacccactgtcactctgttcccaccctcctcgagtgcgtctctgagcgggctggcaaggcgcatagnnnn

SEQ ID NO: 236251 - DNA, 163 bp, Homo sapiens
  misc_feature: GYAE6OF01DMJED.3.35.D02.1.454.CMB.1.raw
  modified_base (159)..(163): a, c, t, g, unknown or other
  misc_feature (159)..(163): n is a, c, g, or t
tcagagacgcactccacgaccggtgctcgatttagcacacgatagttgggtttgggctgaccaaggtcaccgtcctaggtcagcccaaggccaacccactgtcactctgttcccgccctcctcgagtgcgtctctgagcgggctggcaaggcgcatagnnnnn

SEQ ID NO: 236252 - DNA, 503 bp, Homo sapiens
  misc_feature: GYAE6OF01D367D.3.35.D02.1.454.CMB.1.raw
  modified_base (498)..(498): a, c, t, g, unknown or other
  misc_feature (498)..(498): n is a, c, g, or t
  modified_base (501)..(501): a, c, t, g, unknown or other
  misc_feature (501)..(501): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctgggtcccagacagattcagcggcactgggtcaggcactgatttcacactgagaattagcagggtggaggctgaggagtgttgggtatttatttctgcatgcaagctacactactggcgtacactttggccagggaccaagcgtggagatcaaacgaactagtgctgcnccntc

SEQ ID NO: 236253 - DNA, 510 bp, Homo sapiens
  misc_feature: GYAE6OF01A9ZOF.3.35.D02.1.454.CMB.1.raw
  modified_base (453)..(453): a, c, t, g, unknown or other
  misc_feature (453)..(453): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtccccagacagattcagcggcactgggtcaggcactgatttcacactgagaattagcagggtggaggctgaggatgttgggatttagtttctgcatgcaagctacacactggaccgtanacttttggccaggggaccaagcgtggagagtcaaacgaactagtgctgcaccgatcg

SEQ ID NO: 236254 - DNA, 534 bp, Homo sapiens
  misc_feature: GYAE6OF01D4NUZ.3.35.D02.1.454.CMB.1.raw
  modified_base (530)..(530): a, c, t, g, unknown or other
  misc_feature (530)..(530): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggttctaaccgggacgctgggtcccagacagatcagcggcactgggtcaggcactgatttcacactgagaattagcgagggtggaggcgtggaggagtggttagggtatttagtttctgtctatgcaagctaacactacgtcggaccgtactacgttttcggaccgtacggggaccaaggcgtaggagactacgaaacgactaggtgactagcctacgntacg

SEQ ID NO: 236255 - DNA, 516 bp, Homo sapiens
  misc_feature: GYAE6OF01EJC44.3.35.D02.1.454.CMB.1.raw
  modified_base (511)..(511): a, c, t, g, unknown or other
  misc_feature (511)..(511): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggcgtgaggagtgttgggatttagtttctgtcatgcaagctacacactggccgtacacttttggccgtaggggaccaagcgtggagagtcaaacgaactgtggctagctaccngtacg

SEQ ID NO: 236256 - DNA, 530 bp, Homo sapiens
  misc_feature: GYAE6OF01CXU3Z.3.35.D02.1.454.CMB.1.raw
tcagagacgcactccacgaccggtgctcgatttagcacacgatagttgggtttggggatcaggactcctcagttcaccttctcacaatgaggctccctgctcagctcctgggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataagtttctaacggacgctggggtcccagacagattcagcggcactgggtcaggcactgatttcacactgagaattagcagggtgagctgagatgttgggatttattctgcatgcaagctacacactggccgtacacgttttgccgaaggggaccaaggccgtagggagtaagttccgaaaaaccggtaacctaggtacggacttgacctaccgtagttacccg

SEQ ID NO: 236257 - DNA, 508 bp, Homo sapiens
  misc_feature: GYAE6OF01AZ11T.3.35.D02.1.454.CMB.1.raw
  modified_base (505)..(505): a, c, t, g, unknown or other
  misc_feature (505)..(505): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatggttgggatttagtttctgcatgcaagctacactactggccgtacactttggccagggaccaagcgtggagatcaaacgaactgtcggctagcaccntcg

SEQ ID NO: 236258 - DNA, 161 bp, Homo sapiens
  misc_feature: GYAE6OF01A7GUG.3.35.D02.1.454.CMB.1.raw
  modified_base (160)..(161): a, c, t, g, unknown or other
  misc_feature (160)..(161): n is a, c, g, or t
tcagagacgcactccacgaccggtgctcgatttagcacacgatagttgggtttgggctgaccaaggtcaccgtcctaggtcagcccaaggccaaccccactgtcactctgttcccgccctcctcgagtgcgtctctgagcgggctggcaaggcgcatagnn

SEQ ID NO: 236259 - DNA, 502 bp, Homo sapiens
  misc_feature: GYAE6OF01A5CMO.3.35.D02.1.454.CMB.1.raw
  modified_base (496)..(496): a, c, t, g, unknown or other
  misc_feature (496)..(496): n is a, c, g, or t
  modified_base (499)..(499): a, c, t, g, unknown or other
  misc_feature (499)..(499): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggatttatttctgcatgcaagctacacactgccgtacactttggccaggggaccaagcgtggagatcaaacgactgtggctgcnccntcg

SEQ ID NO: 236260 - DNA, 517 bp, Homo sapiens
  misc_feature: GYAE6OF01ARDAN.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcacgtggtcaggcactgatttcacactgagaattagcagggtggaggctgaggatggttgggtatttagtttcgtgctatgcaagtctacactactggcctactacgtttcggccaggggaccaagcgtggagatcgaaacgactgtcggctagcacctgtccg

SEQ ID NO: 236261 - DNA, 521 bp, Homo sapiens
  misc_feature: GYAE6OF01BNTT4.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaacggacgcgtgggtccagacagatcagcggcacgtggtcaggcactgatttcacactgagaattagcgagggtggaggcgtgaggagtgttgggtatttagtttctgtcatgacaagctacacactcggccgtacgtactttggaccgaggggaccaagcgtggagatacgaaacgaactcggtaggctagcaccgtagtcg

SEQ ID NO: 236262 - DNA, 542 bp, Homo sapiens
  misc_feature: GYAE6OF01BHZAN.3.35.D02.1.454.CMB.1.raw
tcagagacgcactccacgaccggtgctcgatttagcacacgatagttgggtttggggatcaggactcctctagttcaccttctcaacaagtgaggctccctgctcagctcctcgggctgctaatgctctgggtcccaggatccagtgggatgttgtggtgactcagtctccactctccctgcccgtcacccttggacagccggcctccatctcctgcaggtctggtcaaagcctcgtgtacggtgatggaaacacctacttgaattggtatcagcagagccaggccaatctccaaggcgcctaatctataaggtttctaaccggacgctggggtcccagacagattcgagcggcacgtgggtcaggcactgatttcacactgagaattagcgagggtggaggcgtgaggagtggttagggtatttaagtttctgctatgcaagctacactacgtcggaccgttactacgttttggccgacgggtacccaaaggtcgtggagagtaccgaaacgaacgtaggtcggactgccaccgagttccg

SEQ ID NO: 236263 - DNA, 517 bp, Homo sapiens
  misc_feature: GYAE6OF01DVOI3.3.35.D02.1.454.CMB.1.raw
  modified_base (513)..(513): a, c, t, g, unknown or other
  misc_feature (513)..(513): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggagtgttgggtatttatttctgcatgcaagctacactactggccgttacacgtttcggccgaggggaccaaggcgtaggagatcaaacgtactagtggactgcaccgntccg

SEQ ID NO: 236264 - DNA, 506 bp, Homo sapiens
  misc_feature: GYAE6OF01DZT93.3.35.D02.1.454.CMB.1.raw
  modified_base (503)..(503): a, c, t, g, unknown or other
  misc_feature (503)..(503): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctgggtcccagacagattcagcggcactgggtcaggcactgatttcacactgagaattagcagggtggaggctgaggatgttgggtatttatttctgctatgcaagctacacactggccgttacacgtttggccaggggaccaaggcgtggagatacaaacgaatgtgctgcacntcg

SEQ ID NO: 236265 - DNA, 501 bp, Homo sapiens
  misc_feature: GYAE6OF01DX4Q3.3.35.D02.1.454.CMB.1.raw
  modified_base (477)..(477): a, c, t, g, unknown or other
  misc_feature (477)..(477): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtccccagacagattcagcggcactgggtcaggcactgatttcacactgagaattagcagggtggaggctgaggatgttgggatttagttctgcatgcaagctacacactggccgtacactttggccaggggaccagcgtgganatcaaacgactgtgctgcncntcg

SEQ ID NO: 236266 - DNA, 503 bp, Homo sapiens
  misc_feature: GYAE6OF01EVGI5.3.35.D02.1.454.CMB.1.raw
  modified_base (500)..(500): a, c, t, g, unknown or other
  misc_feature (500)..(500): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggatttatttctgcatgcaagctacactactggccgtacactttggccaggggaccaagcgtggagatcaaacgactgtggctgcacntcg

SEQ ID NO: 236267 - DNA, 495 bp, Homo sapiens
  misc_feature: GYAE6OF01AU1TG.3.35.D02.1.454.CMB.1.raw
  modified_base (492)..(492): a, c, t, g, unknown or other
  misc_feature (492)..(492): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaacgggacgctggggtccagacagattcagcgcactggtcaggcactgatttcacactgagaattagcagggtgaggctgaggatgttgggattatttctgcatgcaagctacactactggccgtacactttggccaggggaccaaggctggagatcaacgatgtgcttgcacntcg

SEQ ID NO: 236268 - DNA, 528 bp, Homo sapiens
  misc_feature: GYAE6OF01B1YY4.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggcgtgaggatgttgggtatttatttctgctatgacaagctacactacctggacccgttacacttttgggccctaaggggaccaaaggcgtgggaagagtacgaaacgaactggtggactgcaccagtcg

SEQ ID NO: 236269 - DNA, 561 bp, Homo sapiens
  misc_feature: GYAE6OF01CFMW5.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaagcgcctaatctataaggttctaaccgggacgctgggtcctagacagattcgagtcggcacgtggtcaggcactgatttcacactgagaattagcgagggtgaggtctaggaggtagttggttgggtattttgtttcgtgtctagtgacaagtctacactacgtcggcctacgtacgtttcggccgtacggggacctaaggccgtagggaagtacgtaaccgaaacggtaacgttcgtacgggaccttagcctaaccgtgttacccg

SEQ ID NO: 236270 - DNA, 160 bp, Homo sapiens
  misc_feature: GYAE6OF01CDMUO.3.35.D02.1.454.CMB.1.raw
  modified_base (160)..(160): a, c, t, g, unknown or other
  misc_feature (160)..(160): n is a, c, g, or t
tcagagacgcactccacgaccggtgctcgatttagcacacgatagttgggtttgggctgaccaaggtcaccgtcctaggtcagcccaaggccaaccccactgtcactctgttcccaccctcctcgagtgcgtctctgagcgggctggcaaggcgcatagn

SEQ ID NO: 236271 - DNA, 530 bp, Homo sapiens
  misc_feature: GYAE6OF01BLQRA.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtgggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctgggtccagacagattcagcgcactgggtcaggcactgattcacactgagaattagcagggtggaggctgaggatgttgggatttattctgcatgcaagctacactacgtcgccgtactacgtttcggccgaacggggaccaaggcgtagggagacttacgaaaacggtactggtacggcgttaggccaaccgtattccg

SEQ ID NO: 236272 - DNA, 552 bp, Homo sapiens
  misc_feature: GYAE6OF01A52AG.3.35.D02.1.454.CMB.1.raw
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgtggtctctggattcaccttcagggaccacttcatggactgggtccgccaggctccagggaaggggctggagtgggttggccgtataagaaacaaagctagaagttacaccacagattacgccgcgtctgtgacaggcagattcaccatctcaagagatgattcaagcaactcagtgtctctgcaaatgaacaccctgaagaccgaggacacggccgtctattactgcgctacagattcatattggagctacgactacgtgggccacggagaccgtggtccaccgtctcctcacgcctcccaccgaacgggccccacgtccggtccttcccccgtcgggcccgccccgtcgcctcccgacggacgccacccgtcccgagcgaccg

SEQ ID NO: 236273 - DNA, 544 bp, Homo sapiens
  misc_feature: GYAE6OF01B4IT9.3.35.D02.1.454.CMB.1.raw
  modified_base (539)..(539): a, c, t, g, unknown or other
  misc_feature (539)..(539): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcgagggtggaggcgtgagggtagtggttggggtatttagtttctggtcagtgcaaaggcctaacacgtacgtcggccgttactacgttttcggaccgtaggggacccaaagcgtgggagacgtacaaacgtaactgtggctaggcaccgnttccg

SEQ ID NO: 236274 - DNA, 573 bp, Homo sapiens
  misc_feature: GYAE6OF01DW977.3.35.D02.1.454.CMB.1.raw
  modified_base (323)..(323): a, c, t, g, unknown or other
  misc_feature (323)..(323): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggcaatctcaagcgcctaatctataaggttctaacgggacnctgggtcccagacagattcagcgcactgggtcaggcactgatttcacactgagaattagcgagggtggaggcgtgaggatgttagggtatttagtttctgtctagtgacaagtctaacactacgtcggtaccgttactacgttttcgggaccgtaaggggtacccaaaggtccgtacgggtaagtaacgttaccgaaaaaccgggtaacgtacgggtacggtcgtacggacctaacccgtagttacccgg

SEQ ID NO: 236275 - DNA, 512 bp, Homo sapiens
  misc_feature: GYAE6OF01BB50M.3.35.D02.1.454.CMB.1.raw
  modified_base (508)..(508): a, c, t, g, unknown or other
  misc_feature (508)..(508): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaggcgcctaatctataaggtttctaaccgggacgctggggtcccagacagattcagcggcactgggtcaggcactgatttcacactgagaattagcagggtggaggcgtgaggagtgttgggtatttattctgctatgcaagctacacacgtggccgtactacgtttcggccaggggaccaaggcgtggagatcaaacgactgtgctagcacgtntccg

SEQ ID NO: 236276 - DNA, 552 bp, Homo sapiens
  misc_feature: GYAE6OF01BJP22.3.35.D02.1.454.CMB.1.raw
  modified_base (532)..(532): a, c, t, g, unknown or other
  misc_feature (532)..(532): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgtggtctctggattcaccttcagggaccacttcatggactgggtccgccaggctccagggaagggctggagtgggttggccgtataagaaacaaagctagaagttacaccacagattacgccgcgtctgtgacaggcagattcaccatctcaagagatgattcaagcaactcagtgctctgcaaatgaacaccctagaacgaccgaggacacggccgtctattactgcgctacagattcatattggagctacgactacgtgggccacggacgaccgtggtccaccgtcctcctcacgccctccacccaacgggcccacgtccggtcccttcccccgtcggccgcccctcgccctcccacgggccnccaccctcccgagcgacccg

SEQ ID NO: 236277 - DNA, 533 bp, Homo sapiens
  misc_feature: GYAE6OF01BVQC5.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggccgtccatctcctgcaggtctggtcaaagcctcgtgtacggtgatggaaacacctacttgaattggtatcagcagaggccaggccaatctccaaggcgcctaatctataaggtttcaaccgggacgctggggtcccagacagattcagcggacacgtgggtcaggcactgatttcacactgagaattagcgagggtggaggcgtagaggatggttgggtatttatttctgtcatgcaagactacacacgtcggaccgtactactttggaccgtagggaccaaggcgtggaagagtaacaaacgaacgtagtacggctagccacgtactacg

SEQ ID NO: 236278 - DNA, 520 bp, Homo sapiens
  misc_feature: GYAE6OF01C2S41.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctcaaggcgcctaatctataagttctaaccgggagctgggtccagacagattcagcggcactggtcaggcaactgatttcacactgagaattagcaagggtgaggctgaggagtgtgggatttatttctgcatgcaagactactacactggtccgtaacacgttttgccgtaggggaccaagcgtggagattacgaaaacgtaacgtagtcggcttagccgaccattaccg

SEQ ID NO: 236279 - DNA, 541 bp, Homo sapiens
  misc_feature: GYAE6OF01D7QPI.3.35.D02.1.454.CMB.1.raw
  modified_base (537)..(537): a, c, t, g, unknown or other
  misc_feature (537)..(537): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgcgtgggtcccagacagattcagcggcacgtgggtcaggcactgatttcacactgagaattagacgagggtggaggcgtaggaggtagttggttagggtattttagtttcgtgtcgtatgacaagctacacacgtcggtccgttactacgtttcggaccgacgggaccaagcgtaggagagtacaaacgtaacgtgtagcgtagacaccntacg

SEQ ID NO: 236280 - DNA, 594 bp, Homo sapiens
  misc_feature: GYAE6OF01CX43S.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccaggtggggatgttgtggtgactcagtctccactctccctgcccgtcacccttggacagccggcctccatctcctgcaggtctggtcaaagcctcgtgtacggtgatggaaacacctactgaaattggtatcagcagaggccaggccaatctccaaggcgacctaatctataaggtttctaaccgggacgctggggtcccagacagattcgagcggcacgtgggtcaggcacgtgtatttcacactgagaattagcgagggtggaggctgaggtatggttgggtattttattctgtcattgacaagtctaacgactacgtcggacccgttacgtacgttttcgggacccgtaacggggaccctaaggtccgtagggaaggtaacgtaaccgtaaaaacccggtaacgttacgggttacgggtaccgttacgggaccctacccgtagtttacccg

SEQ ID NO: 236281 - DNA, 554 bp, Homo sapiens
  misc_feature: GYAE6OF01CQVW5.3.35.D02.1.454.CMB.1.raw
  modified_base (325)..(325): a, c, t, g, unknown or other
  misc_feature (325)..(325): n is a, c, g, or t
  modified_base (342)..(342): a, c, t, g, unknown or other
  misc_feature (342)..(342): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctgggagggtccctgagactctcctgtgtggtctctggattcaccttcagggaccacttcatggactgggtccgccaggctccgagggaaggggctgggagtgggttggccgtataagaaacaagctagaagttacaccacagattacgccgcgtctgtgacaggcagattcaccatctcaagngatgattcaagcaactnagtgtctctgacaaatgaacacctgaagaccgagacacggctntatcngcgctacagattcatagtgagctacgactacgtgggccaacggagaccgtggtaccaccgtcctacctcgacgccctaccaccgaacggcccacgtccggtccttcccccgtcggcccgtccccgtcgccctccgacggtacgccgaccctccgacgcgacccg

SEQ ID NO: 236282 - DNA, 536 bp, Homo sapiens
  misc_feature: GYAE6OF01AJG5B.3.35.D02.1.454.CMB.1.raw
  modified_base (528)..(528): a, c, t, g, unknown or other
  misc_feature (528)..(528): n is a, c, g, or t
tcagagacgcactccacgaccggtgctcgatttagcacacgataggttgggtttgggggatcaggactcctcagttcaccttctcacaatgaggctccctgctcagctcctggggctgctaatgctctgggtcccaggatccagttggggatgttgtggttgactcagtctccactcgtcccctgccccgtcacccttggacaggccggcctccatctcctgcaggtctggtcaaagcctcgtgtacggtgatggaaaccacctacttgaattggtatcagcagaggccaggccaatctccaaggcgcctaatctataaggtttctaaccgggacgctggggtcccagacagattcagcggcactgggtcaggcacgtgatttcacactgagatagcagggtggaggctggaggtatggttgggtatttagtttctgctatgacaagctacacgtactcggccttactacgtttcggccgtaggggaccaagcgtggacgactccaaacgacgttgtcggtctacgcncgtgtccg

SEQ ID NO: 236283 - DNA, 715 bp, Homo sapiens
  misc_feature: GYAE6OF01CF2L8.3.35.D02.1.454.CMB.1.raw
  modified_base (286)..(286): a, c, t, g, unknown or other
  misc_feature (286)..(286): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctcctgcccgtcacctgacagccgctccatctctgcaggtctggtcaaagcctcgtgtacggtgactggaaacacctacttgatggtatcagcagagcaggcaatctacagcncctaatctataagttcaaccggacgcgtcgggtccagacagattcaacgcggactacgtgggcgaaggccactgtaacttttccgaactaacgtacgaacggtaaacgtttaacggaccgggtaaggggttacggggaacgggtacccggttaacgggtaaacggggtaagtttaggggtttagggggtttaaacgttttttaacgtttttacccgttaggtaccgtaagtttacggaaccgtaaacggtaccgttaaccgaaccgtaaccgttaccggtaccggtttaaccgttaccggtttttacgggaacccggtaacgggggtaaacccgaaacggtaccggtacgggtaaggaaccgttaaccggtaaaaccgaaccgttacggtacgggtacctaccgggtaccctacccgaacgtttacccg

SEQ ID NO: 236284 - DNA, 557 bp, Homo sapiens
  misc_feature: GYAE6OF01E4Z0U.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgataggaaaccacctacttgaattggtatcagcagaggccaggccaatctccaagcgcctaatctataaggtttctaaccgggacgcgtcgggtcccagacagattcagcggcacgtcggtcgaggcactgatttcactactgagaattagcgagggtggaggtcgtaggaggtagtggttgggtattttatttcgtgctagtgacaagtactacacgtacgtggttaccgtactacgtttcggccgtacggggaccaaggtcgtggagtaacgtaccgaaacgtaacgtacggtggactagctaccagttccg

SEQ ID NO: 236285 - DNA, 551 bp, Homo sapiens
  misc_feature: GYAE6OF01BHA5H.3.35.D02.1.454.CMB.1.raw
  modified_base (514)..(514): a, c, t, g, unknown or other
  misc_feature (514)..(514): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggcaatctccaagcgacctaatctataacggtttctaaccgggacgcgtcggggtccagacgagattcgagcggcacgtgggtcaggcactgactttcacactagaagtaattagcgagggtggaggcgtaggaggagtggttgggtatttatttcgtgcagtgactaagactacgacgtacgtcggtccgtacgtacgtttcggaccgtagggacccaagccgtacggganacgtcaaaacgactaggtcgactagcaccgagttccg

SEQ ID NO: 236286 - DNA, 512 bp, Homo sapiens
  misc_feature: GYAE6OF01B7BW2.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatggttgggatttagtttctgcatgcaagctacactactggccgtactactttggccgagggaccaagccgtggagatcgaaacgaactgtggctagcaccgtatcg

SEQ ID NO: 236287 - DNA, 575 bp, Homo sapiens
  misc_feature: GYAE6OF01C8AXW.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcacgtgggtcaggcactgatttcacactgagtaattagcgagggtggaggctaggaggatggtttagggtattttatttcgtgtctagtgacaagtcctaccaacgtacgtacggccgttaactacgttttcggacccgtaacggggaccctaaggccgtagggaggaacttaccgaaaaccggaacttaggtacgggactaggaccacccgtagttacccg

SEQ ID NO: 236288 - DNA, 575 bp, Homo sapiens
  misc_feature: GYAE6OF01CY3MD.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcacgtgggtcaggcactgatttcacactgagtaattagcgagggtggaggctaggaggattggttgggtattttagttctgcagtgacaagctaacactacgtcggtccgttaactacgttttggacccgtaggggaacccaaggtaccgtagggaagtaacgttaaccgaaaaccggtaaacgttcggttacgggtactaggacccaaccgtacgttacccg

SEQ ID NO: 236289 - DNA, 558 bp, Homo sapiens
  misc_feature: GYAE6OF01A8EDX.3.35.D02.1.454.CMB.1.raw
  modified_base (400)..(400): a, c, t, g, unknown or other
  misc_feature (400)..(400): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgcgtggggtcccagacagatcagcgcacgtgggtcaggcactgtatttcacactgagaagttgaaaaaaacgngggtaggaggcgtggaggtagtggttgggtagtttatttcgtgtctagtgtcaagactacgactactcggtaccgtacgtacgtttcggtaccgtacggggaccgtaagcgtaggaggacgtacgaaacgaacgtagtcggacgtagctaccgtgtcg

SEQ ID NO: 236290 - DNA, 516 bp, Homo sapiens
  misc_feature: GYAE6OF01BCSGU.3.35.D02.1.454.CMB.1.raw
  modified_base (512)..(512): a, c, t, g, unknown or other
  misc_feature (512)..(512): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagaccagattcagcggcactgggtcaggcactgatttcacactgagaattagcgagggtggaggctggaggatgttagggtatttagtttctgcatgcaagctacacgactcggccgtactacgtttcggccgagggaccaagcgtggagagtcaaacgaactgtgactgcacngtcg

SEQ ID NO: 236291 - DNA, 551 bp, Homo sapiens
  misc_feature: GYAE6OF01EV79L.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctgatcaaagcctcgtgtacggtgatggaaacacctacttgaattggtatcagcagaggccaggccaatctccaaggcgcctaatctataaggtttcaaccgggacgcgtcggggtcccagacagtattcagtcggcacgtgggtcaggcacgtgtattcactacgtgaagtaattagacgtaggggtggaggtcgtaggaggtagttggttagggtattttagtttctgtctagtgactaacgcgtacacgacgtcggaccgttactacgtttggaccgacgggacaggcgtaggacgagtacgaaagacgtggacgactgcgacgtacg

SEQ ID NO: 236292 - DNA, 529 bp, Homo sapiens
  misc_feature: GYAE6OF01BR0HA.3.35.D02.1.454.CMB.1.raw
  modified_base (242)..(242): a, c, t, g, unknown or other
  misc_feature (242)..(242): n is a, c, g, or t
  modified_base (294)..(294): a, c, t, g, unknown or other
  misc_feature (294)..(294): n is a, c, g, or t
  modified_base (326)..(326): a, c, t, g, unknown or other
  misc_feature (326)..(326): n is a, c, g, or t
  modified_base (382)..(382): a, c, t, g, unknown or other
  misc_feature (382)..(382): n is a, c, g, or t
  modified_base (408)..(408): a, c, t, g, unknown or other
  misc_feature (408)..(408): n is a, c, g, or t
  modified_base (498)..(498): a, c, t, g, unknown or other
  misc_feature (498)..(498): n is a, c, g, or t
tcagagacgcactccacgaccggtgctcgatttagcacacgatagttgggtttggggatcaggactcctcagttcaccttctcacaatgaggctccctgctcagctcctggggctgctaatgctctgggtcccaggatccagtggggatgttgtggtgactcagtctccactctccctgcccgtcacccttggacagccgcctccatctcctgcaggtctggtcaaagcctcgtgtacggtnatggaaacactactgaattggtatcagcagaggccaggccaatctccaagcncctaaatctaataacggttttcaaccgggacnctgggtacccagacagaattcagcggcactggtcaggcactgaatttcacactganaattagcgagggtgaggctgaggtangtttgggtatttagtttctggctatacgcaagcctacactacgtacggaccgtactacgttttacggccgtagggaccaagccgtggaanatacaaacgaactgtacgctagcacattccg

SEQ ID NO: 236293 - DNA, 603 bp, Homo sapiens
  misc_feature: GYAE6OF01CLKXJ.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtgggggatgttgtggtgactcagtctccactctccctgcccgtcacccttggacagccggcctccatctcctgcaggtctggtcaaagcctcgtgtacggtgataggaaaacacctacttgaattggtatcagcagaggccaggccaatcaccaaggcgacctaatcctaataaggtttccaaccgggacgcgtggggtcccagacaggattcgagcggcacgtggtcaggcactgatttcactactagaagtaattaggacgtaggggtgggagggtctagggaagggtagttgggttaggggttacttttagtttcgtggtctagtgacgaagactaacacgtacgtcggtacctaacgttaccgttttacggaccggtaaggggaccaaaggtccgtagggagtaactaaccgaaaacggtaacgttgggtacgtacgaggaccacgtacgttaccg

SEQ ID NO: 236294 - DNA, 553 bp, Homo sapiens
  misc_feature: GYAE6OF01DXBYD.3.35.D02.1.454.CMB.1.raw
  modified_base (548)..(548): a, c, t, g, unknown or other
  misc_feature (548)..(548): n is a, c, g, or t
tcagagacgcactccacgaccggtgctcgatttagcacacgatagttgggtttgggggatcaggactcctcagttcaccttctcacaatgaggctccctgctcagctcctgggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagagcaggccaatctcaaggcgctaatctataggttctaacggacgcgtgggtcccagacagattcgagcggcacgtgggtcaggcacgtgtactttcaacactgaagtaattagacgtaggggtgggaggctaggaggagttggttgggtaattttatttctggtctatgacaagcctacacgtacgtcggtacccgtactcgttttcggccgaacgggaccaagtcgtggtaagacgtaacgaaacgtaacgtggtacggactcgacaccgtnttacg

SEQ ID NO: 236295 - DNA, 535 bp, Homo sapiens
  misc_feature: GYAE6OF01D6OMQ.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctaccaaggcgcctaatctaataaggtttctaacgggacgctgggtcccagacagattcagcggcactgggtcaggcactgatttcacatgagaattagcgagggtggaggcgtagaggagtggttgggtatttagtttctgctatgacaagctacgactacgtcggaccgtacgtactttcggacctagggacccgaagcgtcggagatacgaaacgtaacgtgtcggacgtagacaccgtatcg

SEQ ID NO: 236296 - DNA, 504 bp, Homo sapiens
  misc_feature: GYAE6OF01CK91B.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggttctaacgggacgctgggtccagacagattcagcggcactgggtcaggcactgatttcacactgagaattagcagggtggagcgtgaggatgttgggtatttatttctgcatgcaagctacacacgtcgcgtactactttggccaggggaccaagcgtggagagtcaaacgactgtcggacagcacgatcg

SEQ ID NO: 236297 - DNA, 163 bp, Homo sapiens
  misc_feature: GYAE6OF01BPHA3.3.35.D02.1.454.CMB.1.raw
  modified_base (160)..(163): a, c, t, g, unknown or other
  misc_feature (160)..(163): n is a, c, g, or t
tcagagacgcactccacgaccggtgctcgatttagcacacgatagttgggtttgggctgaccaaggtcaccgtcctaggtcagcccaaggccaaccccactgtcactctgttcccgccctcctcgagtgcgtctctgagcgggctggcaaggcgcatagnnnn

SEQ ID NO: 236298 - DNA, 546 bp, Homo sapiens
  misc_feature: GYAE6OF01CII5L.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggttctaacgggacgctgggtccagacagattcagcggacacgtggtcaggcactgatttcacactgaagaattagcgagggtggaggcgtgagagtgttagggtatttagtttctgctatgacaagactacaacgtacgtacggtccgttactacgttttcgggaccgtaacggggaaccaaggacgtaggaagaacgtacgaaacgtaacgtgtacggcagcaccgagttccg

SEQ ID NO: 236299 - DNA, 510 bp, Homo sapiens
  misc_feature: GYAE6OF01BBG9D.3.35.D02.1.454.CMB.1.raw
  modified_base (506)..(506): a, c, t, g, unknown or other
  misc_feature (506)..(506): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaacgggacgctggggtcccagacagattcagcggcactgggtcaggcactgatttcacactgagaattagcagggtgaggctgaggatgttgggatttatttctgcatgcaagctacactactggccgtactacttttggccaggggaccaaggcgtggagatcaaacgaactgtcggctagcaccgntccg

SEQ ID NO: 236300 - DNA, 515 bp, Homo sapiens
  misc_feature: GYAE6OF01AJW8F.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctcaagcgcctaatctataaggtttctaaccgggacgctggggtcccagacagattcagcggcactgggtcaggcactgatttcacactgagaattagcagggtggaggctgaggagtgttgggtatttatttctgcatgcaagactacacactggccgtacacttttggccgtagggaccaagcgtggagaatacaaaacgaacctggtaggctagcaccatccg

SEQ ID NO: 236301 - DNA, 522 bp, Homo sapiens
  misc_feature: GYAE6OF01EDP6Y.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtccagacagattcagcggcactgggtcaggcactgatttcacactgagaattagcgagggtggaggctgaggatgttgggtatttagtttctgtcagtgcaagctacacacgtcgccgtactacttttggccgaggggaccgaagcgtgggagagtacaaacgtaacgtagtgggactgcaccatccg

SEQ ID NO: 236302 - DNA, 626 bp, Homo sapiens
  misc_feature: GYAE6OF01C1ROG.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccaatggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcacctaatctataaggttctaaccgggacgctgggtccagacagatcagcggcacgtggtcaggcactgtatttcactactagaagaattaggcgtagggtggaggcgtaggaggtagtgggtttagggtaattttagtttcgtagtcagttgacaagtctaaccaacgtaccgtcggtacccgttaacgttaccgttttacgggaacccggtaacgggggaaccctaacgggaccgttaggggaaagtaacggttaacccgtaaaaaccggtacgttaacgggtacgggttacccgtagggtaccccaacccgtacgttttaacccgg

SEQ ID NO: 236303 - DNA, 542 bp, Homo sapiens
  misc_feature: GYAE6OF01AY8GQ.3.35.D02.1.454.CMB.1.raw
  modified_base (328)..(328): a, c, t, g, unknown or other
  misc_feature (328)..(328): n is a, c, g, or t
tcagagacgcactccacgaccggtgctcgatttagcacacgatagttgggtttgggggtagtcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacactacttgaattggtatcagcagaggccaggccaatctccaaggcgcctaatctataaggtttctaaccggganctggggtcccagcagattcagtcggcactgggtcaggcactgatttcacactgagaacttagcgagggtaggaggctggaaggatagggttgggtatttaagtttcttgctatgtcaagtctaacactactggccgttacaccgttttggccgaacggggacctaacgcgttggaggaatcgaaaacgaactacgtggactaggcaccgtgtcg

SEQ ID NO: 236304 - DNA, 549 bp, Homo sapiens
  misc_feature: GYAE6OF01DJKRG.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaaggcgacctaatctaattaaggtttactaaccgggacgcgtggggtcccagacagatcgagcggcacgtggtcaggcactgtatttcacactagagaattagcgagggtggaggctaggaggtagtggttaggtatttagtttctgctatcgacaacgctacactacgtcggtcgtactacgtttcggaccgtacggggaccaaggcgtaggagaactaacgaaacgtaatggtcggctagaccactagttccg

SEQ ID NO: 236305 - DNA, 599 bp, Homo sapiens
  misc_feature: GYAE6OF01EQ7WD.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgataggaaacacctacttgaattggtatcagcagaggccaggaccaatctaccaaggcgacctaatctaataaggtttactaaccgggacgcgtcgggtccagacagattcagcggcacgtgggtcaggcacgtgtatttcacactgaagaattagacgtaggggtggaggtcgtaggaggtattgggttgggttagttttagtttcgtgtctagtcgacgaagtacctaacgactacgtcggtacccgttaacctacgttttcggaccgtaacggggaaccgaaggtacgtagggaagtaacgtaaccgaaaacgtaacgttacgggtacggtacgtagaccaccgtattaccgg

SEQ ID NO: 236306 - DNA, 664 bp, Homo sapiens
  misc_feature: GYAE6OF01CK2W1.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtccacccttggacagccggcctccatctcctgcaggtctggtcaaagcctcggtgtacggtgataggaaacacctacttagaattggtatcagcagaggccaggccaactcctaccgaaggccgacctaattctaagttaaggttttaccgaaccgggacggtcgtcggggtacccaaggaactaggtacttacgaacggccggtacgaacgtgggtaccgaggtcctaacgtgtaactttcgacaacttagaacgtaagttacggacgaggggttaggaggtcgtaggaagggtagtgggtttagggtaattttagtttcgtgtactagtagacgaacggtacctacgtaaccgtaccgttgggtacccgttacgttaccgttttcgggacccggtaacggggaacctaaggccgttagggaagtaacgtaacgaaaccggtaacgttgggtacggacttacgaccaccgtattaccgg

SEQ ID NO: 236307 - DNA, 564 bp, Homo sapiens
  misc_feature: GYAE6OF01B93GT.3.35.D02.1.454.CMB.1.raw
  modified_base (559)..(559): a, c, t, g, unknown or other
  misc_feature (559)..(559): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccgaaggcgacctaatctataaggtttcgtaaccgggacgcgtcgggtccagacagattcagcggcagtgggtcaggcacgtgtattcacactagagaattagcgagggtggaggcgtaggaggtagttggttagggtattttagtttctgactagtgcaacgctacacctacgtcggtacccgttactacgttttcggacccggtaaggggacccaaggtcgtagggtagaactacgaaacgtaacgtggtcggctacgctaccgtnttacg

SEQ ID NO: 236308 - DNA, 582 bp, Homo sapiens
  misc_feature: GYAE6OF01CMDU0.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtacaaagcctcgtgtacggtgataggaaacacctacttgaattggtatcagcagaggccaggccaatctccgaaggcgacctaatctataacggtttcaaccgggtcgcgtcgggtccagacagattcagcggctacgtgggtcaggcactgacttcacactagagtaattagcgagggtggaggcgtaggaggtagtggtttagggtattttattcgtgtacgtatacgtactaagactacacgtacgtacggtaccgttaaccttacgtttcgggacccgtaggggtaacccaaggtacgtacgggagtaagtaccgaaacggtacgttggtacggctagccctaccgtagttccg

SEQ ID NO: 236309 - DNA, 549 bp, Homo sapiens
  misc_feature: GYAE6OF01DWTCI.3.35.D02.1.454.CMB.1.raw
  modified_base (546)..(546): a, c, t, g, unknown or other
  misc_feature (546)..(546): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacgtgatggaaacacctactgaattggtatcagcagaggccaggccaatctcaaggcgcctaatctataaggtttctaaccgggacgcgtcggggtccccagacagattcagcggcacgtgggtcaggcactgatttcacactgaagaattagacgaggggtgggaggcgtggaggagttgggttgggtattttatttacgtgctagtgacaagctaacactacgtcggccgttactacgttttcggcccgtaaggggaccgagcgtaggagagtaccgaaaacgtactacggtggactgacaccgtntcg

SEQ ID NO: 236310 - DNA, 562 bp, Homo sapiens
  misc_feature: GYAE6OF01BNU0J.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctcaggcgcctaatctataaggtttctaaccgggacgctggggtcccagacagattcagcggcactgggtcaggcactgatttcacactgagaattagcgaggggtggaggcgtggaggtagtggttgggtatttagtttctgtctatgacaagactacacgtacgtggtacccgtacgtacgtttcggaccgtacggggacctaaggtcgtagggtaagaacgtaccgaaaccgtaacgtacggtagggaccgtaggccaccgtagttcccg

SEQ ID NO: 236311 - DNA, 578 bp, Homo sapiens
  misc_feature: GYAE6OF01EJRP4.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagagccaggccaatctccaaggcgacctaatctaataaggtttcaaccgggacgcgtcgggtccagacagattcagcggacactgggtcaggcactgatttcacactgagattagagtagggtggaggtcgtaggaggagttggttaggggtatttagtttcgtgtactatgactaagcctaacacgtacgttcggtacccgttactacgttttcggaccggtacgggtaccaaggtcgtaggtaagtaacgtaccgaaacggtaacgtacggtacggtacgtacgacctaccgtgttacccgg

SEQ ID NO: 236312 - DNA, 530 bp, Homo sapiens
  misc_feature: GYAE6OF01D8JZM.3.35.D02.1.454.CMB.1.raw
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactagagaattagcgagggtggaggcgtaggaggagttggttgggtatttatttcgtgctagtgcaagactacactactcggaccgtactacgtttcggccgacgggaccaaggcgtaggagatacgaaacgaacagtggactagccncntcg

SEQ ID NO: 236313 - DNA, 518 bp, Homo sapiens
  misc_feature: GYAE6OF01A84BO.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtccccagacagattcagcggcactgggtcaggcactgatttcacactgagaattagcagggtggaggctgaggatggttgggatttatttctgcatgcaagctacacactggccgtacacgttttggccgaggggacccaagcgtggagactacaaacggaactggtcggctagcaccgatccg

SEQ ID NO: 236314 - DNA, 556 bp, Homo sapiens
  misc_feature: GYAE6OF01AL6VH.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttcaaccgggacgctgggtcccagacagattcagcggcacgtgggtcaggcactgatttcacactgagtaattagcgagggtggaggcgtggaggtagttggttgggtatttagtttctgtctatgacaagtctacgactacgtcggtaccgtacgtacgtttcggaccgtagggtacctaaggtcgtacggagtacgtacaaacgaacgttcggtacggtctacgacctaccgtgttaccg

SEQ ID NO: 236315 - DNA, 532 bp, Homo sapiens
  misc_feature: GYAE6OF01ATNTG.3.35.D02.1.454.CMB.1.raw
  modified_base (525)..(525): a, c, t, g, unknown or other
  misc_feature (525)..(525): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttcaaccgggcgcgtgggtcccagacagattcagcggcacgtgggtcaggcacgtgactttcacactagagaattagcgagggtggagcgtggaggagtggttaggtatttagtttctgtcatgacaagctacactacgtcgccgtactactttcggccgagggaccaagcgtggagacgtacgaaacgaacgtgtacggctacgctaccngttaccg

SEQ ID NO: 236316 - DNA, 608 bp, Homo sapiens
  misc_feature: GYAE6OF01BFZ2A.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccatcctaccgaaggccgacctaatctaattaaggtttctaaccgggacgcgtgggtacccagacagattcagcgacacgtgggtcaggctactgtatttcactactagaagtaattaggacgtagggtagggaggtcgtaggaaggtagttgggtttagggtatttttagtttcgtagtctagtgacgtaaacgtctaaccgactaccgttcggtaccgttaacgtaccgttttcggaccggtaacggggaaccctaaggccgttaggtaagaacgtaaccgaaaaccgtaacgtggtacggactaggacctaccgagttccg

SEQ ID NO: 236317 - DNA, 635 bp, Homo sapiens
  misc_feature: GYAE6OF01BX3R0.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctgggtcccaggatccagtggggatgttgtggtgactcagtctccactctccctgcccgtcacccttggacagccggcctccatctcctgcaggtctggtcaaagcctcgtgtacggtgataggaaacacctacttgtaattggtatcagcagaggccaggaccaatctaccgaaggcgacctaatctaagttaaggttacaaccgggacgcgtcgggtccagacagtattcagcggctacgtggtacaggcacgtgatttacactactgtaataagttagacgaggggttagggaggtacgtaggaaggtagttgggtttagggttaattttacgttttcagtagtactaggactaaggtaccttaacacccgtaacgtcgggtacccgtttaacgtccgtttacggggacccgtaacggggtaacccaaagggtcgtacgggaagtaaccgttaccgaaaacggtaccgttacgggtcggtaccgtaccggacctaacctcgtttaccg

SEQ ID NO: 236318 - DNA, 574 bp, Homo sapiens
  misc_feature: GYAE6OF01CZ11D.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctaccaaggcgcctaatctataaggtttctaaccgggacgcgtggggtcccagacagattcagcggcacgtgggtcaggccatgatttcacactgagaattagacagggtggaggcgtaggaggtagtggttgggtattttagtttctgtcagtgactaagctaacacgacgttcggaccgttaccgtacgttttacgggaccgtacgggggaacctaaggtcgtacgggaagacgtaaccaaaccggtaacgtggttacgggacttggaccaccgtagttaccg

SEQ ID NO: 236319 - DNA, 611 bp, Homo sapiens
  misc_feature: GYAE6OF01CBK5Z.3.35.D02.1.454.CMB.1.raw
tcagagacgcactccacgaccggtgctcgatttagcacacgatagttgggtttgggggatcaggactcctctagttcaccttctcaacaatgaggctccctgctcagctcctgggctgctaatgctctgggtcccaggatccaggtggggatgttgtggtgactcagtctccactctccctgcccgtcacccttggacagccgcctccatctcctgcaggtctggtaccaaagcctgtgtacggtgatggaaaccacctacttagaattggtatcagcagacggccaggcccaatcctaccgaaggccgacccttaaatctaagttaaacggtttccgtaaacccgggacgtcgtcggggtccccaagaccagtacttcgagcggcacgtgggtacaggctacgtgtatttcactactagaagtaagttacgcgagggtcggaggcgtggaggtagttaggttggtattttagttcgtgctagtcgacaacgactacgacgtacgtcggtaccgtactacgtttcggacccgtaaggggaccctaaggtcgtagggaatacgtaaccgaaacggtaacgtgggtacggaccttaggcctaccgtagttccg

SEQ ID NO: 236320 - DNA, 550 bp, Homo sapiens
  misc_feature: GYAE6OF01C3QTD.3.35.D02.1.454.CMB.1.raw
  modified_base (394)..(394): a, c, t, g, unknown or other
  misc_feature (394)..(394): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctactgaattggtatcagcagaggccaggccaatctccaaggcgcctaatctataagttcgtaaccggacgactgggtacccagacagattcagcggcacgtggtcaggcactgatttcacatgagtaatagactagggnggaggtcgtaggaggagttggttagggtatttagtttctagtctaagtgacaagtctaacactacgtcggtcgtacgtcgtttaggacccgtaagggaccaaggacgtggagtatacaaaacgtacgtaggtcggtacgtagactacgcgttaccg

SEQ ID NO: 236321 - DNA, 579 bp, Homo sapiens
  misc_feature: GYAE6OF01ELJC9.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgacctaatctataaggtttctaaccggacgcgtggggtccagacagacttcagcggcacgtgggtcaggcacgtgtactttcactactgaagtaattagacagggtgggaggcgtaggaggtagtggtttagggtatttagttttcgtgtactagtgacgaagctaacacgtacgttcggccgttactacgttttcggaccggtacggggaccaaggtcgtacgggtaagacgtaccgaaaacggtacgttacgtacggctaggcctaaccgtagttaccg

SEQ ID NO: 236322 - DNA, 628 bp, Homo sapiens
  misc_feature: GYAE6OF01DYJ4D.3.35.D02.1.454.CMB.1.raw
  modified_base (336)..(336): a, c, t, g, unknown or other
  misc_feature (336)..(336): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacaccttacttagaattggtatccagcagaggccaggccaatctaccaaggccgacctaatctagttaaggtttctaaccgggacncgtgggtcccagacagattcgagcgcacgtgggtcaggcactgatttcactacgtgaagtaattaggacgagggtgggaggtcgtagggaggtagttgggtttagggttattttacgtttcgtgtacgtagtcggtaacaacggtacctaacgaccgtacgttaccgggtaccgttaaccgtttacggttttacgggacccgtaacgggggtacccaaaggtccggtagggaacgacgttaaaccgaaaacgtacggtacggttacggaccttagaccctacgtagttaccg

SEQ ID NO: 236323 - DNA, 630 bp, Homo sapiens
  misc_feature: GYAE6OF01A5G07.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaaattggtatcagcagaggccaggccaatctccaaggcgcctaatctataaggtttcaaccgggacgcgtgggtccagacagattcgagcggcactgggtcaggcacgtgatttcactactgagaattagcagggtggaggcgtggaggtagtgggttagggtaagttttagtttcgttgtacgtagtgtacgaaaggtaccgttaacgaaccgtacgttacggtacccggttaaccgtaccgtttttacgggacccggtaacgggggtaacccgtaaaggtcggtacgggtaaggtaacgttaacgaaaacccggtaaacgttacgggttacgggaccgttacggacctaacccgtacgtttacccgg

SEQ ID NO: 236324 - DNA, 524 bp, Homo sapiens
  misc_feature: GYAE6OF01A9S1D.3.35.D02.1.454.CMB.1.raw
  modified_base (518)..(518): a, c, t, g, unknown or other
  misc_feature (518)..(518): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacaggattcagcggcactgggtcaggcactgatttcacactgagaattagcagggtgggaggctgaggagtgttgggtatttaatttctgtcatgcaagctacacacgtgccgtacacttttggccgtaggggaccaagcgtgggagagtacaaacgtaactggtggacgtgcaccgnttaccg

SEQ ID NO: 236325 - DNA, 613 bp, Homo sapiens
  misc_feature: GYAE6OF01CQ6KH.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagcccggcctccatctcctgcaggtctggtcaaagcctgtgtacggtgataggaaacacctacttgaattggtatcagcagaggccaggccaatctaccaaggcacctaatctaagtaaggtttcgtaaccgggacgtcgtcggggtcccagacagatcgagcggcacgtgggtcaggcactgtatttcactacgtgaagtaattaggcgtaggggtgggaggtcgtaggaaggtagttgggtttagggtatttttagtttcgtaggtctaagttcgacgtaacgtcctaacgaactaccgtacggtcccgttaacgttacgttttcgggaccggaacggggtaccgtaaggtcggtaagggaagtaacgtaccgaaaacgtacgttaggtcggacgtacgaccaaccgtgttaccg

SEQ ID NO: 236326 - DNA, 521 bp, Homo sapiens
  misc_feature: GYAE6OF01A2GP4.3.35.D02.1.454.CMB.1.raw
  modified_base (488)..(488): a, c, t, g, unknown or other
  misc_feature (488)..(488): n is a, c, g, or t
  modified_base (511)..(511): a, c, t, g, unknown or other
  misc_feature (511)..(511): n is a, c, g, or t
  modified_base (516)..(516): a, c, t, g, unknown or other
  misc_feature (516)..(516): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctactgaattggtatcagcagaggccaggccaatctccaaggcgcctaatctataaggttttctaaccgggcgctggggtccccaggacagattcagcggcactgggtcaggcactgatttcacactgagaattagcgagggtggaggctggaggtatggttgggtattttagtttctgcatgcaagctacactacgtggccgtactactttcggcctggggaccaggctgganatcaaacgactggtcggctagcnccgtnttccg

SEQ ID NO: 236327 - DNA, 595 bp, Homo sapiens
  misc_feature: GYAE6OF01CEDKU.3.35.D02.1.454.CMB.1.raw
tcagagacgcactccacgaccggtgctcgatttagcacacgatagttgggtttgggggatcaggactcctcagttcaccttctcacaatgaggctcccctgctcagctcctgggctgctaatgctctgggtcccaggatccagtggggatgttgtggtgactcagtctccactctccctgcccgtcacccttggacagccggcctccatctcctgcaggtctgtcaaacgcctcgtgtacggtgataggaaacacctacttgaattggtatcagacagaggccaggccaatcctccaaggccgacctaatctaagttaacggtttaccgtaaccgggacgcgtacggggtcccagacaggtacttcgacgcggcacgtgggtcgaggctactgtatttcacgactagaagtaattaggcgtaggggtggaggtcgtaggaggtagttgggttagggtattttacgttctggctagtgactacgactacgactacgtcggtaccttacgtacgtttacggccgtacggggaccacggtcgtacggagtaagtaccgaaacggtactagggtcgtacgtagacctaccgtgttaccg

SEQ ID NO: 236328 - DNA, 543 bp, Homo sapiens
  misc_feature: GYAE6OF01CGVFH.3.35.D02.1.454.CMB.1.raw
  modified_base (439)..(439): a, c, t, g, unknown or other
  misc_feature (439)..(439): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacactacttgaattggtatcagcagaggccaggcaatctccaaggcgacctaatctataacggttctaaccgggacgcgtggggtcccagacagattcagcggcactgggtcaggcactgtatttcacactgaagaattaggcgagggtgaggctaggaggtattggttagggtatttagtttctgacnttagctaagactacactacgtcggccttacgtacgtttggaccgtagggacccaaggtcgtaggagatacgaaacgacgtaggtcgctagaccacgtacttacg

SEQ ID NO: 236329 - DNA, 519 bp, Homo sapiens
  misc_feature: GYAE6OF01A9GYL.3.35.D02.1.454.CMB.1.raw
  modified_base (516)..(516): a, c, t, g, unknown or other
  misc_feature (516)..(516): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggcgtggaggagtggttgggtattttagtttctgctatgacaagctacactacgtcggccgtactacgtttggccgagggaccaagcgtggagatacaaacgactgtggctagcacgntcg

SEQ ID NO: 236330 - DNA, 524 bp, Homo sapiens
  misc_feature: GYAE6OF01BXJBD.3.35.D02.1.454.CMB.1.raw
  modified_base (518)..(518): a, c, t, g, unknown or other
  misc_feature (518)..(518): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcactactgagaattagcagggtggaggctgaggatggttggtatttatttctgcatgcaagctacactactggccgtactacgttttggccgtagggaccaaggcgtggagatccgaaacgtaactaggtcggactgccaccgnttaccg

SEQ ID NO: 236331 - DNA, 672 bp, Homo sapiens
  misc_feature: GYAE6OF01CYI06.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctcgcccgtcacccttggacagccggcctccatctcctgcaggtctggtcaaagcctcgtgtacggtgagtaggaaacaccttacttgtaattggtatcagcagacggccgaggaccaatcctaccgaacggccgtaccttaaatttaacgttaaacgggttttaccgtaaaccgggtacttaccggttcggggtacccaaggaacgtagtacttcgaggcggacgaggtgggtacacggacacgtgtactttcactaactagaaactcgaaggcgtagggtggaggcgtaggaggtagtttgggtttaggggtttattacgtggtactagtcgaacgtaaggttaccacgtacgtcggtacccgttaccggtaccggttaccggacccggtacgggaacccgtaagggttaacggaaaactaccggaaaacggtacgttaggtacggtctacgaccgtaacctagttcccgttagttccctcgtccgttccccg

SEQ ID NO: 236332 - DNA, 539 bp, Homo sapiens
  misc_feature: GYAE6OF01C1DCQ.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaaccgggacgctggggtcccagacagattcagcggcactgggtcaggcactgatttcacactgagaatagcagggtggaggctggaggagtggttgggtatttagttctgtcatgcgaagctacacgtacgtggtccgtactacttttcggccgtacggggaccaagcgtaggagagtacgaaacgtaactggtacggtactagaccaccgtagttaccg

SEQ ID NO: 236333 - DNA, 667 bp, Homo sapiens
  misc_feature: GYAE6OF01EHK67.3.35.D02.1.454.CMB.1.raw
  modified_base (304)..(304): a, c, t, g, unknown or other
  misc_feature (304)..(304): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctcactctccctgcccgtcacccttgggacacgccggcctccatcgtcctgcaggtctggtacaaagcctcgtgtacggtgatggaaacacctacttgaattggtatcagcagacggccaggccaatctccgaaggcncctaatctaataacggttctaacgggatcgtcgggtaccagacagtattcgagcggacagtcgggtcacggcaccgtgtactttcaactacgtagtaagtaattacggacgtaaggggtcgggtagggtcgtacgggtaagggtagttagggtttagggttaactttttacgtttcgttagtacgtacgttacgacgtaacgtaccttaacgtacgttaccgttaccggtaccgttaacgttacggttttcgggaccggtaacggggtacccgtaaacggtcggtacgggtaacgtaacgtacgtaaaaccgggtaacgttcggttacgggtaccttacggacctacccgtaacgtttacccg

SEQ ID NO: 236334 - DNA, 673 bp, Homo sapiens
  misc_feature: GYAE6OF01C2ORR.3.35.D02.1.454.CMB.1.raw
  modified_base (336)..(336): a, c, t, g, unknown or other
  misc_feature (336)..(336): n is a, c, g, or t
tcagagacgcactccacgaccggtgctcgatttagcacacgatagttgggtttgggggatcaggactcatcagttcaccttctcacaatgaggctccctgctcagctcctggggctgctaatgctctgggtcccaggatccagtgggatgttgtgtgactcagtctccactctccctgcccgtcacccttggacagccggcctccatctccctgcaggtctggtcaaagcctcgtgtacggtgatggaaaacacctacttagaattggtatcagcagaggccaggccaatctaccaaggccgcctaatctaagtaacggtttacgtaaccgggacncgtcggggtcccagacagacttcgagcgcacgtcgggtcacgggctacgtgtatttccaactactagaagtaacttaagcgaaggggtaggaggacgtaggagggagttgggttaggggttaattttagttttcgtagtcgtaattcgggaactaacgtaccgttaaacgaccgtaccgttacgggtacccgttacttaccggttttttacgggaccccggtaaagggggtaacccgtaaacggtaccggttaaggggaaccgtaaacgtaaaacccgtaaaaccggtaaacgttcgggttaaccggtcgttaaccggcccgtaacccggttaacgg

SEQ ID NO: 236335 - DNA, 576 bp, Homo sapiens
  misc_feature: GYAE6OF01CEOE8.3.35.D02.1.454.CMB.1.raw
  modified_base (215)..(215): a, c, t, g, unknown or other
  misc_feature (215)..(215): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (320)..(320): a, c, t, g, unknown or other
  misc_feature (320)..(320): n is a, c, g, or t
  modified_base (398)..(398): a, c, t, g, unknown or other
  misc_feature (398)..(398): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgtggtctctggattcaccttcagggaccacttcatggactggggtccnccaggctccgaggggagggctggagtgggtgcgtaataagaacaagctagaagttacacacagatacgccgngtctgtgacnggcagattcaccatctacaaganatgattcaaagcaactcgagtgtcctcgtgactaaatcgaaccacccgtagaacgaccgagacacggtcctatatacngcactacagtattcaattagtaggatactacgtactacgtcggggaccacggacgtacccgtggtacctaccggtcctccgtcacgccctaccaccgaacggccctacgtccgtccctccccgtcggccctccccgtgcccgtaccgacggtaccgaccacccgtacgcgtacgaccg

SEQ ID NO: 236336 - DNA, 676 bp, Homo sapiens
  misc_feature: GYAE6OF01DBXJJ.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgccccgtcacccttggacagccggcctccatctcctgcaggtctggtcaaagcctcgtgtacggtgatggaaacacctacttagtaattaggtatcagcaggacggaccacggaccctaatccgtacccaagggccgaccttaaatacgtaagtttaacggtttaccgtaaacccgggaccgacgtcggggtaccccaaggacagtattcgacgcggcgacgtgggtcaggcacgtgtatttcactactgaagtaagttagacgaggggtaggaggtcgtaggtaggtagttagggtttagggtatttttagtttcgtagtacgtagtcggtacgtaacggtactaaccgtaccgtaccgttacgggacccgttaacgttaccgttttacggggaccccggtaaggggtaacccaaggtaccggtacgggtaagtaacgtaacggaaaacgttaaccggtacggtacggtaccgtacggacctaccgtgttacccgg

SEQ ID NO: 236337 - DNA, 675 bp, Homo sapiens
  misc_feature: GYAE6OF01B0X4K.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccaggtggggatgttgtggtgactcagtctccactctcccctgcccgtcacccttggacacgccggcctccatcctcctgcaggtctggtacaaagcctcgtgtacggtgataggaaacacctacttagaattggtatcagcagaggccaggccaatcctccgaaggccgacctaatctataaggtttacaaccgggacgcgtcgggtaccagacagattcgagcggcacgtgggtcaggcagtgtactttcactacgtgaagtaattaggcgtagggtgggaggtacgtggtaaggtagtttgggtttagggtttattttacgttttcgtacggtacgtaagttacgggaactaacggtacctaaccgtaaccgtaaccggttaccgggttaaccccgttaacgtttacccggttttcgggaaccccgggtaagggggaaccctaaagggtaccggtagggaacgtaacttaaacccgggaaaaccgttaaacggttcgggtacgggtactacggaccctaaccgtcgtttaccg

SEQ ID NO: 236338 - DNA, 575 bp, Homo sapiens
  misc_feature: GYAE6OF01CNH9R.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgcgtggggtccccaggacagacttacagcggcactgggtcaggcactgatttcacactgagtaattagcgagggtggaggtcgtaggaggagttggttagggtattttaagtttcgttgtctagtgacaagctaaccgactaccgtcggtaccgttacgtacgttttacggcccgtaaggggaccaaggacgtacgggaagaacgttacaaacggaacgttaggtcggacgtacgcacccgtattccg

SEQ ID NO: 236339 - DNA, 591 bp, Homo sapiens
  misc_feature: GYAE6OF01DV5ND.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatcctcctgcaggtctggtcaaagcctcgtgtacggtgatggaaacacctacttgaattggtatcagcagacggccaggcccaatcctccgaaggcgacctaatctaattaaggtttacctaaccgggacgcgtggggtccccagacagattcagcggcacgtgggtcaggcacgtgtatttacactactagaagtaagttagcgaggggttggagggcgtagggaaggtagttgggtttagggttattttagtttcgtgtactagtagactaaagtctaacacgtacgtcggtaccgttactacgtttcggaccgagggacctaagcgtaggatacgtacaaaaccgtagtacggtacggacgttacgacctacctgttaccg

SEQ ID NO: 236340 - DNA, 758 bp, Homo sapiens
  misc_feature: GYAE6OF01B2DHH.3.35.D02.1.454.CMB.1.raw
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (324)..(324): a, c, t, g, unknown or other
  misc_feature (324)..(324): n is a, c, g, or t
  modified_base (343)..(343): a, c, t, g, unknown or other
  misc_feature (343)..(343): n is a, c, g, or t
tcagagacgcactccacgaccggtgctcgatttagcacacgatagttgggtttgggccgagctgggttttcctggttgttattttacaaggtgtccagtgtgaggtgcagctggtgcagtcgtgggggaggcttggtccagcctgggacgggtccctgagactctcctgtgtggtctctggattcaccttcgagggaccacttcatggactgggtccgccaggctccgagggagggctggagtgggttggccgtataagaaacaagctaagaagtacaccacagactacgcgntcgtgnacgnggcagatcaccatcacaaganatgattcaaagctaaactnagtgtctacgtcgaactaaaagtcgaaacctacccgtaggaaacggaacccggaaaggaaccaaccgggtacccgttacttaagttaccgtcggtaccgtactaacgtaacgtaactttactaaagttaacgttaggtaacgtaccgttaaacgaaccgttaacggtaccggggaacccgtaacgggtaacggtaacccgttacgggtacccgtaaccccggttccctaccccgttaccgaacccgtaccccgtaaccccgtaaccccggtaaacccggggcccctaaacccggttcccggttacccccgtttacccccccgtcggggacccccgttacccccggttcggtaccccgttccccgggaacggaccgtacccccgtaacccggtaccccggaacgtaccggaacccg

SEQ ID NO: 236341 - DNA, 551 bp, Homo sapiens
  misc_feature: GYAE6OF01B443W.3.35.D02.1.454.CMB.1.raw
  modified_base (447)..(447): a, c, t, g, unknown or other
  misc_feature (447)..(447): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgtggtctctggattcaccttcagggaccacttcatggactgggtccgccaggctccagggaagggctggagtgggttggccgtataagaaacaagctagaagttacacacagattacgccgcgtctgtgacaggcagattcaccatctcaagagatgattcaagcaactcagtgtctctgacaaatcgaacaccctagaacgaccgaggaccacggcctactattactgcgactacagtattacatatggagactacgtactacgtcgggaccacggganaccgtggtccaccgttctcctcacgcctccgaccgaacgggccctagtccgtcccttccccgtcggcccgccctcgcctccgagcgccaccgtccgagcgaccg

SEQ ID NO: 236342 - DNA, 610 bp, Homo sapiens
  misc_feature: GYAE6OF01DLSRC.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcaccttggacagccggcctccatctcctgcaggtctggtcaaagcctcgtgtacggtgagtaggaaacacctacttagaattggtatcagcagaggccaggccaatctaccgaaggcgacctaatctaattaacggtttacctaaccgggacgccgtacgggtacccaagacagtattcgagtcggcacgtggtcgaggcacgttgtactttacactactagaagtaagttaggacgtagggtacggaggtcgtaggaggtagttagggttaggttattttagtttcgttagtcgtaagtgacgtaacgtactacgacgtacgtacggtaccgttaactacgtttacggaccggtacgggaaccgaaggtacgtacggagtaacgtacgaaacgtacgacggtcggactagcctacgtcgttacg

SEQ ID NO: 236343 - DNA, 527 bp, Homo sapiens
  misc_feature: GYAE6OF01CFYNO.3.35.D02.1.454.CMB.1.raw
  modified_base (523)..(523): a, c, t, g, unknown or other
  misc_feature (523)..(523): n is a, c, g, or t
tcagagacgcactccacgaccggtgctcgatttagcacacgatagttgggtttgggggatcaggactcctcagttcaccttctcacaatgaggctccctgctcagctcctgggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctaataaggtttctaaccggacgctgggtccagacagattcagcggcactgggtcaggcacgtgatttcacactgagaattagcagggtggaggctggaggatggttagggtatttatttcgtgctatgactaagctaacgactactcggaccgttactacgttttcggaccgtaggggacctaagcgtggagatacaaacgacgtgtggctgcacgtntacg

SEQ ID NO: 236344 - DNA, 512 bp, Homo sapiens
  misc_feature: GYAE6OF01AY1DE.3.35.D02.1.454.CMB.1.raw
  modified_base (439)..(439): a, c, t, g, unknown or other
  misc_feature (439)..(439): n is a, c, g, or t
  modified_base (480)..(480): a, c, t, g, unknown or other
  misc_feature (480)..(480): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaagcgcctaatctataaggtttcaaccgggacgctggggtcccagacagattcagcggcactgggtcaggcactgatttcacactgagaattagcagggtggaggctgaggtatgttgggatttatttctgctatgcaagctacanactgccgtacactttggcctaggggaccaggcgtggagtanccaaacgaactggtgactggaccacgattccg

SEQ ID NO: 236345 - DNA, 642 bp, Homo sapiens
  misc_feature: GYAE6OF01DH7RM.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggcaggccaatctaccaaggcgcctaatctattaacggtttcgtaaaccgggacgcgtgggtccccagacagattcagcgcacgtggtcaggcactgactttcacactgaagtaatagacgagggtaggaggctaggagtagttggttgggtattttagtttcgtgctagtcgacgaaacgtctaaccacgtaccgtacgggtaccccgtttaacgttaccgtttttaccggggacccggtaaacgggggaaacccctaagggtccggtaacggggtaacggtaacgttaaaccggaaaaacccggttaaacgttaccgggttacggggtaccttagggaaccccaacccgttacgtttaacccg

SEQ ID NO: 236346 - DNA, 574 bp, Homo sapiens
  misc_feature: GYAE6OF01CTIW2.3.35.D02.1.454.CMB.1.raw
  modified_base (420)..(420): a, c, t, g, unknown or other
  misc_feature (420)..(420): n is a, c, g, or t
  modified_base (568)..(568): a, c, t, g, unknown or other
  misc_feature (568)..(568): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaaatctaccaaggcgcctaaatctaataaggtttctaaccgggacgcgtgggtccccagacagattcagcggcacgtgggtcaggcactgatttcacactgagtaattagcgagggtggaggcgtaggaaggtntggttgggtattttagttcgtgctagtcgacaagtctaacacgtacgtacggtaccgttaacgtacgttttcggaccggtaaggggacctaaggcgtagggaagtactaccggaaaacgtaacgtggtacgggactaggaccaacgtnttaccg

SEQ ID NO: 236347 - DNA, 689 bp, Homo sapiens
  misc_feature: GYAE6OF01CGL6X.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctgggtcccaggatccagtggggatgttgtggtgactcagtctccactctccctgcccgtcacccttggacagccggcctccatctcctgcaggtctggtcaaacgcctcgtgtacggtgagtaggaaacacctacttgaattggtatcagcagaggccaggccaatctccgaacggcgacctaatctaagttaaggtttaccgtaaccgggtcgcgtcggggtaccagacagtatcgagtcgcacgtggtcgaggcactgtatttcactactagaacgtaagtacgacggtaggggttagggacggtacgtagggtaagggttaggttagggtttaggggttatttttaacgtttcgtaggtctaagttcgaacgtaacgtacgttaacaaccgttaccggtacgggtacccgtttaacgttaccggttttacgggacccggtaaacgggggaaccctaaagggtaccgtaacgggtaacgtaaaccgtaaaccggtaaaaacccggtacggtttacgggtaccgggttacctacgggtaaccctaacccgtagtttaccccgg

SEQ ID NO: 236348 - DNA, 559 bp, Homo sapiens
  misc_feature: GYAE6OF01CPJHJ.3.35.D02.1.454.CMB.1.raw
  modified_base (554)..(554): a, c, t, g, unknown or other
  misc_feature (554)..(554): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgataggaaacacctacttgaattggtatcagcagaggccaggccaatctccgaaggcgcctaatctataaggtttctaaccgggacgcgtcgggtcccagacagattcagcggcacgtgggtcgaggcactgtattcacactgaagtaattagcgagggtggaggtcgtaggaggtagttggttagggttattttagtttcgtagtctagtgacaagacctacgactacgtcggaccttactacgtttcggccgtagggaccaggcgtaggagaactacgaaacgtacgttggtacggctacgaccacgtnttccg

SEQ ID NO: 236349 - DNA, 633 bp, Homo sapiens
  misc_feature: GYAE6OF01E3I4L.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagcccggcctccatcctcctgcaggtctggtcaaagcctcgtgtacggtgatggaaacacctacttgaattggtatcagcagaggccaggccaatctccaaggcgcctaatctaataaggtttctaaccgggacgcgtcgggtcccagacagattcagcgcacgtgggtcaggcacgtgattcacacgtagagaattagcgagggtgggaggcgtaggaggtagttgggttagggtattttagtttcgtagctagttgacgaacgtactaccacgtaccgtacggtacccgttaccgtacgttttcgggacccggtaacggggaacccgaaaggtaccggttagggtaacggtaaaccgtaaccgtaaaaaccgggtaaaccgtttacgggtaccgggtaccgttacggtacccgtaaacccgtaacgtttacccgg

SEQ ID NO: 236350 - DNA, 693 bp, Homo sapiens
  misc_feature: GYAE6OF01BUVMI.3.35.D02.1.454.CMB.1.raw
  modified_base (224)..(224): a, c, t, g, unknown or other
  misc_feature (224)..(224): n is a, c, g, or t
tcagagacgcactccacgaccggtgctcgatttagcacacgatagttggggtttcggggaaactcacggactccgtcaagttccaccttctcacaatgacggctcccctgcgtcaggcctccgtggggcctgccttaactggctctgggtcccagggatccaggtggggactgttcgtggttgacttcgagtctccactcgtccctgcccgtcacccttggacncgccgggcctccatctcctgcaggtcctggtcaaagccctcggtgtacggtgatcggaaacacctaacttgaagttggtatactaggcagacggccgacggaccaagtctcgaaggcgcgtaagtctagtacggtttctaacgggacgtcgtcgggtacccaggtacaggacttacgagcggacgaacgtcgggtacgaggccaacgttagtaactttaccgaacctaacccgtaggaacgtaactttaacggaccgtaaggggttacgggaacgggtaccgtaagggtaagggtaacgttagggttaccgggttaagtttacgtttcgtgtacgtaagtcggtacgaacgtcttaacgtactacgtcggtaccgtacgtacgttttcggaccgtagggtacccaagtcgtaggtagtagtacgaaacggtacttacggtacggtacgtacgtctaccgtacgttccgg

SEQ ID NO: 236351 - DNA, 706 bp, Homo sapiens
  misc_feature: GYAE6OF01B9BLZ.3.35.D02.1.454.CMB.1.raw
  modified_base (700)..(700): a, c, t, g, unknown or other
  misc_feature (700)..(700): n is a, c, g, or t
tcagagacgcactccacgaccggtgctcgatttagcacacgatagttgggtttgggggatcaggactcctcagttcaccttctcacaatgaggctccctgctcagctccgtggggctgctaatgctcgtgggtcccaggatccaggtggggatggttgtggtgactcagtctccactcctccctcgcccgtcctacccgttggacacggcccggcctccactcctcctgcgtaggtctaggtacaacgcctcggtgtacggtgatacggaaactacctattgtaagttgtaatcgagcgaggacggccgacggacctaaacgtccgtaaccgaaacggggcctaccttaaaacgttccgttaaagtttaaaccgggttttaccggtaaaaccccggggtcgtaccggtttaccgggggaccctaaggaaccgtagtaactttcgaacgggccggtacgtacggtacggggttacacggacgtagttacggtaactttaccgacttaacgagtaacgtaaacgtttagacgggtaggggtggacggtctagggaaggtagtgggtttagggttatttacgttctgactgtagtacacgtactacaccgtacgttacgtccgttactacggttacggaccggacggtaaccgagtcggtaggaacacgtaaccgaaacggtgtggtacggctagaccacgtnttaccg

SEQ ID NO: 236352 - DNA, 607 bp, Homo sapiens
  misc_feature: GYAE6OF01DHLZ3.3.35.D02.1.454.CMB.1.raw
  modified_base (330)..(330): a, c, t, g, unknown or other
  misc_feature (330)..(330): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttagaattggtatcagcagaggccaggccaatctccaaggcgacctaatctataaggtttctaaccgggacncgtcgggtcccagacagattcgagcggcacgtgggtcaggcacgtgatttcacactagaagtaattagacgagggtggaggcgtaggaggagttagggttgggtagttttatttcgttggtactagtgcgtaaacggcttaaccacgtaccgtcggtacccgttacgttaccgttttacgggacccggtaacggggaaccctaagggaccgtacgggaacggtaactacggaaaaccgtaagttacggtaggacgttacgaacctccgtattaccgg

SEQ ID NO: 236353 - DNA, 898 bp, Homo sapiens
  misc_feature: GYAE6OF01DOPGD.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctcgcccgtcacccttggacagccggcctccactctcctgctaggtctggtcaaagcctcgtgtacggtgatacggaaacaccttacttagtaagttcggtatccaagcaagacggccgacggaccaaatcctaccgaacgggccgaccctaaattccgttaatttaaacgggtttcccgttaaaaccggggaccgtccggttccggggttaccccaaggaacctaaggtactttacgaacggtccgggaccacggttcggggtaccgaacggggtacctacgtttacggtaactttttacccgaaaccgtaaccgttaggggtaaacgttaaacggttttacgggtaaccgggtaagggggggttaggggtaaacggggttcccggttaaggggtaacgggggttaaaggttttaggggggtttttaacgggggttttaaagtttttttaaaccgttttttaccggtttacgggttaaccgttaacggtttccggtaacggttaaaaccgtacccgtttaaacccgaaaccccgttaacccgtttacccgggggttaaccccgtttaaacccggtttaccgttttttaccgggggaaccccggtaaagggggtaaaccccaagggtccgttaacggggaacgttaacgtaaaccccgtaaaaacggtaccggttcgggttaccggtacgtaccggtaaccctaccgttaacgtttaccgg

SEQ ID NO: 236354 - DNA, 716 bp, Homo sapiens
  misc_feature: GYAE6OF01EJHNQ.3.35.D02.1.454.CMB.1.raw
  modified_base (249)..(249): a, c, t, g, unknown or other
  misc_feature (249)..(249): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctcccctgcccgtcacccttggacacgcccggcctccatcctcctgcaggtctggtacaaacgcctcgtgtacggnagtggaaactacctacttagaagttggtatcgagcaggacggccaggaccaatcctaccgaaggccgtacctaattctaagttaacggttttaccaaccgggacgtccggttcgggtacccctagaaccgagtacgttaccgaaggccggacgtacgtcgggtacaggcgactgtaacttacactacgtgaagtaagttacgacggaggggtaggaggtcgtagggtaggtaggttagggtttaggggtaatttttagtttacgtaggtcgtaacgtcgtaacgtaaacgtacccttaaccgtaaccgtacggttaccggtacccggtttaaccgttacgggttttaccggaccgggtaaaccggggtaacctaaacgggtcgtaagggaacggtaacttaacccggtaaaaccggttaacgttacgggttaccgacggtttacgaccctaccggtaagtttcccgg

SEQ ID NO: 236355 - DNA, 668 bp, Homo sapiens
  misc_feature: GYAE6OF01DB013.3.35.D02.1.454.CMB.1.raw
  modified_base (243)..(243): a, c, t, g, unknown or other
  misc_feature (243)..(243): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtccaccttggacagccggcctccatctcctgcaggtctggtcaaagcctcgtgtacggngatgaaacacctacttagattggtatcagcagagccaggccaatctacaacggcgtacctaatcctaagttaacggtttacctaaaccgggacgtacgtacggggtccacgacgacgtattcgaagccggtacaaccgtcgggtaccaggactacgtaggtaactttcaacgtacgttagaagtaaagttaggacgtaaggggtagggaggtacgtaggaaggtagtttaggttagggttaatttttaaagtttccgtggtacctagttacgacgtaaacggtactaacctacgtaacctccggtaacccgtttaacgtaccgttttacggacccggtaaggggaacccctaaaggtcgtacggtaagaacttaccggaaaaaccgtaacgttacggtggaccgtacgacctaaccgtgttaccg

SEQ ID NO: 236356 - DNA, 596 bp, Homo sapiens
  misc_feature: GYAE6OF01CXTWC.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctcctgcccgtcacccttggacagccggcctccatctcctgcaggtctggtcaaagcctcgtgtacggtgataggaaacacctactagaattggtatcagcagaggccaggccaatctaccaaggcgcctaatcctaattaaggtttacgtaaccgggacgcgtcgggtacccagacagattcacgcggacacgtgggtcaggcactgactttacacactgaagtaactagcgagggtggaggcgtggaggtagttgttgggtattttagttcgtgctagtgacgtaacgtctaaccgtacgtacgtacggtaccggttacgttacggttttacggaccgtaacgggggaccctaaaggccgtaagggtagaacgtaacgaaaccgtaacgtcgtacggtactacggaccaccgtagttaccg

SEQ ID NO: 236357 - DNA, 161 bp, Homo sapiens; identical to SEQ ID NO: 236258
  misc_feature: GYAE6OF01ADU6Q.3.35.D02.1.454.CMB.1.raw
  modified_base (160)..(161): a, c, t, g, unknown or other
  misc_feature (160)..(161): n is a, c, g, or t

SEQ ID NO: 236358 - DNA, 584 bp, Homo sapiens
  misc_feature: GYAE6OF01ES4E6.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaaccacctacttgaattggtatcagcagaggccaggccaatctccaaggcgcctaatctataaggttctaaccgggacgcgtcgggtccagacagattcagcgcacgtgggtcaggcactgtatttcacactagagtaattagacgagggtagggaggcgtaggaggtagttggttagggttagttttagtttcgtgtctagtcgacgaacgtactaaccgactacgtcggtaccgttacgtacgttttcgggaccggtaacgggaccgaaggtacgtaggaagtacgtaacgaaacgtaacgtaggtcggacgtacgacctaccgtagttaccg

SEQ ID NO: 236359 - DNA, 552 bp, Homo sapiens
  misc_feature: GYAE6OF01DHE3L.3.35.D02.1.454.CMB.1.raw
  modified_base (431)..(431): a, c, t, g, unknown or other
  misc_feature (431)..(431): n is a, c, g, or t
  modified_base (521)..(521): a, c, t, g, unknown or other
  misc_feature (521)..(521): n is a, c, g, or t
  modified_base (542)..(542): a, c, t, g, unknown or other
  misc_feature (542)..(542): n is a, c, g, or t
  modified_base (545)..(545): a, c, t, g, unknown or other
  misc_feature (545)..(545): n is a, c, g, or t
  modified_base (547)..(547): a, c, t, g, unknown or other
  misc_feature (547)..(547): n is a, c, g, or t
tcagagacgcactccacgaccggtgctcgatttagcacacgatagttgggtttgggggatcaggactcctcagttcaccttctcacaatgaggctccctgctcagctcctgggctgctaatgctctgggtccccaggatccagtgggggatgttgtggtgactcagtctccactctccctgcccgtcacccttggacagccggcctccatcctcctgcaggtctggtcaaacgcctcgtgtacggtgatggaaacacctacttgaattggtatcagcagagccaggccaatctaccaaggccacctaatctaattaacggttcctaaccgggacgcgtgggtacccagacagattcgagcgcacgtgggtcaggcactgatttcgactacgtagaagtaattacggcgtaagggtggaggctaggaaggtnttgggttgggtattttacgttcgtgctatgacaagcctacactcgtagcccttagttacgtttggacccgagggaccaacgcgtaggaanagtacaaacgtacgtgcgacnacncngttcg

SEQ ID NO: 236360 - DNA, 717 bp, Homo sapiens
  misc_feature: GYAE6OF01CY6PZ.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccactcctcctgccaggtctggtacaaagcctcgtgtacggtgataggaaacacctacttgaattggtatcagcagacggaccgaggccaatctaccgaaggccgcctaatctagtaacggtttcgtaaccgggacgcgtcggggtacccagacagacttcgaagcgcacgtgggtacaggcactgactttccacacgtgaagtaattacggacgtaggggtacggagggcgtaggtaaggtagttagggttacgggttaatttttacgtttccgtagtaccgtagttacggtacgtaaacgtaccttaaccgtaaccgtaaccgttcgggttaacccggttaacgtttacccgggtttttaccggaaccgggttaaccgggggaaaccctaaagggtacccggtttaaggggaaacggtaaaccttaaaccggtaaaaaacccggttaaaccggtttacggggttaccggtaaccgttacgggacccctaacccggtaccgttttacccgg

SEQ ID NO: 236361 - DNA, 536 bp, Homo sapiens
  misc_feature: GYAE6OF01AWD7K.3.35.D02.1.454.CMB.1.raw
  modified_base (439)..(439): a, c, t, g, unknown or other
  misc_feature (439)..(439): n is a, c, g, or t
  modified_base (526)..(526): a, c, t, g, unknown or other
  misc_feature (526)..(526): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaagcgcctaatctataaggtttctaaccgggacgctggggtcccagacagattcagcggcactgggtcaggcactgactttcacactcgagtaattagcgagggtggaggcgtgaggatggttgggtatttatttctgctatcganaagctacacgacgtcggccgttacacgttttggccgtaggggaccaaggcgtgggagactacgaaacgtaactcggtggactagccnccgtattccg

SEQ ID NO: 236362 - DNA, 770 bp, Homo sapiens
  misc_feature: GYAE6OF01DZ036.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacacgcccggcctccactctcctgcaggtctgtacaagcctcgtgtacggtgagtacggaaactacctacttgaagttggtatacagacgagaggaccgaggaccaactccgtaccgaacggccgtaccttaaacttacttaaacgttaacgggttttaccgtaaacccggggaccgtaccggttcgggggtaccccaacggaacctaagacgtttacgacggaccgcgtacggtgggtaccgacggactacgtagttactttaccacgacgttacggaagtaacgttaggaccggtaagggggtacgggtagggtacggttagggagggttaaggtttaggtttagggttttaagttttaacgttttcgtaggtactagttacggactaacgtacctaacgtaccgtaacgttcgggtacccgttaaccgttaccggttttacgggacccggtaacggggtaacccgtaaggtccggtaagggaacggtaaaccgttaaacccgtaaaaccgggttaaccgttacggggttaccggtaccggttaccgaacccgtaaacccgttgtttaccccgg

SEQ ID NO: 236363 - DNA, 550 bp, Homo sapiens
  misc_feature: GYAE6OF01E1IRT.3.35.D02.1.454.CMB.1.raw
  modified_base (543)..(543): a, c, t, g, unknown or other
  misc_feature (543)..(543): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgtggtctctggattcaccttcagggaccacttcatggactgggtccgccaggcctccgaggggaggggctggagtgggttgccgtataagaaacaagctagaagttacaccacagatacgccgcgtctgtgacaggcagattcaccatctcaagagatgattcaagcaactcagtgtctctgacaaatgaacacctgaacgacgaggacacggccgtactattactgcgctacagattcatatgagtctacgactacgtcgggccaacggacgacctggtcctaccgtcctcctacacgccctaccaccgacgggccacgtccgtcccttccccgtcggccgcccgtcgcccgtccgacggtacaccgacctccgngcgaccg

SEQ ID NO: 236364 - DNA, 588 bp, Homo sapiens
  misc_feature: GYAE6OF01EC7TB.3.35.D02.1.454.CMB.1.raw
tcagagacgcactccacgaccggtgctcgatttagcacacgatagttgggtttgggggatcaggactcctcagttcaccttctcacaatgaggctcactgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttagaattggtatcagcagaggccaggccaatcctaccaaggccgacctaatctataaggtttcaaccgggacgcgtgggtcccagacagatcgagcgcacgtgggtcaggcacgtgatttcactactgaagtaattagcgagggtggaggctaggaggtagttggttagggttattttagtttcgtgtactagtgacgaacgtctaacgtactaccgtcggacccgttacgtacgtttcgggacccggtacggggaaccctaacggtcgtagggaacgtacgtaacgaaaaccgtaacgtgggtacggacgtacgcccgtaaccgtacg

SEQ ID NO: 236365 - DNA, 826 bp, Homo sapiens
  misc_feature: GYAE6OF01CS2CL.3.35.D02.1.454.CMB.1.raw
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgtggtctctggattcaccttcagggaccacttcatggactgggtccgccaggctccgagggaagggctggagtgggtggccaacgttgaagccagatggaagtgaagaaatactatgtggactcgtgtggaggggacgattcaaccgtatttccgagaacgaacgaaacgaccaaagaactcaattagtactctagacaaagtcggaacagtccctagaacgacccggaggacctacggtctagttttaattcgtagtcggaccggtccgttaggggacctaacgtacgggtaaaaaccgtaccggttacggggaacccgtaaccggggtaaaccccgttacgggtacccgtaaacccggttccgtaccccgttaccaaccggtccccgttaaccccaacccggtaaacccggggtacccccgtaacggtttccccccggggttaaccccttttccccccccgggagggttccccccggtacccccgttacgggtacccccgtttacccggaaacccggggtaaccggtaccccgtaaaccccccggttaccccgggaaacggacccgggtaccccgaaaccccgtaccggggtacccccggggtaccccccgggttacgggggaccccgtttccgggcccccgtttaaacccgggggg

SEQ ID NO: 236366 - DNA, 803 bp, Homo sapiens
  misc_feature: GYAE6OF01CSCZ7.3.35.D02.1.454.CMB.1.raw
  modified_base (250)..(250): a, c, t, g, unknown or other
  misc_feature (250)..(250): n is a, c, g, or t
tcagagacgcactccacgaccggtgctcgatttagcacacgatagttgggtttgggggatcaggactcctcagttcaccttctcacaatgaagctccctgctcagctcctggggctgctaatgctctgggtcccaggatccaggtggggatgttgtggtgactcagtctccactctccctgcccgtccacccttggacagcccggcctccatctcctgcgaggtctggtacaaagtcctcgtgtacggtnatacggaaactacctacttgtaattggtatacgagacgaggacggccgaaggaccaaattccgaccgaaggccgtaccttaaatctaagtttaacggtttaccgtaaaccggggacgtccgtcggggtacccaaggacaggtaacttcgaaggccggactaaccggtcgggtaccgaacggtacctaacgttacggtaacttttaccaaacgaaccgttaggaaacggttaaagtttaacgggaccggtaaggggggttaaggggaagggtaccggtaagggtaaggggttaaggtttaggggtttaagggggtttaatttttacgttttcgtacgtacgtaagttacggaacctaaagggtaccctaacgaacccgtaacgttccgggtacccgtttaacccggttaccggtttttacgggaacccgggtaaaccggggtaaacccgtaaacggtaccggttagggaaaggtaaccgttaaaccggtaaaaaccggtaaccgttacgggttaccgggtacttaccggaaccctaacccgtagtttaccccgg

SEQ ID NO: 236367 - DNA, 557 bp, Homo sapiens
  misc_feature: GYAE6OF01CPPXV.3.35.D02.1.454.CMB.1.raw
  modified_base (423)..(423): a, c, t, g, unknown or other
  misc_feature (423)..(423): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgtggtctctggattcaccttcagggaccacttcatggactgggtccgccaggctccgagggaaggggctggagtgggttggccgtataaagaaacaaagctagaagttacaccacagattacgccgcgtctgtgacaggcagattcaccatcctacaagagatgattcaagcaaactcgagtgtctctgacaaatgaaacaccctagaagaccgaggacacggcctactattactgcgctacagtatcatatgganctacgactacgcgggccacggagacctggtccaccgtctcctcacgcctaccaccgaacggcccacgtcccgtccttcccccgtcggcccgtccctcgccgtaccgacggacgcccaccctccgacgacgaccg

SEQ ID NO: 236368 - DNA, 584 bp, Homo sapiens
  misc_feature: GYAE6OF01C3NX3.3.35.D02.1.454.CMB.1.raw
  modified_base (297)..(297): a, c, t, g, unknown or other
  misc_feature (297)..(297): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaatggtatcagcagaggcaggccaatctccaaggcncctaatctataaggtttctaacgggacgcgtgggtcccagacagattcagcggcacgtgggtcaggcacgtgatttccaacactgaagaatagacgagggtaggaggcgtggaggagttggttgggtatttatttctgtctatcgacaacgtacctaacgaccgtacgtcggaccgttaaccgtaccgttttgggaccgtacgggggaacccaaggtaccgtacgggataacgtaaccgaaaaccgtaacgtacggttcggacctacggaccaaccgtaacgttccg

SEQ ID NO: 236369 - DNA, 723 bp, Homo sapiens
  misc_feature: GYAE6OF01BZ3OZ.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcaccctggacagccggcctccatctcctgcaggtctggtcaaagcctcgtgtacggtgataggaaactacctacttagaattggtatcagacagacggccaggaccaatctaccgaacggcgtacctaatctaagttaacggtttaccgtaaaccgggacgtcgtacggggtaccaaggtacgagtacttacgaggtccggacgtacgtcgggtacgaggtactacgttagtaacttttaccgaaccgtacgtagtaagtaagtttacggacgggtaaggggtagggaagggtcgtagggtaagggtaaggtttggggtttagggttaatttttagttttacgtaggtacctagtcgtaacgtaacgtaccttaaccgaacgttaccgtaccgggttaccgttaaccgtttacggtttaccgggacccggtaaaggggaaccccgtaaggtaccggtaggtaacggtaacgtaaaccgtaaaaccggtaacgttacgggtaccggtaccgttaccggaacctaccgtacgtttacccg

SEQ ID NO: 236370 - DNA, 575 bp, Homo sapiens
  misc_feature: GYAE6OF01BKX04.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatacggaaacacctacttgaattggtatcagcagaggccaggccaatctaccaaggcgacctaatctataaggtttccaaccgggacgcgtcgggtcccagacagattcgagcggcacgtgggtcaggcacgtgtatttcacactagaagtaagttagcgagggtggaggcgtggaggtagttggttagggttatttagtttcgtgtctagtgacaagctacacgtacgtcgtaccgtactacgtttcggaccggtacgggtaccgaacggccgtagggagacgtaaccgaaaccgtaacgtggtacggctacgacctaccgtagttaccg

SEQ ID NO: 236371 - DNA, 600 bp, Homo sapiens
  misc_feature: GYAE6OF01BJFW5.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtacaaagcctcgtgtacggtgataggaaacacctacttgaattggtatcagcagaggccaggccaatctaccaaggcgcctaatctaattaaggtttctaaccgggacgcgtcgggtcccagacagtattcgacgcggcacgtgggtacaggcactgtactttcactacgtagagtaattagcgagggtggaggtcgtaggaggtagtgggttaggtaattttagtttcgtgtacgtagtagacaacgtctaaccgacgtaccgtcggtacccgttacgttacgtttacggacccggtaacggggtacccaaagggtccgtaggagtaacgtaccgaaaacgtacgtgtacggtactacggcctaccgtgttaccg

SEQ ID NO: 236372 - DNA, 543 bp, Homo sapiens
  misc_feature: GYAE6OF01BBQ9O.3.35.D02.1.454.CMB.1.raw
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgtggtctctggattcaccttcagggaccacttcatggactgggtccgccaggctccagggaaggggctggagtgggttgccgtataagaaacaaagctagaagttacacacagattacgccgcgtctgtgacaggcagattcaccatctcaagagatgattcaagcaactcagtgtctctgacaaatcgaacaccctgaagaccgaggacacggcctctattactgcgctacagattcatattggagctacgactacgtgggccacggagacctggtccaccgtctcctcacgcctccaccgacgggcccatccggtccttcccccgtcggcccgccctcgcctcccgacggtacgccaccctccgacgcgacccg

SEQ ID NO: 236373 - DNA, 758 bp, Homo sapiens
  misc_feature: GYAE6OF01A5P1S.3.35.D02.1.454.CMB.1.raw
  modified_base (744)..(744): a, c, t, g, unknown or other
  misc_feature (744)..(744): n is a, c, g, or t
  modified_base (752)..(752): a, c, t, g, unknown or other
  misc_feature (752)..(752): n is a, c, g, or t
tcagagacgcactccacgaccggtgctcgatttagcacacgatagttgggtttgggggagtcgaggactcctcagttcaccttctcacaatgagctccctgctcagctcctggggctgctaatgctcgtggtcccaggatccagtgggatgttgtggtgactcagtctccactctccctgcccgtctaccgttcggactcgccggcctccacttcctctcgcgacggttcgtggttaccaaaagtcccgttccggttaggttaccgggtagtaacggttacggaaaaacccgtacccgttaaccgttacggtaaaagtttcggggtaacttacgaacggtaccgtacggtaacggaccccgtaacgggtaccctaacgttaccgtacccgaaacgggtccggtaaccctaagttactaagttaacgggtttacctaaccgggaccgtacggtcggggtaccacgtaacgtacggacttaccgaggacggactacggtacggtcgtaaggaccgtaacgtcggtatttacccgaccgttaacgtaggtaacgtacgttaacggtacggtaacgggtagggtaaccgtcggtaaggttacgggtagtttacgggtttagggttaatttacgtttacggtagtacgacgttagtacgtaacgacgttacaccgtacgtccggtacgtacgttacgttacggacgttacgggacctagtcgtaggtacagtacgacgagtcgtagacngacctagngtaccg

SEQ ID NO: 236374 - DNA, 744 bp, Homo sapiens
  misc_feature: GYAE6OF01C1A2U.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtccccaggatccagtggggatgttgtggtgactcagtctccactctccctgcccgtcacccttggacagccggcctccatctcctgcagtctggtcaaagcctcgtgtacggtgatggaaacacctacttgaattggtatcgagcaggacggccaggcctaaatcctaccgaaggccgtaccctaattcctaattaaagggttttacctaaaccggggtacgtcgtcggggtccccaggaacagattcgagtcggcacgtgggtcaggcctacgtgtaactttccactaccgtagtaacgtaaatttaggacgtaggggtgggagggtcgttaggaagggtacgttagggtttcggggttaatttttacgttttcgtcggtacgtaagtcgaacgtaacgaccttaaccgtaaccgtacggttacggtaccccggtttaacgttaccggtttttacgggacccggtaacggggtaaacccgtaacgggtaccggttaacggggtaacggttaaacgttaaacccgggtaaaaacccggtaaccggtttacgggttaaaccggggtaccgttaaccgggtaaaccccgtaacccgttaaccggttttaccccggg

SEQ ID NO: 236375 - DNA, 759 bp, Homo sapiens
  misc_feature: GYAE6OF01BB1SK.3.35.D02.1.454.CMB.1.raw
  modified_base (167)..(167): a, c, t, g, unknown or other
  misc_feature (167)..(167): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctggtcccaggatccagtggggatgttgtggtgactcagtcnccactctccctgcccgtcacccttggacacgcccggcctccatcctcctcgcaggtctggtacaaacgtcctcggtgtacggtgatacggaaacctacctacttagtaacttggtatcgagcagacggccgacggacctaatcctaccgaaaggccgtaaccttaatactaagttaacggtttaccgaaccgggacgtccggtacggggtacccaggtaacgacgtagtccgaacggtccggtaccgtaacgtcggggtaccgacgggtaccctaacgttacggttaactttacccgaacgtaaccgttacggtaacgttaaagttacggaacgggtaacgggggtagggtaacgggtaccgtagggtaaacggttagtttaggggtttagggttaactttttacgtttacgtcggtacgttaacgtaccggtactaaccggtactaaaccgtacgtacccggttaggtaccccgttaacgttccggtttacgggaccggttaacggggaccctaaggtccgtaaggtaataaccggtactaaaacgggtaccttagggtaccgacgttacggacctaaccgttgttacccg

SEQ ID NO: 236376 - DNA, 606 bp, Homo sapiens
  misc_feature: GYAE6OF01DJHGE.3.35.D02.1.454.CMB.1.raw
  modified_base (256)..(256): a, c, t, g, unknown or other
  misc_feature (256)..(256): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagccgtcgtgtacggtgataggaaaccnctacttgaattggtatcagcagaggccaggccaatctcaaggcgcctaatctaagtaacggtttcaaccgggacgcgtgggtcccagacagacttcgagcgctacgtggtcaggctactgtacttcacactagaagtaattaagacgaggggtaggaggtacgtggaggtagtaggtttagggtattttagtttctaggctagtacgacgtaaacgactaacgaccgtacgttaccggtacccgtttaacgtaccgttttacgggacccgtaacggggtaccaaaggtccgtaggaaggaacgtacgaaaacggtaacgtcggtacggacctagcctaaccgtgttaccg

SEQ ID NO: 236377 - DNA, 611 bp, Homo sapiens
  misc_feature: GYAE6OF01DIQ23.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctgggtcccaggatccaggtggggatgttgtggtgactcagtctccactctccctgcccgtcacccttggacagccggcctccatcctcctgcaggtctggtacaaacgcctcgtgtacggtgatacggaaacacctacttagaattggtatcagcagacggccaggaccatctaccaaggccgacctaatctagttaacggtttacgaaccgggacgcgtcgggcccctagacagacttcgacgcggcacgtgggtcaggcagtgtatttcactactgaacgtaatagacgtaggggtggaggtcgtacggaggtacgttgggttagggttaactttttcgttacgtcgtacagttagacgaacgtactaacctacgtacgtcggtaccttacgttacgtttcgggacccgtaagggacctaaggccgtaaggataacgtaacgaaacgtaacgtcggtcggacgtacgaacctcgtacgttaccg

SEQ ID NO: 236378 - DNA, 632 bp, Homo sapiens
  misc_feature: GYAE6OF01DM6QN.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctggggtcccaggatccagtggggatgttgtggtgactcagtctccactctccctgcccgtcaccctggacagccgcctccatctcctgcaggtctggtcaaagcctcgtgtacggtgatggaaacacctacttgaattggtatcagcagagccaggccaatctaccaaggcgacctaatctaagttaacggtttaccgtaaaccgggacgtcgtcggggtacccagacagattcgagtcggcacgtggtcagcactgtatttcactacgtagagtaataggacgtagggtaggaggactaggaagggtattggggttagggttaatttttacgtttcgttacgtacgtaagtcggtaacaacggtacctaaccgaaccgtacgttaccgggtacccgttaacgttaccgtttacgggacccggtaacgggacccgtaaggtccgtaacgggagtaactacgaaaccgtaacgttacgggtcggacttagaccctacgtacgttccg

SEQ ID NO: 236379 - DNA, 586 bp, Homo sapiens
  misc_feature: GYAE6OF01ASUTI.3.35.D02.1.454.CMB.1.raw
  modified_base (396)..(396): a, c, t, g, unknown or other
  misc_feature (396)..(396): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtacaaagcctcgtgtacggtgatggaaacacctacttgaattggtatcagcagaggccaggccaatctccgaaggcgcctaatctataacggttctaacgggcgcgtcgggtcccagacagattcagcgcacgtggtcaggcactgtactttcactactagagtaattacgngacgggtggaggcgtaggagggtagttgggttagggttattttacgtttcgtagtcgtatggtacaagtacctacaccgtacgtcgggtacccgttacgtacgtttcggaccggacggggtacccaaggtccgtagggtacgaacgtaccgaaacggtagttcggtacgcgtagaccagtaacgttacgg

SEQ ID NO: 236380 - DNA, 619 bp, Homo sapiens
  misc_feature: GYAE6OF01B12E7.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgccccgtcacccttggacagccggcctccatctcctgcaggtctggtcaaagcctgtgtacggtgatggaaacactactgaattggtatcagcagaggccaggccgtaatctaccaaggcgcctaatctataaggttctaaccgggacgcgtcggggtccagacagattcgagtcggcacgtggtcgagcactgtactttcactactgtaagtaattaggcgagggtggaggtcgtaggtaggtagttggttagggttattttagtttaccgtgtcgtagtgacgtaagaccttaacgactaaccggtggtacccgttaacgtacgttttacggacccggtaacggggtacccaacggtacggtagggaacgtacgttaaaccgaaaaccggtaaacgttggtacggtacggttacgcccgtaaccgtacgtttacccgg

SEQ ID NO: 236381 - DNA, 713 bp, Homo sapiens
  misc_feature: GYAE6OF01EB9AZ.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccaggtggggatgttgtggtgactcagtctccactcctccctcgcccgtcacccttggacacgccggcctccatctcctgcaggtctgtacaagcctcgtggtacggtgagtaggaaaccaccttacttagaagttggtatcagcgaggacggaccaggaccctaatccgtaccgaacgggtccgaccttaactcttaagttaacgggttttacgtaaaccggggtaccggtacggtcggggtaccccaaggacgaagtacgttcgacggacggcgacgtgggtacacggtacacgtgtactttacactacgtagaagtaagttaggacggtagggtgggtacgggcgttaggtaaggtagtttgggttaggggtttaattttcgtttcgtgtactagtcgaacgtaacgtaccgtaacgaccgtaccggttaccggtaacccgttacgttaccgggtttcgggacccggaaacggggtaccgtaaacggtcgggttaggaacgtaacggtaaacccgaaaacgggtagttacggggtacgtacccggttacgaaccctaccgtacgttcccgg

SEQ ID NO: 236382 - DNA, 624 bp, Homo sapiens
  misc_feature: GYAE6OF01ENXJ9.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccgaaggcgcctaatctaataggtttctaaccgggacgcgtcggggtcccagacagattcgagcggcacgtgggtcacggcactgtatttcacactagagaattagcgagggtgggaggcgtggaggtagttgggtttagggttacttttagtttacgttgtacgtagttgacaaaggtacctaacgtaaccgtaacggttcggttacccgttaacgttacggttttccggacccggtaacggggaacccgtaaggtccggtaggaggtaacgtaaccgaaaaccggtaaacggttcggtaggtacccgtagtacccgtaccgagtttacccg

SEQ ID NO: 236383 - DNA, 597 bp, Homo sapiens
  misc_feature: GYAE6OF01D61PP.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtacaaagcctcgtgtacggtgataggaaacacctacttgaattggtatcagcagaggccaggccaatctccaaggcgcctaatctataagttctaaccgggacgcgtgggtaccagacagatcagcgcacgtggtcaggctactgtactttcactactagacgtaattagacgagggtggaggtcgtggaggtagtggttagggtattttagtttctgtactagttcgacaagtcctaaccgaacgtacgttacgggtacccgttaaccgttacgttttacgggacccggtaacggggaccctaaaggtcgtacgggaaggtacgtaaccgaaaccgtaacgttaggtcggactaggaccaaccgtagttccg

SEQ ID NO: 236384 - DNA, 690 bp, Homo sapiens
  misc_feature: GYAE6OF01CKY28.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccgttggacagccggcctccatctcctgcaggtctggtcaaagcctcgtgtacggtgataggaaaccacctaacttgaattggtatcagcagacggccaggaccaatcctaccgaaacgggccacccttaaatcctaagttaaacggttttccgtaaaccggggaccgtcgtcggggtcccagaccagtacttacgagccggtcgacgtgggtaccaggaccattacgtatttaccgaactaccgtagaagtaagtttaaggtacggggtaggtagggcgttaggacgggtagttggtttacgggttaatttttacgtttcgtagtacgttagtccggactaagtcctaacgtaacctaccgttcgggtaccgttaccgttaacgttttcggacccggtaacgggggtaacccaagggtccggttaagggacggtaactaaccgtaaaacggtaaccggttggtaacggtctacggaacctacccgtagttcccgtttacgg

SEQ ID NO: 236385 - DNA, 656 bp, Homo sapiens
  misc_feature: GYAE6OF01EG46L.3.35.D02.1.454.CMB.1.raw
  modified_base (295)..(295): a, c, t, g, unknown or other
  misc_feature (295)..(295): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacacgccggcctccatcctcctgcaggtctgtacaaagcctcgtgtacggtgataggaacacctacgtgaattggtatcagcagaggccaggaccaatccnccgaaggccgacctaatctaagttaacggtttactaaccgggacgtcgtcggggtccccagacagacttcgaggcgcgtacgtcgggtcgaggcactacgtactttaccgacctacgtagaagtaacgttaggacggacggggtagggaggtcgtaggaagggtagttgggtttagggttattttagtttcgtgtacgtatcggacaacgtactaacgaccgtacgttcggtacccgttacgtaccgtttacgggaccggtaacggggtaccaacggtcggtacggtaaggtaacgttaaaccggaaaaccgtaacggtacgggttacggtacgtaccggtaccgtaaccctgtttacccg

SEQ ID NO: 236386 - DNA, 584 bp, Homo sapiens
  misc_feature: GYAE6OF01BADXW.3.35.D02.1.454.CMB.1.raw
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgtggtctctggattcaccttcagggaccacttcatggactgggtccgccaggctccgagggagggctggagtggtgccgtataagaaacaagctagaagttacacacagattacgccgcgtctgtgacaggcagattcaccatctcaagagatgattcaagcaactcagtgtctctgacaaatcgaacaccctagaacgaccgagacacggcctctactactgcgctacagattcaatatagacactacgactacgtgggaccacggacgaccgtggtaccaccgtcctacctcgacgccctacccgaccgaacgggccctagtcccggttacccttccccccgtcgggaccccgtccccgtcgccccgtacccgacgggtaccacccgtaccccgtcccgacggaccgtaccccgg

SEQ ID NO: 236387 - DNA, 967 bp, Homo sapiens
  misc_feature: GYAE6OF01CVDP2.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttagtaattggtatcgagcagaggccaggccaatcctaccgaaggcgacctaatcttaagttaaggtttcctaaaccggggacgtacgtcggggtaccccaaggtaacacgtactttcgaacggcgggaccgtacgtaggggtccaagggacctaacgtaggttaaccttttaccgaaaccgtaaccgttggaaacggttaaacggtttacggtaccggggtaaggggggttacgggggtaacgggtaccggttaaggggtaaacggggtaagggttttacgggggttttaacggggggtttaaatttttttaacggttttacccggtttacgggttaaccccgttaaggtttacgggtaacccggttaaaaccggttacccgttaaaaccccggttaaacccgttaaacccggggtttacccgggggttaaaccccccgtttttaaacccggggtttaaccccgggttttttttaaccggggggaaacccccggggttaaaaacccgggggggggtaaacccccgtaaaaacggggttcccgggtttaaacggggggtaaaacccggttaaaaccggtttaaaaacccccgttaaaaaaaacccggggtaaaccccgggtttttacgggggttaaccccgggggtttaacccggttaaccgggtaaaccccccgttaaaaccccgtttaccgtttttaaacccccggg

SEQ ID NO: 236388 - DNA, 668 bp, Homo sapiens
  misc_feature: GYAE6OF01CKA2Q.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcagtctggtcaaagcctcgtgtacggtgatacggaaacacctacttagaattggtatcagcagacggccaggccaatctaccaaggccacctaactcttaagttaacggttacctaaccgggacgcgtcgggtacccagacagtattcgagcggactacggtgggtacacggcctacgtgtactttcgaacctacgtagaacgtaagtttacggaccggtagggtacgggaacggtcgtagggtagggttagtttacgggtttagggttaactttttaacgtttcgtaggtacgttaacgtcgtaaccgaacgtacctaactaccgtacgtacggtacccgttaacgttaccggtttacggaacccgggtacgggtaaccgtacggcgttaacgggagtaacgtaaccggaaacgtacgttggtacgtaccgtacgacctaccgtattacccg

SEQ ID NO: 236389 - DNA, 704 bp, Homo sapiens
  misc_feature: GYAE6OF01CD52N.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttgacagccgcctccatcctcctgcagtctgtcaaacgcctcgtgtacggtgataggaactacctacttgtaattggtatcagacgagacggccaacggaccaatccgtaccgaaggccgacctaatacttaacgttaacggtttaccgtaaccgggacgtcgtacgggtaccccaagacagtacgttcgacgcggacacgtgggtacgacggacacgtgtactttacactacgtagaagtaagttagcggtagggtacgggaggtcgtaggaggttaggttaggttagggtttagttttaacgtttcgtacggtactagttacggactaacggttacctaacgaaccgttacggtacggttaccccggtttaacgttaccggttttacgggaacccgggtaacggggtaaccgtaaaggtccgggttaggaaacggttaacgtaaaccggttaaaaccggaacgttagggttacccggtctaaccgggtaccctaaccgtacgtttaccccgg

SEQ ID NO: 236390 - DNA, 572 bp, Homo sapiens
  misc_feature: GYAE6OF01EGJ9N.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacacgccggcctccatctcctgcaggtctggtacaagcctcgtgtacggtgataggaaacacctacttgaattggtatcagcagaggccaggccaatctacaaggcgacctaatctaagtaaggtttctaaccgggacgtcgtcggggtaccccagacagtattcagcggcacgtgggtcaggcacgtgtactttcgactacgtagaacgtaattaggacgtaggggtgggaggtcgtaggaggtagtggttggtatttagtttctgctatgacaagactacactacgtcggaccgttacgtacgtttggaccggtaagggaccaagtcgtaggtagacgtacgaaacgacgtacgtcggactacgcaccgtattccg

SEQ ID NO: 236391 - DNA, 624 bp, Homo sapiens
  misc_feature: GYAE6OF01CTJ7O.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacaccttacttgtaattggtatcagcagaggccaggccaatctccgaaggcgacctaatctataaggtttctaaccgggcgcgtgggtcccagacagattcgagcggcacgtgggtacaggcacgtgatttcactacgtgaagtaattaggacgtaggggtggaggtcgtaggtaagggtagttgggttaggggttattttagtttcgtagtcgtagtagactaaagtcctaacgaaccgtacgtacggtaccgttaaccgttaccggttttacgggacccgtacgggggtaaccctaaggtacgtagggaacgtaacgtaaaccgtaaaccgtaacgttaggtacggactacggtaccaaccgtgttacccgg

SEQ ID NO: 236392 - DNA, 575 bp, Homo sapiens
  misc_feature: GYAE6OF01AZBW1.3.35.D02.1.454.CMB.1.raw
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgtggtctctggattcaccttcagggaccacttcatggactgggtccgccaggctccagggaaggggctggagtgggttggccgtataagaaacaagctagaagttacacacagattacgccgcgtctgtgacaggcagattcaccatcctacaagagatgattcaagcaatcagtgtctctgactaaatcgaacaccctagaacgaccgaggaccacggccttctacttactcgcgactacagtattacatagtgtagctaacgactacgtcgggaccgacggacgacctggtcctaccgtcctccgtacacgccctaccaccgacggcccatccggtcccttcccccgtcggcccgtaccccgtcgcccgtccgacggtaccgacccacccgtcccgaggcgacccg

SEQ ID NO: 236393 - DNA, 724 bp, Homo sapiens
  misc_feature: GYAE6OF01BE4HR.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccaggtggggatggttgtggtgactcagtctccactctccctgcccgtcacccttggacacgccggcctccatcctctgcaggtctggtacaaagcctcgtagtacggtgataggaaactaccttacgttagtaagtttggtatacgagacgaggacggacctaggaccaaattcctaccgaaacgggcctaccttaaatccttaagttaacggttttaccgtaaaccggggacgtccggttacgggggtaaccccaagaccgtaagtacttaccggaggccggactacggtcggggtacaggtaccgtacgtcgtactttacgaactacgttaggtaacgtaagttaggacggaggggttagggaggtcgtagggtaaggtaggttagggttaggttaattttacgtttcgtagtacgtagttgaacgtaacgtaccttacgaacgtaccgttacggtaccgtttacgttaccgttttaccgggaccggtaacggggaaccgtaacggtaccggtagggtaacgtaacgtaaaccggtaaaacggtacgttaggtacggacgttagaccgtacgtacttaccgg

SEQ ID NO: 236394 - DNA, 762 bp, Homo sapiens
  misc_feature: GYAE6OF01C36N0.3.35.D02.1.454.CMB.1.raw
  modified_base (244)..(244): a, c, t, g, unknown or other
  misc_feature (244)..(244): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctcatcctcctgcaggtctggtcaaagcctcgtgtacggtnatggaaacacctacttagaattggtatcagcagacggccgaggcccaatcctaccgaaacggccgtacctaaatctaagttaaacggtttccgaaaccgggtacgacgtcggggtaccccaaggacaagtacttccgagtccggacacgtacggggtcaggtaccacttaggtactttaccaacgtacttacgggaagtaaagtttacggaaccggtaaggggggtacgggaacgggtcgttagggtaaacggggttaggtttaggggttttaggggttaaatttttttagttccgtttaacggtaccgtacgttacgggtaacgtaaacggtaacccggttaaaccaaccgttaccggttaccgggtaccccgttaaaccgtttacggtttttaccggggaacccggtaaccgggggtaaaaccccgtaagggtcccggttaaggggaacgttaacgtaaaacccgtaaaaccggaacgtcgggtacgaccgtacgtacccaaaccgtcgttaaccg

SEQ ID NO: 236395 - DNA, 722 bp, Homo sapiens
  misc_feature: GYAE6OF01DLE8G.3.35.D02.1.454.CMB.1.raw
  modified_base (201)..(201): a, c, t, g, unknown or other
  misc_feature (201)..(201): n is a, c, g, or t
tcagagacgcactccacgaccggtgctcgatttagcacacgatagttgggtttgggggatcaggactcctcagttcaccttctcacaatgaggctccctgctcagctccgtgggctgctaatgctcgtggtcccaggatccgaggtggggatgttggtggtgactcagtctccactcctccctcgcccgtcacccgtgacncgccgcctccatcctccgtgcgtaggtcgttacggtacaaacggtcccttcggtaggtaccggtgaagtacggaaaacctactacgttagtaagttggtaactacgagacgaagacggaccgacggacctaacgtccgtaccgaacggtccctaaccgtaaagttaccgtaagttaacggtttacccggtaaaccgggaccgtccggttccgggtacccaacgtacgaacgtacttaccgacggtaccggactaacggtgggtaccgacggtactacgtacgtacttacacgtacgtagagtaaacgttagcgggtagggtacggaggtacggtaaggtaggtaagttgggtttaacggttatttaagttccgtagtacgtagtacgtacgtaacgtaacctactaccgtacgtacggttaccctacggttacgttcgggaaccgaccgggtaacgtagtacggtaaggtagtaaaccgtaacggtaaacgtaacgtgtacgtcgacgacctactgttccg

SEQ ID NO: 236396 - DNA, 713 bp, Homo sapiens
  misc_feature: GYAE6OF01ENL3D.3.35.D02.1.454.CMB.1.raw
tcagagacgcactccacgaccggtgctcgatttagcacacgatagttgggtttgggggatcaggactcctcagttcaccttctcacaatgaggctccctgctcagctccgtggggctgctaatgctctgggtcccaggatccgagtggggatgttgtggtgactcagtctccactctccctgcccgtcacccttggacacgccgcctccatcctcctgcgaggtctggtacaaagtcctcgtgtacggtgagtacggaaactaccttacgttagtaagttcggtatacagacaaggacggccaacggaccaaacttccaccggaaggcctacctaaattctaagttaacgggtttacctaaccgggacgtccggtacggggtacccaggacagtacttcgaacggcggacacgtcgggtcaggcacgtgtacttcaacgtacgtagtaagtaacgttaggacggtaggggtgggacggtcgtaagggtaggtaggtttgggttagggtttatttttacgtttcgtagtcgtaagttagaacgtaacggtacctaaccgacgtaccgttacgggtacccgttaacgtttacggtttccgggaaccgggtaaccggggtacctaaacggtcggtacgggtaacgtaacggttaaccgtaaaacggttaaccggtgggttaccgacgttaccggaccgtaaccgtaacgtttccgg

SEQ ID NO: 236397 - DNA, 615 bp, Homo sapiens
  misc_feature: GYAE6OF01EM9EY.3.35.D02.1.454.CMB.1.raw
  modified_base (424)..(424): a, c, t, g, unknown or other
  misc_feature (424)..(424): n is a, c, g, or t
  modified_base (450)..(450): a, c, t, g, unknown or other
  misc_feature (450)..(450): n is a, c, g, or t
  modified_base (575)..(575): a, c, t, g, unknown or other
  misc_feature (575)..(575): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacctggacagccggcctccatctcctgcaggtctggtacaaacgcctcgtgtacggtgataggaaactaccttaattagaattggtatcagcagaacggcaggaccaatctaccaaggacgacctaatctaagttaaggttctaaccggacgcgtagggtaccaggacagtactacgagcggacacgtgggtacaggcactgtattacacactgaataacgttagacgagggtggagnaggaggattgtaggtaatttgttacngtacatcgataagtacgtacacgtaccgtcggtaccgttaacgtacgttttcgggaacccggtacgggggaaaccctaaagggtacgtacgggtaaagtacgtaaacccgaaaacgttaaaccgnggttaccggtactacgggaaccttaaaccccgtgttaccg

SEQ ID NO: 236398 - DNA, 925 bp, Homo sapiens
  misc_feature: GYAE6OF01DEVFV.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctctgcaggtctgtcaacgcctcgtgtacggtagagtacggaaacctaccttacgttagtaaacgtttgggttaacttccgaagccgaaggacgggacccgaagggacccctaaaagttcccgtaccgaaacgggcccgtaacccttaaacgtaccgtttaaacgttttaaaccggggttttacccgtaaaacccgggggtaccgtaccgggttaccgggggtacccccaagggtaaccaaggtactttaccggaacgggtcccgggaccgtacggtacggggttccgaacgggtaccgtaacgtttaggtaacttttaccgaacctaccgttaagggaaagttaaacgtttacggaaccgggtaagggggttacggggaacgggttacggttaagggtaaggggttaaggtttagggggttttaggggttttaacttttttaaggttttccgttacggggttaccttaagggttacgttaacggtaaaccgtaccgttaaacccgtaaccgttaccgggttaccgggttaccccgtttaaaccgtttaccgggttttaacccggggaccccgggtaaacggggggtaaccccctaaagggttacccgggttaaacggggtaaacgttaaacccggtaaaccgttaaaaacccgggttacgttaccgggttacggtaacccgttacggtaaccccaacccgtttacgtttacccgg

SEQ ID NO: 236399 - DNA, 159 bp, Homo sapiens
  misc_feature: GYAE6OF01DU4PY.3.35.D02.1.454.CMB.1.raw
  modified_base (157)..(159): a, c, t, g, unknown or other
  misc_feature (157)..(159): n is a, c, g, or t
tcagagacgcactccacgaccggtgctcgatttagcacacgatagttggttgggctgaccaaggtcaccgtcctaggtcagcccaaggccaacccactgtcactctgttcccacctcctcgagtgcgtctctgagccgggctggcaaggcgcatagnnn

SEQ ID NO: 236400 - DNA, 693 bp, Homo sapiens
  misc_feature: GYAE6OF01CTESA.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctggtcccaggatccagtggggatgttgtggtgactcagtctccactctccctgcccgtcacccttggacagccggcctccatcctcctgcaggtctggtcaaagcctcgtgtacggtgatggaaacaccttacttgaattggtatcagcagacggccacggaccaatccgtaccgaaggccgtacctaatacctaagttaacggtttaccgtaaacccgggacgtcgtcggggtaccccagaccagacttcgacgcgctacgtggtcacggcacgtgactttcacctacgtacgaagtaacgttaggacgtaggggtggtaaggtcgtaggtaacgggtagtttgggttagggttaatttttagtttccgtggtactaagttcgacgtaacggtaccttaaccgtaaccgtacgttaccgggtacccgtttaaccgttacgtttaccgggaacccgggtaacgggtaaaccccgtaaggacggttaacgggaagtaaaccgtaaaccgtaaaaaccggtaccgttcgggtaacgggtccttacggaaccctaaccgtgtttaccccgg

SEQ ID NO: 236401 - DNA, 635 bp, Homo sapiens
  misc_feature: GYAE6OF01BHVIM.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgataggaaacacctacttgtaacttggtatcagcgagacggccaggaccaatctaccgaaggccgacctaatctaataacggtttaccgtaaccgggacgtcgtggggtcccagacgagattcgagtcgcacgtggtcgaggcactgtatttacactactagagtaagttagcgtagggtggaggcgtgaaggtagttggttagggtattttagtttcgtgctatgacgaagtactaccactacggtacgtacccgttacgttaccgttttacggaccggtacggggtaacccgaacggtccggttagggaacggtaacgtaaaccggtaaaacggtaacgttacgggtacgggtaccgtaccgggaccctaacccgtacgtttaaccccgg

SEQ ID NO: 236402 - DNA, 714 bp, Homo sapiens
  misc_feature: GYAE6OF01AEHIS.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtgggatgttgtggtgactcagtcctccactcctccctcgcccgtctacccttggacacgcccggcctccactcctcctgcgaggtcgtggtacaaacgccgtcggtgtacggtgagtacggaaacctaccttacgtagtaacgttggtaactacgacgacgaggacggaccgacggacctaactccgtaccgaacgtccgacctaattaccgttaatttaaaccgggtttaccgtaaacccgggaccgtccggtaccgggtaccctaacgaacgtacgtacgttccgacggtccggactacggtgggtacacggtctagtacgtatttaccgacgtacgtaagaagtaacgtaggtacggagggtacggtacggtagtacggtaaggtagttacgggtttaggtttattttacgtttcgtacgtactagtacgtacgtaacgtaccgtacgtaaccgtacgtacggtaccgttacgttacggtttcggaccggtaacggaccgtagtacggtagtaagtaacgtaaccgtaaacgtagtacgtacgtacgtactacctaccgtcgttaccg

SEQ ID NO: 236403 - DNA, 798 bp, Homo sapiens
  misc_feature: GYAE6OF01CYKQT.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccgcctccatcctcctgcaggtctggtacaaagcctcgtgtacggtgatcggaaacacctacttagaattggtatcagcagacggccaggaccaatctccaaggccgtacctaactactagttaaacggtttccgtaaaccgggcgtaccgtcgggggtacccccaaggaccagtagttaccgaacggtccggtaccgaaccgtttcgggtaccgaacgggtacccaccgttacggtaacttttccaaccgtaaccgttaaggtaacgttaaacgtttaacgggacccggtaaaggggggttcgggtaacggggtaccgttaacggggtaaacggggttaaggtttacggggttttaagggggtttaactttttttaacggttttacccggtttaggtacccgttaagtttaccgggtaacgttaaaacggtacccttaaacccggtaacccgtacccggtttaccggggttaaccccgtttaacccgttacggtttttaccgggaccccggtaaacgggggtaaccccgtaaggtacccgtagggtaacgtaacgtaccgaaaaccggtagtcggtaggcctagacccgtacagttccg

SEQ ID NO: 236404 - DNA, 770 bp, Homo sapiens
  misc_feature: GYAE6OF01DTB9L.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcagtctgtcaaagtcctcgtgtacggtgataggaaacacctacttgaattggtatcagcagacggccacggacctaactccgtaccgaacggccgtaccttaataccttaagtttaaacgggtttacccgtaaaccggggtaccgtccggttaccgggggtaccccaaggtaaccgtaacggtacgtttacgaacgggtacccggtaccgtaaccggttcggggtaccgaacgggtacctaacgttacggttaactttccgaaaccgtacgttaaggtaacgtaaagtttaacgggacgggtaagggggtacgggtaacgggtacgtacgggaagggttagtttcggggtttaagggtttaatttttacgtttcgtacggtacgttaagtaccgtaacgtaacggtacctaacgtaaccgtaccgttacggtacccgttaacgttaccggtttaccgggaccgggtaacgggtaaccctaaggaccggttaggtaacgtaacgtaccgaaaacggtacgtacgggtacgtacgtacgtacctaccgtattaccgg

SEQ ID NO: 236405 - DNA, 657 bp, Homo sapiens
  misc_feature: GYAE6OF01CGKZK.3.35.D02.1.454.CMB.1.raw
  modified_base (387)..(387): a, c, t, g, unknown or other
  misc_feature (387)..(387): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtccaccttggacacgccggcctccatctcctgcaggtctggtacaaagcctcgtgtacggtagataggaaacacctacttgaattggtatcagcagacggccaggccaatctcaacggcgacctaatctaagtaacgtttacgtaaccgggacgcgtcgggtaccaggacagtactacgacgcggcacgtggtcaggcacgtntactttcgactacgtaggacgtaagttagacggtaggggtagacggtacggtggaaggtaggttagggttaggttattttacgtttcgtgtacgtagtcgacgtaacgtacctaacgaccgtacgttacggtacccgttacgttaccgtttccggggaccgtaaccggggtaaccgtaacggtaccggtagggtaacgtaaccgtaaccgaaaaccgggttaaccgttacgggtcggtaccgtacgtaccccgtaacgtacgttacccgg

SEQ ID NO: 236406 - DNA, 625 bp, Homo sapiens
  misc_feature: GYAE6OF01CCYGU.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaagcgcctaatctataaggtttctaaccggacgctggggtcccagacagattcagcggcacgtgggtcaggcactgatttcacactgaagaagttagcgtagggttggaaggtcttaggaagggtattaggttaggggttattttacgttttcgttggacctagttagacgtaaaggtacctaaccgtacctaaccgttcgggtacccgttaaccgtaccgtttttacgggccccgtaagggggaacccctaaaggccgttaagggaagtaactaaccggtaaaaccgtaacttcgggtacggtaccgtaggacccgtaacctacgttacccg

SEQ ID NO: 236407 - DNA, 614 bp, Homo sapiens
  misc_feature: GYAE6OF01ARIEZ.3.35.D02.1.454.CMB.1.raw
  modified_base (251)..(251): a, c, t, g, unknown or other
  misc_feature (251)..(251): n is a, c, g, or t
  modified_base (291)..(291): a, c, t, g, unknown or other
  misc_feature (291)..(291): n is a, c, g, or t
  modified_base (467)..(467): a, c, t, g, unknown or other
  misc_feature (467)..(467): n is a, c, g, or t
  modified_base (604)..(604): a, c, t, g, unknown or other
  misc_feature (604)..(604): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctcgcccgtcctacccttcggacacgccggcctccactctcctgcaggtctggtcaaagtcctcgtgttacggngagtacggaaaccacttacgttacgtaagttaggtactanacgctacggacggccgacggacctaactaccgtaccgaacggccgaccttaactacttacgttaacggtttaccgtaaccgggacgtcgtacgggtaccacgacagtacttacgacgacggcgacgtcggtcgagcacgtgtacttcacactgaagtagtagccgtagggtgcggngtaggagtagtggtttaggtattttagttccgtagtcgtatgacataccgacacgtacgtggttaccctagttaccgttacgggaccgtagggaccctagcgtagtagacgtacgaactagtcggtagtccagtacncgtacgttcg

SEQ ID NO: 236408 - DNA, 718 bp, Homo sapiens
  misc_feature: GYAE6OF01CF5YH.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactcctccctcgcccgtccacccgttggacacgcccggcctccactcctcctgcgaggtctggtacaaacgcctcgtggtacggtgagtacggaaacctacctacttagtaagttggtatcgagcaggacggccaggaccaatccgtaccgaacggccgacctaatactaagttaacggttacgaaccgggacgcgtcgggtaccagacagtactcgagcggcacggtggtacgaggctacgtgtactttcaacgtacgtagaagtaacgttacggacggtaggggtaggagggtacgttagggaacgggtaggtttagggtttagggtttacttttacggtttcgtaggtacttaggtacgtaacgtaacggtacctaacccgtaccgtaaccgttaccgggtaacccgttaaccgtttccggtttaaccgggacccgggtaacggggtaacccgtaacggtacggtaacgggtaacgtaaccggttaaccgaaaaccggttaccggttcgggtacggtaccgtacgtaccctacgtacgtttcccg

SEQ ID NO: 236409 - DNA, 670 bp, Homo sapiens
  misc_feature: GYAE6OF01CR92F.3.35.D02.1.454.CMB.1.raw
  modified_base (446)..(446): a, c, t, g, unknown or other
  misc_feature (446)..(446): n is a, c, g, or t
  modified_base (642)..(642): a, c, t, g, unknown or other
  misc_feature (642)..(642): n is a, c, g, or t
tcagagacgcactccacgaccggtgctcgatttagcacacgatagttgggtttgggggatcaggactcctcagttcaccttctcacaatgaggctccctgctcagctccgtggggctgctaatgctcgtgggtccaggatccgaggtggggatgttggtggtgactcagtcctccactcctcccgtcgcccgtccaccctggacacggccggcctccatcctccgtgctaggtctaggtacaaacgtcgtcgtaggtacggtgtagtaacggaaaacctaccgttaacgttagtaagttaggtaatacgaacgacgaaggaacggaccgaacggacctaaaactccgtaaccgaacggtccaactaaacttacgttaacggttaacggttaccgtaaccgggacgcggtacgggtaccaagactagtacgtcgagcggacgtacgnggtacgagtacctactgtacttacaactacgtagtaagtaattaggacgggagggtagggaggtagtaggtaaggttaggtaggttaggttagtttagttacgtagtctagtacgacaagactaacgaacgtcggtacgtacgtacgtaggttccggacgtaacgggacacgtagaggaagaacgtaacgaaacgntggtacgacacgacgtaccgagttcccg

SEQ ID NO: 236410 - DNA, 856 bp, Homo sapiens
  misc_feature: GYAE6OF01CRO2A.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccaggtggggatgttgtggtgactcagtctccactctcctcgcccgtcacccttggacacgccggcctccactctcctgcgaggtctggtacaaacgccgtcgtcgtacgggtgagtacggaaactaccttacttagtaattggtatcagacaggacggaccgacggaccaactccaccgaaggccgaccttaaacttacgttaacgtttaaacgggttttaccggtaaacccggggtacgtccgggtaccggggtacccgaacggacgaacgtacgtttaccgacgggtcccgggtacgtaccgggttacggggttaccgaacgggtacctaacgtttcggttaactttaccaacgtaaccgtaggtaaagtaacgttaaggaccggtaagggggttaggggaacggttcggtagggtaagggtaggtttagggtttagggggtttaattttttacgttttcgtcggtaaccgtagttaccggtacgtaaacgtaccgttaaccgaaccgtaccggttaccgggttacccgggttaaccgtttaccgggtttttaccgggaacccgggttaaacgggggaaacccgtaaggtacccggtaaacggggttaaacggtaaaccgttaaacccggtaaaaacccgggttaaacgttaccgggttaaccgggggttaccttaccgggtaaacccccttaaccgttccggttttaacccgg

SEQ ID NO: 236411 - DNA, 682 bp, Homo sapiens
  misc_feature: GYAE6OF01EJSHP.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtacaaagcctcgtggtacggtgataggaaacacctacttagaattggtatcagcagacggccgaggaccaatctaccgaaggtccgacctaatactaagttaacggtttacgtaaccgggacgtcgtcgggtcccagacagattcgagcgcacgtgggtacgacggcacgtgtactttcaactacgtaggaagtaaactttaggacggtagggggtagggaacgggtacgtagggtaaagggtacgtttaggggtttacggggtttaatttttacgttttacgtcggtactaaggttcgaacgtaacgtccttaaccaccgtaccgttacggtacccgttaacgttaccggttttacgggaccggtaacgggacccgtaaaggtcggtacggaagtaacgtaaccgtaaacggtaagttcgggtacggaccgttacggacctaaccgtagttacccgg

SEQ ID NO: 236412 - DNA, 620 bp, Homo sapiens
  misc_feature: GYAE6OF01D57UQ.3.35.D02.1.454.CMB.1.raw
  modified_base (244)..(244): a, c, t, g, unknown or other
  misc_feature (244)..(244): n is a, c, g, or t
  modified_base (440)..(440): a, c, t, g, unknown or other
  misc_feature (440)..(440): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtnatggaaacacctacttgtaattggtatcagcagaggccaggacctaatcctaccgaaggccgaccttaaatcctaattaacggtttcctaaaccgggacgtcgtcgggtcccaagaccagtacttcgagcggtcgaacgtcgggtacaggctactgtatttcactactagaagtaagttagacgagggtaggaggngtagaggtagttggttagggttatttagtttcgtgtcgtatagacaacgtactacgacgtacgtcggtaccgttaacgttaccgttttacggaccgtaacggggacctaaggtcgtagggaacgaacgtaccgaaaacggtaacgtcggtacgggtacgttacgacctacgtagttcccg

SEQ ID NO: 236413 - DNA, 665 bp, Homo sapiens
  misc_feature: GYAE6OF01A2RG2.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtacaaagcctcgtgtacggtgataggaaacacctacttgaattggtatcagcagaggccaggaccaactctaccgaaggccgacctaatctaagttaacggtttaccgtaaaccgggacgtaccgtcggggtacccaagactagacttcgacggccggacgacgtcgggtacaggtctacgtgtactttaccgactacgtaggaagtaagtttacgcggtaggggtggaggtacgtaggaaggtagttagggtttacgggtattttacgtttcgtagacgttagtcgacgtaacgtacctaaccgtacgtaaccgttcggtacccgttaacgttacggtttcgggacccgtaacggggaacccaggtaccgtagggtaacgtacgtaaccgtaaacgtaaccgttgggtacggaccgttacgacctacccgtgttacccgg

SEQ ID NO: 236414 - DNA, 725 bp, Homo sapiens
  misc_feature: GYAE6OF01DMQ37.3.35.D02.1.454.CMB.1.raw
  modified_base (473)..(473): a, c, t, g, unknown or other
  misc_feature (473)..(473): n is a, c, g, or t
  modified_base (610)..(610): a, c, t, g, unknown or other
  misc_feature (610)..(610): n is a, c, g, or t
  modified_base (683)..(683): a, c, t, g, unknown or other
  misc_feature (683)..(683): n is a, c, g, or t
tcagagacgcactccacgaccggtgctcgatttagcacacgatagttgggtttgggggatcaggactcctcagttcaccttctcacaatgaggctccctgctcagctccgtggggctgctaatgctcgtgggtcccaggatccaggtggggatgttgtggtgactcagtctccactcctccctcgcccgtccacccgttggaccacgcccggtcctccacttcctcctgacgtaggtctcggtacaaacgcctcggtggtacgggtgagttaacggaaacctaccttacgttagtaagtttacgggtatacgaggcgaaggacggaccacggacctaactaccgaccgaacggtccgtaacttaactacgttaacggtttaaacggttaccgtaaaccgggtacgtacgggtaccggggtacccaacgtacgtaacgtaacttcgacgggtcggaccgtacggtcgggtaccncggtactacgtattaacttaccacgtacgttaagaagttacgtaggacgggaggggtgacggtagtagggacggttagttggggtttaggttacttttagtttcgaggtactagtacggaacgtaagtaccgtaacnccggtaacgtcggttaccttaccgtttacggtaccgggacgtaacgggacctaagttccggaagtaccgtaanaacccggtaaagtggtacgtcgtacaccgcgtactgttaccg

SEQ ID NO: 236415 - DNA, 774 bp, Homo sapiens
  misc_feature: GYAE6OF01AD4WL.3.35.D02.1.454.CMB.1.raw
  modified_base (152)..(152): a, c, t, g, unknown or other
  misc_feature (152)..(152): n is a, c, g, or t
tcagagacgcactccacgaccggtgctcgatttagcacacgataggttgggtttgggggatcaggactcctcagttcaccttctcacaatgaggctccctgctcagctccgtggggctgctatgctcgtgggtcccaggatccgaggtgggnttggttgtggtgactcacgttcctccactcctccctcggcccgtctacccgttggaccgacggcccggcctaccacttcctccgtgccgtacggttcgtggtaaccaacggtccgttcggtaggtacggtgacgtaacggaaacctaccttacgttagtaacgttggtacacgacgacgaacggacggaccgacggactacgtaccgtacggaacgccgtactaagttacgttaagttaacggttaccggaaccggtacgtcggtaccgggtaccaacgactagtacgtacgacggacgtacgacggttgggacaggtactacgttacgtacttaccgaacgttacgtaaggtactaaagggttacggacggggtaacggggttggaacccgggttgtacgggtaggtttaggtttacggttagggttttaatttaccgtgtcacgagtttacgaacgtaacgtaccgtaccgtacgttacgggtcccggttaacgttaccgtttaccgggtcgggaaaccggacgggtttaaaccgaaggtcggtaacgggtaacctaaacgggtaacgaaccggttggtaccggtacgaaccgttacggaaccctagttcgtttaacccg

SEQ ID NO: 236416 - DNA, 614 bp, Homo sapiens
  misc_feature: GYAE6OF01BBWER.3.35.D02.1.454.CMB.1.raw
  modified_base (341)..(341): a, c, t, g, unknown or other
  misc_feature (341)..(341): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactcctccctgcccgtcacccttggacagcccggcctccatctcctgctagttctggtacaaacgccctcgtgtacggtgataggaaacacctacttgaatttggtatcagcagaggccaggccaatcctaccgaagccgacctaatctaagttaacggttcaaccgggcncgtacgggtacccagacagacttcgagcgacacgtgggtacaggctaactgtactttacgaactacgtagagtaagttacgacgtaggggtacggaggtacgtaggaacggtagttggttagggttattttacgttcgtagtctagtgtacgaacgtacctacgactacgtacgtaccgttacgtacgtttcggaccgtacgggacctaacggtcgtaggtacgacgtaacgaaacgtacgttaggtacgtacgtagacctacgtcgttaccg

SEQ ID NO: 236417 - DNA, 586 bp, Homo sapiens
  misc_feature: GYAE6OF01ER4MR.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatcctcctgcaggtctggtcaaagcctcgtgtacggtgatggaaacacctacttgaattggtatcagcagaggccaggccaatctccaaggcgcctaatctataaggttctaaccgggcgctggggtcccagacagattcgagcggcacgtgggtcaggcactgattcactactagagtaattagcgtagggtggaggtcgtggaaggtagttgggttagggtattttagtttcgtgtctagtgctaagtcctaacaccgtagtcggtacccgtaacgtaccgttttcgggaccgtaacggggtaccaacggtcgtagggtaagacgtaacgaaaccgaacgttaggtacggtacgtaggaccctaccgtagttaccgg

SEQ ID NO: 236418 - DNA, 707 bp, Homo sapiens
  misc_feature: GYAE6OF01AFSTG.3.35.D02.1.454.CMB.1.raw
tcagagacgcactccacgaccggtgctcgatttagcacacgatagttgggtttgggggatcaggactcctcagttcaccttctcacaatgaggctccctgctcagctccgtggggctgctaatgctctgggtcccaggatccagtggggatgttgtggtgactcagtctccactctccctgcccgtcacccttggacacgccggcctccatcctcctgcaggtctggtacaaagtcctcgtggtacggtgatacggaaacctacctacttgaatttggatcagcagacggccaggccaatctaccgaaggccgtacctaaatcttaataacggtttacgaaccgggacgcgtacgggtcccaaggacagtacttacgacgtcggacgacgtcgggtacaggctacgttcggtaacttttaccaacgtactacggaagtaacttaacgggtaccgtaaggggtaggggaggtacggtagggtaagggtagttacggggtttagggtacgttttacttcggttagtacgtatgtaaccgaacgtacctaacgaccgtacggtaccggtaccgttaaccgttacggttttaccggaaccggaaccggggtaacctaaggtaccgggttagggaaacggttaactaaccgggtaaaacggtaccgttacgggttacgtaaccggtacgacctaaacccgtagtttacccgg

SEQ ID NO: 236419 - DNA, 615 bp, Homo sapiens
  misc_feature: GYAE6OF01B34G5.3.35.D02.1.454.CMB.1.raw
  modified_base (474)..(474): a, c, t, g, unknown or other
  misc_feature (474)..(474): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtacaaagcctcggtgtacggtgatacggaaacaccttactgaattggtatcagcaggacgccaggccaatcctccgaaggcgtacctaatctaataacggtttaccgtaaccgggacgcgtcggggtacccaagacagacttcgagcggcacgtgggtacaggctacgtgtactttcgaactacgtagaagtaagttacgcgtagggcggaggtcgtaggaggtagttgggtttagggttatttcgtttntcgtactagtgacgacgtcctaacacgtacgtcggtaccttacgttccgtttacgggaccgtaacgggaccaacggtcgttacgggaacgtaacgtacgaaacggacgttaggtcggtactacggacctacgtcttaccgg

SEQ ID NO: 236420 - DNA, 598 bp, Homo sapiens
  misc_feature: GYAE6OF01EVKNV.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctacgaggcgctaatctataaggttctaacggacgcgtgggtcccagacagattcgagcggcacgtgggtcaggcacgtgtatttcactactgagtaattagcgtagggtggaggtcgtgaggtatggttaggtattttagtttctgtctagtagacgaagactaaccacgtacgttacgggtacccgttactaccgttttcggaccggtaacggggaaccgtaacggtaccgtagggtaacgaacgtaaccgaaaaccggtaaccgtacggtacgggtaccgtacggaccctaccgtacgtttacccg

SEQ ID NO: 236421 - DNA, 581 bp, Homo sapiens
  misc_feature: GYAE6OF01A2NKU.3.35.D02.1.454.CMB.1.raw
  modified_base (218)..(218): a, c, t, g, unknown or other
  misc_feature (218)..(218): n is a, c, g, or t
  modified_base (361)..(361): a, c, t, g, unknown or other
  misc_feature (361)..(361): n is a, c, g, or t
  modified_base (383)..(383): a, c, t, g, unknown or other
  misc_feature (383)..(383): n is a, c, g, or t
  modified_base (391)..(391): a, c, t, g, unknown or other
  misc_feature (391)..(391): n is a, c, g, or t
  modified_base (393)..(393): a, c, t, g, unknown or other
  misc_feature (393)..(393): n is a, c, g, or t
  modified_base (410)..(410): a, c, t, g, unknown or other
  misc_feature (410)..(410): n is a, c, g, or t
tcagagacgcactccacgaccggtgctcgatttagcacacgatagttgggtttgggccgagctgggtttcctggttgttatttactaaggtgtccagtgtgaggtgcagctggtgcagtctggggggaggcttggtccaggcctgggagggtccctgagactctcctgtgtggtctctggattcaccttcgagggacccacttcatggactgggtccncaggctcgagggagggctggagtggttgccgtataagaaacaagctagaagttacaccaacagattacgccgcgtctgtgacaggcagattcaccatcctagaagagatgattcaagcaactcagtctcatgacaaatcaacncctagaacgacgagacacgctntaatactncnctacatatcatataganctacactcgtcgggccacggagacctggcctaccgtcgtcctccgagtccctaccgaccgaaccgggcccacgttacccgggttccccttcccccggacggtccccgccccgttcgaccccgttacccgacgggaccctaccgtaacccctacccgggagacccggacccg

SEQ ID NO: 236422 - DNA, 837 bp, Homo sapiens
  misc_feature: GYAE6OF01BYZJ4.3.35.D02.1.454.CMB.1.raw
tcagagacgcactccacgaccggtgctcgatttagcacacgatagttgggtttgggggatcaggactcctcagttcaccttctcacaatgaggctccctgctcagctccgtggggctgctaatgctcgtcgggtcccaggatccgaggtggggatggttgtggtgactcagtctccactcctccctgccctcacctgacacgccgcctcctactctcctgcgacggtcgtcggtaccgtaaacgtccgtcggtaggtacgggtagacgtaacggtaaaccaaccttacgttagtaagttaggtacgtacgagacgaggtacggacccgacggaaccgtaactaccgtacccggaaacgggaccgtaccgttaaacttaacgttaacggtttaaacgggttttaccggtaaacccggggtacggtccggttaccggggtaacccaacggtaacgtaacgtaacgttccggacggaccgggtaccgtaacgggttcgggtacggtacgggtaacctacttacgttaacgtttaccaacgtaccgtaggtaaggttaaccgttaagggtaccgggtaagggggtagggtaacgggtacggtagggtaagggttagggtttacgggttttaagggttacttttaagttttcggtacgtacttaacggacgtaacggtaaactacgttaaacccacgttacgggtaccgggtacccttaagttaccccgttacgggaccgggtaaccgggtaccggtaacggtacggtacggtaagtaaccgtaaacggtaaaccgtacgggttcggtacggacttacccgacgttaaacctcggtttaccg

SEQ ID NO: 236423 - DNA, 596 bp, Homo sapiens
  misc_feature: GYAE6OF01AKGEG.3.35.D02.1.454.CMB.1.raw
  modified_base (585)..(585): a, c, t, g, unknown or other
  misc_feature (585)..(585): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgccccgtcacccttggacagcccggcctccatctcctgcaggtctggtcaaagcctcgtgtacggtgatggaaaccacctacttgtaattggtatcagcagaggccaggccaatctccaagcgacctaatctaagtaaggtttactaaccgggcgcgtcgggtccagacgagattcagcggactacgtgggtcaggcactgtactttcactactagagtaagttagcggtaggggttggaggtctggaaggtagttagggtttagggtattttagttttcgtggtactatcgacgtaagcctaaccgactacgtcggtaccgttaccgtacgtttacgggaccgtacggggacctaaggcggtaggagtacgtaacctaaacgtacgtaggtcggtacgtcgaccnccgtattaccg

SEQ ID NO: 236424 - DNA, 741 bp, Homo sapiens
  misc_feature: GYAE6OF01AJNGG.3.35.D02.1.454.CMB.1.raw
tcagagacgcactccacgaccggtgctcgatttagcacacgatagttgggtttggggggatcaggactcctcagttcaccttctcacaatgaggctccctgctcagctcctggggctgctaatgctctgggtcccaggattccagtggggatgttgtggtgactcagtctccactctccctgccgtcacccttggacagccggcctccgatcctcctagcgagggtctggtacaagcctcgtgtacggtgataggaaacacctacttgaattggtatcgagcagagccaggccaagtcctaccgaacggcgtaccgtaagtcgtaagttaacggttttaccgaacccgggtcgtccggtacgggtacccaagacgtagtacttacgacgtaccggactacgtcgggtaccaggacctacgtagtactttacacgtacgttacgaagtaagttacgtacgtaggggtacgggacggtcgttaggaaggtaggttacgggttagggttaagttttagtttacgttacgtacgttaactacgtaaccgtaaacgtacctaaccgtaacgtaccggttaaccgggtacccgttaaccggttaccgttttaccgggaccggtaacggggtaaacccgtaacgggtaccgttaacgggtaacggtaacgtaacccggttaaaaccggtaccggttacggttaaccgggttacctaccggttaaccttacccgttacgtttacccggg

SEQ ID NO: 236425 - DNA, 699 bp, Homo sapiens
  misc_feature: GYAE6OF01CY3F5.3.35.D02.1.454.CMB.1.raw
  modified_base (245)..(245): a, c, t, g, unknown or other
  misc_feature (245)..(245): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatcctcctgcaggtctggtacaaagcctcgtgtacggnatggaaaaccaccttacttgtaacttggtatcagcaggacggcaggaccatccgtaccgaaggccactaatactaagttaacggtttaccgaaaccgggcgcgtcggggtacccagacagtattaccgaggccggtacgacggttacgggtcgaacggctacgttagtaacgttttaccaacgtaacgttggaaagtaacgttacggaccggtagggggtacgggacggtacgtagggtaagggtagtttgggtttagggtttaatttttacgttcgtggtacaagttacgacgtaacgtactaaccgacgtaccgttacgggtaacccttaacgttacggtttacgggacccggtaacggggtaaccctaaggtccggtaacgggtagtaaacgtaaccgtaaaaccggtacgttcgggtaccggtactacggaaccctaacctgtttacccg

SEQ ID NO: 236426 - DNA, 677 bp, Homo sapiens
  misc_feature: GYAE6OF01DZO88.3.35.D02.1.454.CMB.1.raw
  modified_base (329)..(329): a, c, t, g, unknown or other
  misc_feature (329)..(329): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccgaaggcgacctatctataaggtttctaaccgggacncgtcgggtacccagacagtattcgagcggcacgtgggtacaggcactggtatttcactactagaagtaagttagacgaggggtagggacggcgtaggtaggtaggttacggtttaggggttagttttaacgtttcgttcggtaccgtaagttacggtacgtaaacgtaccgttaaccgaaccgtaccgttacgggtacccggtttaaccgttaccggtttttaccgggaccggtaaccgggggtaacccgtaacggtacggtaacggaacggtaacgttaacccggaaaaccggtaaccgttacgggttacgggtacccgtacggacccgtaccgtacgtttacccgg

SEQ ID NO: 236427 - DNA, 602 bp, Homo sapiens
  misc_feature: GYAE6OF01BI63S.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacacgccggcctccatcctcctgcaggtctggtcaaagcctcgtgtacggtgagtaggaaacacctacttgaattggtatcagcagaggccaggccaatctaccgaaggccgacctaatctagtaaggtttacctaaccgggacgcgtcggggtcccagacagattcagcggcacgtgggtcaggcactgtacttacactactgaagaagttagcgtagggtgggaggcgtaggaaggtagttgggtttagggttattttatttacgtgtacgtagttacgacgtaacgtcctaaccacgtacgttcggtacccgtacttaccggtttcggaccggacggggtaaccaaggtcgtaacggataacgtacgaaaaccgtacgtcggtaggctagccctacacgttaccg

SEQ ID NO: 236428 - DNA, 751 bp, Homo sapiens
  misc_feature: GYAE6OF01DHUG9.3.35.D02.1.454.CMB.1.raw
tcagagacgcactccacgaccggtgctcgatttagcacacgatagttgggtttgggggatcaggactcctcagttcaccttctcacaatgaggctcctgctcagctccgtgggctgctaatgctcgtgggtcccaggatccaggtggggattggttgtggtgactcagtctccactcctccctcgcccgtccaccttgacacgccggcctccactctcctgcgtacggtcgtaggtacaaacgtccgtcggtaggtacggtagtaacgtacggaaacctacctaacgttagtaagttggtatcgagacgagacggacgacggacctaacgtaccgtaaccgaacggtaccgtaaccttaacgttacgttaacgtttaaaccgggtttaaccggaaccgggtacggtccgggttaccgggtacccgaaggaacgttaacgtacgttacgaacggtccggacgtacgggtacgggtacgacggactacgttacggttaacttacaacgtacgtagtaaaggtaactacgggacggtaggggtaggacgtcggtaagggtaacggttggtttagggtttagggtttaacttttagttcgtagtacgtgtacgacgtaactacccgtaagacgtaccggtcgtaccgtttaacgttcggttacggaaaccggtacggggaactagggtccgtaggaaactacgtaaaaccggtaagtacggtcgggtactaccgtagtaccctaacgtcgtttcg

SEQ ID NO: 236429 - DNA, 630 bp, Homo sapiens
  misc_feature: GYAE6OF01BOJ2V.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccgcctccatctcctgcaggtctggtacaaagcctcgtgtacggtgagtaggaaacaccttacttgaattggtatcagcagaggccaggaccaatcctaccgaaggccgtacctaatctaattaacgggtttaccgtaaccgggaccgtcgtcggggtaccccagacagtactcgagcggcacgtgggtactacggctacgtagtatttacgactacgtagagtaattaggacgagggtcggaggcgtaggacgtagttggtagggttatttagttgtgtagtagtgacgtaacgtcctaacgacgtaccgttacggtacccgttacgtacgtttacgggaccggtaacgggtacctaggtccgtaagggataacggtaacccgaaacggtaccgttaggtacggtccgtagtaccctacgtaacgttcccg

SEQ ID NO: 236430 - DNA, 821 bp, Homo sapiens
  misc_feature: GYAE6OF01B5QHV.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctcgcccgtccacccgttggacacggcccggcctccatctcctgcgaggtctggtacaaacgtcctggtgtacggtgacgtaggaaactacctacgttagtaacttggtatcagcgaggacggccacggaccgaactccgtaccgaacggtccgtacctaagttacgtaacgtttaaacgggttttacccgaaacccggggtaccgtaccgggttacggggtaaccccgaaaggtaaccgtaaggtaaccgtttaccggaacgggtacccgggtacccggtaaccggttcgggggttaaccgaaccgggtacctaaccgtttacggtacttttaccgaacctaaccgttaggtaaacgtaagttaacggtacgggtagggggtacggtacgggtacggttagggtaaagggtacgtttaggggtttacgggttaagtttttacgtttcgttaggttaccgtagttacggtaacgtaacgtaccggttaaaccgtaccgtaaccggttaccggttaccgttaaccggttacggtttaccgggaaccggtaacggggtaaccgtaacgggtaccgtaggaacggtaacttaaacggaaaccggttacgtaggtacggaccgtacggacctaaccgttagttaccgg

SEQ ID NO: 236431 - DNA, 818 bp, Homo sapiens
  misc_feature: GYAE6OF01AJIQE.3.35.D02.1.454.CMB.1.raw
tcagagacgcactccacgaccggtgctcgatttagcacacgatagttgggtttgggggtagtcaggactcctcagttcaccttctcacaatgaggctccctgctcagctctgggctgctaatgctctgggtccaggactccaggtggggatgttgtcggtgactcgagtctcactctccctgcccgtctaccttggacacgccggcctccatctcctgacaggtctggtacaacgtcctcgtcgttacggtgtagtacggtaaacctaccttaacgttagtaaagtttcgggtaacttacgacgtacgaaaggacgggtccagggtaaccctaacgtcgtaaccggaacgggtccctaaccggttaacttaccgtttaaagttaaccgggtttttaccgtaaaccccgggggacgtaccgggttaccggggtaaccccgaagtaaaccgtaggtaaacgttccgaaacgggccggacgtaaacgggttggggtacctaaagggccggttactttacggtaacgttttaccaaaccgttacggttaagtaaggttaacggttacggtacggtaggggttaccgggtagggacggttaagggtacggttaaggttacgggttttacgggttaagtttttacggtttacgttacggtacgtttacggtacgtaacggtaacgtacctaacgtaaccgttacgtaaccgggttaccgttacggttaccgtttacgggaaccggttacgggaaccgtaggtacggacgtagtaacgtacgaaacgtgtacgggtcgtacgtaccgcttaaccgtgttaaccgg

SEQ ID NO: 236432 - DNA, 658 bp, Homo sapiens
  misc_feature: GYAE6OF01A4ZJB.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctgggtcccaggatccagtggggatgttgtggtgactcagtctccactctccctgcccgtcacccttggacacgccggcctccatctcctgcaggtctggtcaaagcctcgtgtacggtgatggaaacacctacttgaaactttggtaatcagcagaggccaggaccaatctccaaggcgcctaatctaataaggtttctaaccgggacgacgtgggtaccctagacagattccgagccggctacgtgggtcagggcacgtgatttaccacactgaagtaattagtacgaggggttaggacgggtcgttacgggaagggttagttagggtttggggttaagtttttaacggtttaccgttaggtacgttaacgtcggtaaccgaaaggtaccttaacgaaccgtacgttacgggttacccgttaaccttaaccggttttcggacccgggttaacggggaccctaaagggtacccgtagggaagtacgtaacaaaccgtaggtacgtcggtacttagacccaccgtagttacccg

SEQ ID NO: 236433 - DNA, 660 bp, Homo sapiens
  misc_feature: GYAE6OF01CH3LB.3.35.D02.1.454.CMB.1.raw
  modified_base (261)..(261): a, c, t, g, unknown or other
  misc_feature (261)..(261): n is a, c, g, or t
  modified_base (402)..(402): a, c, t, g, unknown or other
  misc_feature (402)..(402): n is a, c, g, or t
  modified_base (409)..(409): a, c, t, g, unknown or other
  misc_feature (409)..(409): n is a, c, g, or t
tcagagacgcactccacgaccggtgctcgatttagcacacgatagttgggtttgggggatcaggactcctcagttcaccttctcacaatgaggctccctgctcagctccgtgggctgctaatgctcgtgggtcccaggatccgaggtggggatggttggtggtagactcgagtctccactcctccctcgccccgtcacccgttggacacgccggcctcactctcctagccgaggtctggtacaaagtcctcgtgtacgganagtacggaaactaccttattagtaatggtaatcgaagcgaggagacccgaggacctaagtccacgaaggcctacctaatcgtaagttaacggttaccgaaacgggcgacgtcgggtaccaagacgtgaactgacggacggntaacggngggtccaggtacactaggtacttacaacgacgtagtaacggtaacgttaggaccgaggggtaggacgggtaacgtgggtaagaggtttcgggttagggtttactttacgtttacgtagactagtacgactaacggtacctaaccgaacgaccgttacggaccttacgttaccggttcggaccgggtacgggacgaaacgcgtaaggacgactaaccggaaagacgttaggcacgacgccaacgtgttaccg

SEQ ID NO: 236434 - DNA, 653 bp, Homo sapiens
  misc_feature: GYAE6OF01DXZ6Y.3.35.D02.1.454.CMB.1.raw
  modified_base (381)..(381): a, c, t, g, unknown or other
  misc_feature (381)..(381): n is a, c, g, or t
  modified_base (402)..(402): a, c, t, g, unknown or other
  misc_feature (402)..(402): n is a, c, g, or t
tcagagacgcactccacgaccggtgctcgatttagcacacgatagttgggtttgggccgagctgggttttcctggttgttattttacaaggtgtccagtgtgaggtgcagctggtgcagtcgtggggggaggcttggtccagcctgggagggtccctgagactctcctgtgtggtctctggattcaccttcgagggaccctacttcagtggaccttggggtcccgccaggcctaccgaggggaacggggctgggaggttggggttcggaccgttaataaaggaaacaaaggctaaggtaacgttacaaccacagatttaccgtcgacgttctgtgacaggcagattcaccattcacaagagatgattcaagcaactcagtntcctgtcgacaaatgaaaccncccgtagaacgacggagaccacgggcctatacttactcgcgtctaacgagtacttcaattagtcgggaacactaacggactacggtcgggacccgaacgggactacccgtggtcccaccggtcctccgtacgaccgtcccgtaccaccgtaaccgggtcccacgttccccggtcccgttacccccgtcgggcccgtccccgtcggcccttacccggacggtacgccctacccggtccgacgcggtaacccg

SEQ ID NO: 236435 - DNA, 846 bp, Homo sapiens
  misc_feature: GYAE6OF01EM4C3.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctcgtgggtcccaggatccaggtggggattgttggtggtgactcagtctccactctccctcgcccgtcacccgttggacacgcccggcctccactctcctgcaggtctggtaccaaacgccgtcggtgtacggtgaatacggaaacctacctacgttagtaagttggtatcgagcgaggacggacctacggaccaacgttcctaccggaaacgggtccgtaacccgttaaataccgtttaaagtttaaaccgggttttaacccggtaaacccggggtaccggtaccggttaccccgggggtaaccccgaacggtaaccgtaacggttacgtttaaccgaccggggaccgggtaccgtaccgggttacggggaaccgtaacggaccgtaacggttcgttaacgtttaaccaccgttaacgtaacggaaagttaaacggttacgggaacgggtaggggggtacgggtacggtaacggtaagggtagggtacggttttagggggtttaggtttaactttttagtttacccgtaggttacctaagggttaccgaacgtaaccgtaccgttaaaccgacccgttacggttacgggtaacccttaccgggtttaccgttaccgggaccgggtaaccgggtaaacctacgggttacggtaacggggaattaaccggaaacgtaaacgggtaacgtcgggtacgtaccgtaccacccgtactccgtttacg

SEQ ID NO: 236436 - DNA, 695 bp, Homo sapiens
  misc_feature: GYAE6OF01EB8HZ.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacacgccggcctccatctcctgcaggtctggtacaaagcctcgtgtacggtgataggaaaccacctacttagtaattggtatcagcaggacggccgacggcctaactcctaccgaacggccgaccgtaatacttaagttaacggtttaccgtaaccgggacgtcggtcggggtaccccaagacgagtagttcaggcggactacgtcgggtcaggcctacgtacgtactttcactacgtacggtaagtaagtttacggaccggtaagggggtagggtacgggtacgtaggaaggggttagttacggggtttagggttaatttttacgtttcttaggtctagttacgacgtaacggtcctaacgtaccgtacggttacgggtaccttacgttaccgtttcgggacccgtaaacggggtacccaaggtccggtacgggacgtaacgtaaccgaaaaccgttaaggtcggttaccgggacgttaccgaccgtacctagttacccg

SEQ ID NO: 236437 - DNA, 783 bp, Homo sapiens
  misc_feature: GYAE6OF01D6N7T.3.35.D02.1.454.CMB.1.raw
  modified_base (196)..(196): a, c, t, g, unknown or other
  misc_feature (196)..(196): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcaccttggacncgccgcctcatctctgctaggtctggtacaaacgtccgtcgtgtacggtagtaagtacggaaaccaccttaagttagtaacgtttaggtataccgagacgaaggaacggacccgaacggacctaaaccgttccgtacccggaaagggtcccggtaacccttaaactttaccgttaaacgtttaaacggggtttttacccgtaaaaccgggggaccgttccggtaaccgggggttaccccaaggaactaaggtaacgttccgaaggccggaccgtaccgtggggtaccgaaggactacgttagtacgttttcgaactacgtagtaagtaagttacgacggtagggtaggaggtcgtaggaggtagttcggttagggttacgttttagtttagtcgtacgtagtacgtaacgaacggttacgtaaccgtacgtaaccggttaggtaacccggtttaccgtttaacggttttaccggaccgggtaaaccggggtacctaaaccggtaacggtacggaagggttaacgtaaaccggtaaaaccgtaacgttcgggtaacggtacgtaccgacctaccgtaacgtttacccg

SEQ ID NO: 236438 - DNA, 687 bp, Homo sapiens
  misc_feature: GYAE6OF01AQNOC.3.35.D02.1.454.CMB.1.raw
  modified_base (173)..(173): a, c, t, g, unknown or other
  misc_feature (173)..(173): n is a, c, g, or t
  modified_base (547)..(547): a, c, t, g, unknown or other
  misc_feature (547)..(547): n is a, c, g, or t
tcagagacgcactccacgaccggtgctcgatttagcacacgatagttgggtttgggggatcaggactcctcagttcaccttctcacaatgaggctccctgctcagctcctggggctgctaatgctcgtgggtcccaggatccaggtggggatgttgtggtgactcagtctccnctcctccctcgcccgtctacccgttggacacggcccggcctccactcctcctgcgaggtctggtacaaacgtccgtcgtggtacggtgatacggaaacctacctacttagtaagttcggtactcagacaggacgccgacggaccaagtcctaccgaacggccgtaccttaatacgtaagttaacgggtttaccgaacccgggtacgtcggtaccggggtaccacggactaggtacttacgacggcggacgtacggtgggtacgacggactacgtacgttacttacaacgtagttagaacgtaaacgttaggacgggtaaggggtcgaagggtcgtagggagtaggtttggttagggttattttactcggtcgtntagttcgggaatacgtacctaccgaacgtcggtacgtccggttaacttacggttacggaccgggacggtaaccgtaggacgtagggaactaaccgtaaacgaaacgtcgggttagtcggtactacgactaccgtgttacg

SEQ ID NO: 236439 - DNA, 663 bp, Homo sapiens
  misc_feature: GYAE6OF01ASVBM.3.35.D02.1.454.CMB.1.raw
  modified_base (215)..(215): a, c, t, g, unknown or other
  misc_feature (215)..(215): n is a, c, g, or t
  modified_base (259)..(259): a, c, t, g, unknown or other
  misc_feature (259)..(259): n is a, c, g, or t
  modified_base (301)..(301): a, c, t, g, unknown or other
  misc_feature (301)..(301): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctgggggagcttggtccagcctggagggtccctgagactctcctgtgtggtctctggattcaccttcagggacccacttcatggactggggtccnccgaggcctccgaggggaaggggctgggagtgggttgccgtaanaagaacaagctagaagttacacacagattacgccgcgtctgngacaggcagacttcacatctacaagagatgattacaagacaactcagtcgtctctgacaaatacgaaccacccgtagaacgaccggaaggaccgacggccgttactattaacgtcgaccgtacctaacgtacgtaacttccgaattagttaggacgtaccgtaacgtaccgttaacggtacgggacccgtacgggaacgtaccgtacggtcccgaacccggtccttacccgtaccaccgtaccctaacccgacccgaaccgggtacccaccgtcccggttaccccttcccccggtccgccccggtaccccgtccgtacccgtaccgacggaccgtaccgaccccgtccgacgtcggaacccg

SEQ ID NO: 236440 - DNA, 709 bp, Homo sapiens
  misc_feature: GYAE6OF01BM6UO.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccaggtggggatgttgtggtgactcagtctccactcctccctcgccccgtcacccttggacacgcccggcctccatcctcctgcgaggtctggtacaaacgtccgtcgtgtacggtgaagtacggaaaacctaccttaacgttagtaagtttggtaactccgaggacgacggacggaccgacggacctaaacttccgaccgaacggaccgtacctaatacttaagttaacggttaccgtaaccgggacgtacggtcgggtacccaagaacagtacttacgaggcggacgtacgtcgggtacgaggtacctacgtacgtactttacaactacgtaggtaagtaacgttacggacgtaggggtaggtacgggtacgtaggaagggttagttacgggtttagggtttaaactttttcgttacgttacgtacgtagtacgaacgtaagtacctacggtactaaccggtcggtaaccgttaaccgttacgttaccggaaccggtacgggacctaaggacgtacggaagtacgtaaacgaacggtacgtggtacggacagactacccgtgttaccg

SEQ ID NO: 236441 - DNA, 700 bp, Homo sapiens
  misc_feature: GYAE6OF01BPAJ0.3.35.D02.1.454.CMB.1.raw
  modified_base (455)..(455): a, c, t, g, unknown or other
  misc_feature (455)..(455): n is a, c, g, or t
tcagagacgcactccacgaccggtgctcgatttagcacacgatagttgggtttgggccgagctgggttttcctggttgttattttacaaggtgtccagtgtgaggtgcagctggtgcagtcgtgggggagcttggtccagcctgggaggtccctgagactctcctgtgtggtctacgtggtattccacttcgacgggaccacttcagtggtacgtggggtccgccgaggcctacggaggggaagggcgttgggaggttgggtgaccgtaataaagaaactaagctaagaagttacaacctacagtattaccggacgcgttctgtacgactaggcaagtcttccacattcacaagagatcgtaatccaaagccaaactcgtagttacgtctcgagaacaaagtcgaaactacccgtagaacgacggtacgaaccgtacggtccctataacgttacncgacgtacgtacaagtcttacaagttacgtggtactaccgtaacgtcgtaaccgcgggtaaccgacggtacgaccgttcggaccctaccggtcacccgttacgacctacccgtacccggtaacgacccgggtaaccctcggttccccgttcccgttacccccgccgggtaccccgtcccgtccggtaccctacccgggaacggtacccgaccccgtaacggtaccccggtagaccgtaaccccgg

SEQ ID NO: 236442 - DNA, 650 bp, Homo sapiens
  misc_feature: GYAE6OF01DVNVJ.3.35.D02.1.454.CMB.1.raw
  modified_base (326)..(326): a, c, t, g, unknown or other
  misc_feature (326)..(326): n is a, c, g, or t
tcagagacgcactccacgaccggtgctcgatttagcacacgatagttgggtttgggccgagctgggttttcctggttgttattttacaaggtgtccagtgtgaggtgcagctggtgcagtcgtggggggaggcttggtccagcctgggagggtccctgagactctcctgtgtggtctctggattcaccttcagggaccacttcatggactgggtccgccaggctccgaggggaggggctggagtgggttggcgtataagaaacaagctagaagtacaccacagattacgccgcgtctgtgacaggcagattcaccatctacaaganatagattacaaagcaactcagtcgtctctgacaaatgaacctaccctagaacgaccgaggaccacggtccgtactaacttacgtgaccgtactaacagtactttactaattaacgttagggacgtaccgttaacgtaaccgttacgggtaccggggacccgaacgggtacgtacccgttcgggtacctaccccggttcctacccgtcgaccgtccctacccgaccgaaccgggacccctacggtcccgttccccgttcccccggtcggccccgtccctcggccctaccggacggtccgacctacccgtccgaacgcgaaccccg

SEQ ID NO: 236443 - DNA, 570 bp, Homo sapiens
  misc_feature: GYAE6OF01A517E.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgccccgtcacccttggacagccggcctccatctcctgcaggtctggtcaaagcctcgtgtacggtgatggaaacacctacttgaattggtatcagcagagccaggccaatctccagcgcctaaatctaataaggtttcaaccgggacgctggggtccccagacagattcacgcggcacgtggggtacaggcactgtattcacacgtgagaattagcgaggggtggaggtcgtgagggatgggtttgggtaattttatttcgtgtacagtgacgtaacgtactacgactacgtcgtccgtaacgtacttttcgggccgtaaggggtacctaaggcgtggtagacgtaccaaacggaacttacggtaggtcctaggccctaacgtcgttaccg

SEQ ID NO: 236444 - DNA, 602 bp, Homo sapiens
  misc_feature: GYAE6OF01DW821.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacactacttgaattggtatcagcagagcaggccaatctccaaggcgctaatctataaggtttctaaccgggacgcgtgggtacccagacagattcagcggcacgtgggtcaggcactgatttcgactacgtacgaagtaattaggacgaggggtcgggagggctaggaagggtagttcgggtttaggggtaattttagttttcgtgtacgtattcgactaaagctaactacgtacgtcggaccgttaccgtacgttttcgggacccgacgggggaccaaggtccgtagggtaagacgtaaccgaaaaccggtactacgggtacggtacctaggaccctacctagttacccgg

SEQ ID NO: 236445 - DNA, 750 bp, Homo sapiens
  misc_feature: GYAE6OF01CJRYA.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacacgccggcctccatcctcctgcaggtctggtcaaacgcctcgtgtacggtgataggaaacactacttgaattggtatcagacagacggccaggcctaaatcctaccgaaggccgaccttaataccttaagttaaacggtttccgtaaaccgggtacgccgttcggggtaccccaagacacgtattacgaggccgacacgtgggtcaggctacgtcgtattcacactggaagtaattacggcgtaggggtcggaggtacgtagggtaaggtagtgggtttacgggtattttaacgtttcgtaggtactacgttaggaactaaacggtacttaacccgaaccgttaacccggttaccggggttaccccgttaaaccgtttacccggtttttacgggggaacccccggtaacgggggggtaaaaccccttaacgggtacccgggttaaggggaaaccgttaaaccggttaaacccggtaaaaacccggttaacgggttacgggttacgggacccggttaacggaaccccttaaacccggttaggtttaaaccccggg

SEQ ID NO: 236446 - DNA, 1198 bp, Homo sapiens
  misc_feature: GYAE6OF01A1YJ1.3.35.D02.1.454.CMB.1.raw
tcagagacgcactccacgaccggtgctcgatttagcacacgatagttgggtttgggggatcaggactcctcagttcaccttctcacaatgaggctccctgctcagctccgtggggctgctaatgctcgtgggtcccaggactccgaggtggggattgttgtggtgactcagtcctccactcctccctgcccgtctacccgttggaccacgcccggcctccactctccgtgctacggtctaggtacaacgtcctcggtaggtacggtgatacggaaacctaccttacgttagtaagtttcggtactccgaaggtacgaggacggtacccgacgggaccctaacgtccttaccgaagggtcccgtaaccgtaacgttaccttaaacggttaaaccgggtttaccgtaaacccggggtaccggtcgggttaccgggggtaccctaacggtaaccgtacgtaacgttccgaaccgggtccggtaacggtaccggtacggggtaccgtacggtaccgtaccggttacgtttaaccgttttaacccgaaacgttaaccgggttaacggtaaacggtttaaacggtttaaccggggtaacgggggttaaccgggggggttaacggggtaaaccggggttaccgggttaacggggtaaagggggttttacgggtttttaacggggggttttaacggggtttttaaaccgggttttttttaacggttttacccgggtttaacgggtttaccggtttaacgggtttacccgggttaaaacccggggtaaaacccgggtttaaaccccccggtttaaaaccccgggttaaaccccggtttaacccccggggttttaaaccccggggggttttaaccccggttttttaaacccccggggtttttaaaccccggggggtttttttaacccccgggggggtaaaaaccccccggggggtttttaaaaaaccccggggggtaaaccccccgggggttttaaaaaccgggggtttaaaacccccgggggtttaaacggggggtaaaaaccccgggggtttaaaaccccgggttttaaaaaaccccccggggttaaaaaaacccggggggtttttaaaccccggggtttaaccccggggggtttaaaccggggtttaaccccccgggggtttaaaaccccgggttaaccccccggttttaaaaccccggggtttt

SEQ ID NO: 236447 - DNA, 704 bp, Homo sapiens
  misc_feature: GYAE6OF01EENL0.3.35.D02.1.454.CMB.1.raw
  modified_base (271)..(271): a, c, t, g, unknown or other
  misc_feature (271)..(271): n is a, c, g, or t
tcagagacgcactccacgaccggtgctcgatttagcacacgatagttgggtttgggggatcaggactcctcagttcaccttctcacaatgaggctccctgctcagctccgtggggctgctaatgctcgtgggtcccaggatccagtggggatgttgtggtgactcagtctccactcctccctgcccgtcaccgttggacacgcccggcctccatctcctgcctaggtctcggtacaaagcccgttgtggtacggtgaacgtaggaaaaccnccttacgttagtaagttggtatcgagcgaagacggaccaggacctaatcctaccgaacggcctaaccttaatctaaagttacggtttaccgaaccggacgtcgtcgggtaccagacagtactacgagcggacacggtcggtacacggctacgtgtaacttcacacgtgaagtagtagacgtagggtgagcgaggagtagttacggttaggttaacgttttacttcgtacgtacttagtacgtaacgtaacgtacctaacgaccgtaaccggttaccggtaaccccgttaacggtttaccggtttaacccgggaccgggtaaaccggggtaaaccaaacggtcggttaacgggtaattaaccggtaaaaccggtaaacgtaacgttacgggttacggaccttaaccgggaacccttaaccgtaacgtttaccgg

SEQ ID NO: 236448 - DNA, 639 bp, Homo sapiens
  misc_feature: GYAE6OF01EAXZ7.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagcccggcctccatctcctgcaggtctggtcaaagcctcgtgtacggtgataggaaacacctacttagaattggtatcagcagaggccaggccaatctaccaaggccgcctaatctaattaacggtttcgtaaaccgggacgcgtgggtacccagtacagatcagcgcacgtgggtcaggcactgacgtttcaactactgaagtaattagacgtagggtggaggcgtaggaaggagttggttagggtattttacgtttcgtgacatcgacaacgtctaacaaccgtacgtacggtacccgtaactaccggttttacggaacccggtaacgggggaacctaaacgggtccgtaacggggtaagaaccgtaaaccgtaaaaaaccggtaacgttacgggttaccgggaaccgttaccggtaacctaaacccgtacgtttacccgg

SEQ ID NO: 236449 - DNA, 742 bp, Homo sapiens
  misc_feature: GYAE6OF01DLL2E.3.35.D02.1.454.CMB.1.raw
  modified_base (622)..(622): a, c, t, g, unknown or other
  misc_feature (622)..(622): n is a, c, g, or t
  modified_base (632)..(632): a, c, t, g, unknown or other
  misc_feature (632)..(632): n is a, c, g, or t
  modified_base (721)..(721): a, c, t, g, unknown or other
  misc_feature (721)..(721): n is a, c, g, or t
tcagagacgcactccacgaccggtgctcgatttagcacacgatagttgggtttgggggatcaggactcctcagttcaccttctcacaatgaggctccctgctcagctccgtggggctgctaatgctctgggtcccaggatccgaggtgggattgttgtggtgactcagtctccactcctcccgtcgccccgtcctacccgttggaccacggcccggccctccacttcctcctcgacgtaggtccgtacggtacaaaacggccttcggtacggtacggtagagtacggaaacctaccttaacttagtaagttcggtatacgagcgtaggacggtccgaacggacctaacgtaccctaccgaacggcccgtaaccgttaaattaccgttaaacggtttaaacggttttaacccggtaaacccgggtacggtaccggttaccggggtaccccaaggaacgtaacgtacgttaccgaaggcccggtacgtaccggtacgggtaccgacggtacctacgttagtactttaccgaactacgtagtaaacggtaagttacggcggtaagggggtacggaggtacgtaggaagggttagttaggggtttaggtttattttagttcgtagngtagacgtanacgtacctacacgtcgtacgtaccgttacgtacgtagggcccgaaggaccgtaggtcgtacggataacgacgaaaccgtgtcggtacgntaccgactaccgtgttacccg

SEQ ID NO: 236450 - DNA, 747 bp, Homo sapiens
  misc_feature: GYAE6OF01DLSF0.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggactccgagtggggatgttgtggtgactcagtctccactcctccctcgcccgtctacccttggaccacggcccggcctccatcctccgtgcgtaggtcgtggtacaaacggcctcggtcggtacggtagacgtacggaaacctaccttacgttaggtaagttggtactacgagcgaggacggccgaacggacctaactccgtaccgaacggccgtacctaattccgttaagtttaacggtttaccgaaccggggtacgtcggtaccggggtaccaaggactacgtacttcgacggccggacgtacggtcggtacgacggctacgtgtaactttcacgtacgtagtaagtaagttacggacggaagggtcgggaggtaccgtagggtaacgggttagttaggggttaaggtttaacgttttacgttttcgtaggttctagttacggagttaaccgacctaacgtaccgtaccggttaccggtacccttaacggtccgggtttaccggaccgggtaacgggaacccgtaaggtaccggtaacggtaagtaccggtaaaccgaaaccgttacgttcgggtacgtcgtaaccggacccttacgtacgtttaccgg

SEQ ID NO: 236451 - DNA, 787 bp, Homo sapiens
  misc_feature: GYAE6OF01B2PL0.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgccccgtctacccttggacacgccggcctccactcctcctgcacggtctcggtacaaacgcctcggtgtacgggtgagtacggaaactaccttaacttagtaagttggtactacagacaggacggccaacggacctaactccgtaccgaacggtccgaccttaaataccgttaagttaacgggtttacccggtaaacccggggtaccggtaccggttacggggtacccaacggtaacgtaacgtactttaccgaacgggtcccggtacgtaccggtacggggtaccgacgggtacctaacgttacggttaacctttaccgaacctacggtaagtaacgttaagttaacgggacggtaagggggttaggacgggtacggttagggtacggttaggtttgggtttaggtttaagtttttacgtttcgttagtacgttagtacggtaacgaacgtaccttaacgaccgttaccgtacggttacccgttaacgttaccggtttaccgggaccgggtaacgggtaaccgtacggtacggtgggtaaagtacgtaaacccggtaaacggaccggtttaggtcgggtacctaacggtaccgtaaccgtcgtttcg

SEQ ID NO: 236452 - DNA, 839 bp, Homo sapiens
  misc_feature: GYAE6OF01B8NQ1.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctgggtcccaggatccaggtggggatgttgtggtgactcgatctccactcctccctcgcccgtccacccgttggacgacgcccggccctccatcctccctgcgacggttctggtacaaacgtccgtcgtgtacggtgatacggaaacctaccgttacttagtaagtttcggtaatcgaagtacgaacggacggccgaacggaccctaacgtaccgtacccgaacgggccgtaccctaaagttaccgttaagtttaaacgggttttacccggtaaaccccggggtaccggtaccgggttaccggggtaccccgaacggaacctaggtaacgttccggaacggaccgggtacgtaccgggtacgggttccgaacgggtacctaccgttacgttaactttaccaaccgttaacgtaggaaacgttaagttacgaccggggttaagggggtcgggtacgggtacgtagggtaagggtaacggtttagggtttagggtttaactttttactttacgggtacgtacgtaacgttcgtaaccgtaacgtaccgttaaccgaacccgttaccggtccgggttaacccttacccggttacgtttaccgggacccggtaaaccggggaccgtaaacggttacgggtaacgggacgtaaacgtaaaccgtaaaccggttaccgtacgggtaccggttcaacggtacctaaccgttacgttaaccgg

SEQ ID NO: 236453 - DNA, 701 bp, Homo sapiens
  misc_feature: GYAE6OF01ED4TO.3.35.D02.1.454.CMB.1.raw
  modified_base (561)..(561): a, c, t, g, unknown or other
  misc_feature (561)..(561): n is a, c, g, or t
  modified_base (683)..(683): a, c, t, g, unknown or other
  misc_feature (683)..(683): n is a, c, g, or t
  modified_base (693)..(693): a, c, t, g, unknown or other
  misc_feature (693)..(693): n is a, c, g, or t
tcagagacgcactccacgaccggtgctcgatttagcacacgatagttgggtttgggggatcaggactcctcagttcaccttctcacaatgaggctccctgctcagctccgtggggctgctaatgctcgtcgggtcccaggactccaggtgggattgttgtggtgactcagtcctccactcctccctgcccgtcaccgttgacacgccgcctccatcctctgcgtaggtctacgtacaacgtccgtcgttaggtacggtagtaagtacggtaaacctaccttaagttagtaagtttggtactaccgagacgacggaacggtccgagacccgtaactaccgaccgaacggtacctaacctaagttactaacggtttaacggttaaccgtaaacccgggtcgtccgggtaccgggtacccaaggtaaccgtagtacgtacggacggccggtactaacggtcgggtacgacggtacaacgtgtacttacactagtacgaagttactaggcgtaggggtgacgtgaggtaacgggtatttgggtaccgtttatttacggtcgaagngtactgaacgttaagccttaacgcgttacggtacgggttacctgttaccggtcgaaccgggaacgtagtaaccggtgtagggaagtaaaccaacgtaaacggtacgtcgtacggtaccgtanccttaacggntttacccg

SEQ ID NO: 236454 - DNA, 769 bp, Homo sapiens
  misc_feature: GYAE6OF01CMWK0.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtacaaagcctcgtgtacggtgatacggaaacacctacttgtaattggtatcgagacgaggacggccgaggtacccaactccgtacccgaaacggccgtacccttaaattaccttaagtttaaacggttttaccgtaaacccggggaccgtccggttcggggtaccccaaggaaccgaacgtacgttaccgacggtacccgggtaccgtaaccggttcggggtaccgaacgggtaccctaacgttacgttaacgttttaccgaaaccgtaaccgttaggaaacggttaacgttaacggtaccgggtaagggggtacgggtaacggtacgtagggtaagggtacgtttgggtttacggggtttaattttacgtttcgtacgtactagttacgaacgtaacgtacctaacgacgtaccggtcgggtacccgttaacgttaccgtttacgggaccggtaacggggaccgtaaggaccggtagggtaacgtaacgttaaccggaaacgaacggtttcggtcggtacgtagacccgtccgtacgtttccgg

SEQ ID NO: 236455 - DNA, 677 bp, Homo sapiens
  misc_feature: GYAE6OF01ELKA0.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtgtgactcagtctccactctccctgcccgtcacccttggacacgcccggcctccatcctcctgctagtctggtacaaacgcctcgtgtacggtgagtaggaaacaccttacttgtaatttggtatcagacgagacggccaacggccaatcctaccgaacggcacctaatactaagttaacggtttccgtaaccgggacgtcgtacgggtacccaagaccgtagacttcgacggtcggacacgtgggtacgacggctactcgtacttacactacgtagtaagtaagttaggacggagggtacgggaggtacgtagggtaggtaggttagggtttagggtttagttttacgtttcgtagtacgtagtcgacgtaacgtactaacgtaccgtaccgttaccggtaccgttaacgttaccgtttcgggacccggtacggggaaccaaggttcggtacggtaacgtaacgtaacccgtaaaacggtacggtacggtacggacgttacggacctaccgttacgttaccg

SEQ ID NO: 236456 - DNA, 811 bp, Homo sapiens
  misc_feature: GYAE6OF01BI5ST.3.35.D02.1.454.CMB.1.raw
  modified_base (204)..(204): a, c, t, g, unknown or other
  misc_feature (204)..(204): n is a, c, g, or t
tcagagacgcactccacgaccggtgctcgatttagcacacgatagttgggtttgggggatcaggactcctcagttcaccttctcacaatgaggctccctgctcagctccgtggggctgctaatgctcgtgggtcccaggactccgaggtggggatgttggtggtgactcagtcctccactcctccgcgcccgtccaccgtgacncggccgcctcactcctcgtgcgtacgtctaggtacaacgtccgtaggtgtacggtagacgtacggaaacctaccttagttagtaagttcggtataccgagacgaacggacggaccgaacggacctaactccgtaaccggacggtaccgtaccttaagtacttaacggtttaacgggttaccggaaaccgggccgtacgggtcgggtaccaacggtacgagttacgtacggacggtaccggtacgacggggttcggtaaccgacggtaccgttaagttcgttaacgtttacccgaagtaacggttacggtaaaggttacggttagggaaccgggtaaggggggttcgaacggtggttaagggtaaacggttggtttaaggggtttacggtttaattttacggtttacgacggtacgttacgtaaccggtaacgtaacggtacccgttaaccgtacccggggtaaccgtaccggtttaccgtttaaccgggttacgggaccggtaaccgggtaataccgggacgttagggaacttaacgaaacggttaaacccggtggttacgggtacgtaccggtacccaaccgttacctacgtttccggttacccgg

SEQ ID NO: 236457 - DNA, 918 bp, Homo sapiens
  misc_feature: GYAE6OF01DTT8M.3.35.D02.1.454.CMB.1.raw
  modified_base (121)..(121): a, c, t, g, unknown or other
  misc_feature (121)..(121): n is a, c, g, or t
  modified_base (224)..(224): a, c, t, g, unknown or other
  misc_feature (224)..(224): n is a, c, g, or t
tcagagacgcactccacgaccggtgctcgatttagcacacgatagttgggtttggggatcaggactcctcagttcaccttctcacaatgaggctccctgctcagctccgtgggctgctaangctctggtcccaggatccaggtggggattgttgtggtgactcagtctccactcctcccgtcgccccgtctacccgttggacacggcccgcctccatcctccgngcgtaggtactggtaaccaaacgtcccgtggttacggtacggtagaacgtacggaaaacctaccgttaacgttagtaaacgtttaggtaactacgaacgacgaaggaaccggaccgtaacggaaccctaacgtaccgtaacccggaaagggtacccgtaaccgttaaacttacgttaaacggtttaaacgggttttaacccggtaaaccccgggtaaccggttacccgggttaacggggtaaccccccgtaaggtaacccgtaagtaacgtttaaccgggacggtacccgggtacgtaccgggttacggggtaccgtaacggtaccgtaaccgtttagtaacttttacccggaaaccttaacggtaaggtaaacggttaaacgttacgggtaacggacgggggttaggaaccggtgtaacgggaagttagggtttagggtttagggtttaaactttttcggttacgttacggtacgttacgtaacgtaacgtaaaccgttaactaaaccgtaacccgttaggtacccggggttaacccttacgggtttaaccggttaccgggtacccgaaacgggggtaccgaacgggttaccggaagggaacgttaaccgttaaaaaccggaaaaccggttaaggtacccgggttaacggtaccgttaaccccgaaccgtttaacccggtacgttttacccgg

SEQ ID NO: 236458 - DNA, 707 bp, Homo sapiens
  misc_feature: GYAE6OF01BO6S3.3.35.D02.1.454.CMB.1.raw
  modified_base (677)..(677): a, c, t, g, unknown or other
  misc_feature (677)..(677): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccaggtggggatgttgtggtgactcagtctccactcctccctcgcccgtcacccgttggacacgcccggccctccatcctcctgcgaggtctggtacaaacgccttcgtgtacggtgagtacggaaacctaccttacttagtaagtttggtactacgagacgaggacggaccgacggaccaactaccgtaccgaacggccgtaccttaactacgttaacgtttaacgggtttaccggtaacccgggtacggtccggttacggggtacccaagacgtacgtacgttcgacggcggacgtacggtacgggtcgacgtactacgtagttacttacgacgtacgtagtaagtaagttacggacgggtaggggtaggaggtgtacgggaggttaggtttgggtttacgggtttattttacgttacgtgtacgtacgtcgtaacgaacgtactaaccgtacgtccgttaccgttacgttacggttacgttacgggaccgaacgggtaccaggtacggtacggacgtaacaaccggaagttcggnggtacgaccgtacgacctacgtcgtttccg

SEQ ID NO: 236459 - DNA, 533 bp, Homo sapiens
  misc_feature: GYAE6OF01CE8LZ.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagagccaggccaatctaccaaggcgacctaatctagtaaggtttctaaccgggcgcgtcggggtccagacagattcgagcgcacgtggtcaggcactgatttcacactgagaattagcgagggtggaggctagaggagttggtgggtatttagttcgtgtctagtgacgaagcctacacgtacgtgaccgtactcgtttggccgtagggaccaagcgtggagacgtacaaacgtactggtacggctagctcctagtacg

SEQ ID NO: 236460 - DNA, 651 bp, Homo sapiens
  misc_feature: GYAE6OF01DVXGP.3.35.D02.1.454.CMB.1.raw
  modified_base (379)..(379): a, c, t, g, unknown or other
  misc_feature (379)..(379): n is a, c, g, or t
  modified_base (391)..(391): a, c, t, g, unknown or other
  misc_feature (391)..(391): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctcgcccgtcacccttggacacgccggcctccactctcctgcaggtctggtacaaacgccgtcggtaggtacggtagagtaggaaacctaccttacttagtaattggtatcagcagacggcagcaatctaccaaggcgactaatctaagttaacggttacgaaccggacgtccgtcgggtacccagacagtacttcaggcgntacgtgggtacnggcacgtagtatttcactacgtagaagtaagtacggacgtagggtaggacggtctaggtaaggtagttagggttagggtttattttacgtttcgtcggtatagtacggtactaagaccttaaaccgaccgtacggtcgggtacccgttaacgttaccgtttacgggacccggaacggggtaaccaacggtcggtaacggtaagtacggtaaccaaaacggtacgttacggtacgtacggtactaccgaccgtcgttaccg

SEQ ID NO: 236461 - DNA, 737 bp, Homo sapiens
  misc_feature: GYAE6OF01AVEV2.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccaggtggggatgttgtggtgactcagtctccactctccctgcccgtccacccttggacacgcccggcctccatcctcctgcgaggtcgtggtaccaaacgcctcggtgtacggtgataggaaacctaccttacgttagtaagttggtatcgagcaaggacggaccgacggaccactccgtaccgaacggccgtaccttaattaccgttaagttaacgggtttacccgtaaaccgggacggtaccggtccggggtacccaagacgtaacgtacttacgacggtcggaccgtacggtcgggtacgacggtactacgtgttaactttaccgactacgtagaagttaacgtacggacggtaagggggtacggtaacggtacgtacgggtaagggtaggtttaggggtttaaggtttagttttacggtttacgtgacgttagtacgtacgaaacgtaccgtaaccgtacgtacggtaccggttaacccgttacgttaccgtttacgggaaccgggtacgggaaccaagggtacggtaggtaacgaaacgttaaccgaaaccgtacgtcgggtacggacctacgaccctaccgttgttaccgg

SEQ ID NO: 236462 - DNA, 702 bp, Homo sapiens
  misc_feature: GYAE6OF01CJCLO.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcaccctggacagccggcctccatcctcctgcaggtctggtcaaagcctcgtgtacggtgatacggaaacacctacttagaattggtatcagcagacggccaggccaatctaccgaaggccgtacctaatacttaagtaacggtttacgtaaccgggcgacgtcgggtccaagacagatcgagcgcacgtggtcaggtcactgtactttacgaactacgtagaagtaagtttacggacggtaaggggtacgggaaggtcgtagggtaacgggtagtttagggtttaggggttaagttttttagtttcgttaggtactaagttacggtaacgtaaacggtaaccctaacgtaacccgtacggttaccgggttacccggttaacgtttacccggttttaccgggaacccggtaacggggtaaaccgtaacggtaccggttagggtaacgtaacggtaaaccgaaaaccggttaacgttacggtcggttacggtaccgtaaccgtaacccgtagttccggg

SEQ ID NO: 236463 - DNA, 864 bp, Homo sapiens
  misc_feature: GYAE6OF01A4J1G.3.35.D02.1.454.CMB.1.raw
  modified_base (165)..(165): a, c, t, g, unknown or other
  misc_feature (165)..(165): n is a, c, g, or t
tcagagacgcactccacgaccggtgctcgatttagcacacgatagttgggtttgggggatcaggactcctcagttcaccttctcacaatgaggctccctgctcagctccgtggggctgctaatgctctcgggtcccaggatccagtggggatgttgtggtgactnagtctccactctccctcgcccgtcacccgttggacacgcccggcctccatcctcctgcgtaggtcttggtacaaacgtcccttcggtcgtacggtgtaatacgggaaaacctacccttaacgttagtaaattcggtatcaggctaaggaggacccgtaggacccaagtccgtaccgtaacgggccgtaccttaaacgttacttaacgttaaacgggtttttaccgtaaacccggggtaccgtaccgggttacggggggttaccccaaaggaccgtaagtaacgtttacgaacgggccggtaccgtacggttacggggtaccgacgggacctaaccggttacggttaacttttaccaaaccggtaccgttaggaacgtaaacgtttacggaccggttaggggggttacggggtaagggtccgttaggggtaagggtaggttacgggtttaggggtttaatttttacggttttacgtagggtacctaacggttggtaacccgtaacgtaccgttaacccggtaaaccgtcgggttaccggttaccccggttaaccgtttaccgggttttaccgggacccggtaaacgggggtaacccctaaacggggtcggtacggggttaaagtaaccggttaaacggaaaaccccggttaagttcggggtacccgggttactaggaaccccgttaactacgtttcccgg

SEQ ID NO: 236464 - DNA, 854 bp, Homo sapiens
  misc_feature: GYAE6OF01EV6QW.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacacgcccggcctccatcctcctgcgaggtcgtgtacaacgtccgtcgtgtacggtgagtaggaaccaccttacgttagtaagttggtatcgagcaggacggccgacggacctaaacttccctaccggaacgggtaccgtacccttaaatttaccgttaaacgtttaaacgggttttacccggtaaacccggggtaccggtaccggttaccgggggtaccccaacggaacgtaacggtaactttaccggacggaccgggtacctacgggttcggggtaccgaacggtactaaccgtaggttactttacgaaacgtacgtaagggtaagtaaacggtttaacgggacgggtaagggggtcggggtaacgggtaccggttagggtaagggttaggtttaggggtttagggtttagttttttaacgtttcggttacgtacgtagttcggaacgtaaccgtaaccgtaacccgtacgtaaccggttaccgggttacccggttaaccgttttaccgggtttaccggggacccgggtaaaggggtaccccgtaaagggtccggtaagggtaacgtaaccgttaaaacccgggaaaaccggttacggttaccggggttagggttacccgtaaccggttaccccgtaacccgttaaggtttaccccgg

SEQ ID NO: 236465 - DNA, 790 bp, Homo sapiens
  misc_feature: GYAE6OF01A6JA7.3.35.D02.1.454.CMB.1.raw
tcagagacgcactccacgaccggtgctcgatttagcacacgatagttgggtttgggggatcaggactcctcagttcaccttctcacaatgaggctccctgctcagctccgtgggctgctaatgctcgtcgggtcccgaggacttccgaggtggggattggttgtggtgactcagtcctccacctccgtccctcgcccgtacctacccgtgacgaccgccgtcctccatcctccgtgccgtacggttcgtacggtaacaaccgtccgtacggtacggtaccggttagaacgtacggaaacctaccgttacgttaggtaattacgggtatccgaaggacgaacggacggacccgtaacggccctaaacgtccgtacccggaaacgggtcccgtaaccttaacgttaaccgtttaaggtttaaccgggttttaacccggaaacccgggtacggtccggttaccgggtacccgaagacgtaagtacgttcgaacgccgggactacggtagggtacaggtcctaactgttacttacgaactcgtaagtaagtaagttacggacggtagggtaggacggtacggtaggtaacgggtagttagggtttagggtattttagtcgtagtactagtacgtagtaaccgtataacccgacgttaccggtccgttaccgtaacgttttaccgggtaccgacgggtaaccggaaccgtacggaagtacgggaactaccggtaaaccggtaacgttacgtaccggttacgaccggttaaccgaaccttcccgtaggtttacccg

SEQ ID NO: 236466 - DNA, 802 bp, Homo sapiens
  misc_feature: GYAE6OF01DGWQW.3.35.D02.1.454.CMB.1.raw
  modified_base (212)..(212): a, c, t, g, unknown or other
  misc_feature (212)..(212): n is a, c, g, or t
  modified_base (784)..(784): a, c, t, g, unknown or other
  misc_feature (784)..(784): n is a, c, g, or t
  modified_base (791)..(791): a, c, t, g, unknown or other
  misc_feature (791)..(791): n is a, c, g, or t
tcagagacgcactccacgaccggtgctcgatttagcacacgatagttgggtttggggatcaggactcctcagttcaccttctcacaatgaggctccctgctcagctcctgggcttgctaatgctcgtggtcccaggatccagtggggattgttgtggtgactcagtctccactctccctgcccgtcacctggacacgccgcctcatcgtccngcaggtctaggtcaaacgcctcgtggtacggtgatacggaaactaccgttacgttagtaacgttggttaactacctaggacaacggaacggtaccaaggccctaaatccgtaaccgaagggccgtaccttaacgtacttaacgtttaaacggttttaccgtaaacccggggtacgtaccggttaccgggggtaaccccctaaggtacctaaacggtacgtttaccggaacggttacccgggaccgtaaccggtttacgggggtaaccggacgggtaacccacggtttacgttaaccgtttttacccgaaacgtaaccgttaagggtaacggttaaacgttacggtaacggtacgggggtacgggtaacgggtccggttaaggtaagggtaggtttaggggtttagggtttaacgtttttacgtttacgttacggtacgtacgtaccggtaacgtaacggtacgtaaccgtaccgtaccggtaccggtaccgttaccgttaccggttttcgggaccggtacgggaccgtaggtacgtacggaacgtactaacgaaacgtacgtagtcggtacncgaaccncgtagttaccg

SEQ ID NO: 236467 - DNA, 688 bp, Homo sapiens
  misc_feature: GYAE6OF01C4BQ0.3.35.D02.1.454.CMB.1.raw
  modified_base (246)..(246): a, c, t, g, unknown or other
  misc_feature (246)..(246): n is a, c, g, or t
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (447)..(447): a, c, t, g, unknown or other
  misc_feature (447)..(447): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctggggggagcttggtccagcctgggaggtccctgagactctcctgtgtggtctctggattcaccttcgagggaccacttcatggactgggtccgcaggctcgagggaggctggagtggtgcgtanaagaacaagctaagaagtacacacagatacgcngtatgtacgangcagtacttaccacattccagaaagagtactgaacttacgaaacgctaaacgtctagtacttcctcgataacaaacgtcgaaacctaaccgtgaaacgaccggtaggaacccgacggtccttattacgttacgcgccgtactagtacggttaacttntaacgttagttacgggactaacgttaacgaaccgttacgggcggggaacctacggtaacggacccgttgggtacccaaccggttcccttaccgtaccgtaacgtcccccttaaccggaaccgttacccgggtacccttaccgggttaccccgttcccgtcccccggttcggaccccgtacccgttcacccggtacccgaacggtccctacccggtacccggacccgtaaggccgtaaccgg

SEQ ID NO: 236468 - DNA, 813 bp, Homo sapiens
  misc_feature: GYAE6OF01DKB9K.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctcgtgggtcccaggactccagtgggatgttgtggtgactcagtctccactcctccctcgcccgtctacccttggacacgccgcctccatcctcctcgcgacggtctacggtacaaacgccgttcggtacggtacggtagacgtacggaaacctaccgttacttagtaagtttaggtactcgagacgtaggacggaccgacggaccctaatccgtaccgaacggaccgttacctaaacttaccgttaacgtttaaacgggtttaccgtaaacccggggtaccgtccggttacccggggtaccccaaggtaccgaagtacttaccggacggtccggtacgtacggtacgggtcgaacggtccgacgttagtaacgtttacgaacgtacgtaggaacgttaagtacgggtacggtacggggtagggacggtacgtagggtaacggttggtttacgggtttagggtttaactttttaacgtttcgttcgtacgtacgtacgtacgttaacgtaccctaacgtaccgtacggttaccgggttaccctttaaccggttaccggttttaaccgggacccggtaacggggtacccgaacggtcggtaacgggtaacgttaacccgtaaaccggtaaacccggtaacggttacgggtaccggtacgtaccggtacccgtacccgttacgtttacccgg

SEQ ID NO: 236469 - DNA, 954 bp, Homo sapiens
  misc_feature: GYAE6OF01CJ6SG.3.35.D02.1.454.CMB.1.raw
  modified_base (230)..(230): a, c, t, g, unknown or other
  misc_feature (230)..(230): n is a, c, g, or t
tcagagacgcactccacgaccggtgctcgatttagcacacgatagttgggtttgggggatcaggactcctcagttcaccttctcacaatgaggctccctgctcagctcctggggctgctaatgctcgtgggtcccaggatccgaggtggggatgttgtggtgactcagtctccactcctccctcgcccgtcctacccgttggacacggcccggcctccatcctcctgacnggtctggtacaaacgtcctcgttggtacggtagactacggaaactaccgttacgttagtaattggtaactcgaggacgaacggtacggaccgaaggtacctaaacgttaccgaccggaacggtcccgtaaccgttaaagttccgttaaacgtttaacgggttttaaccggtaaacccgggtaccggtcggttaccgggggaaccccgtaaggaacgtaacggtacgttacgtaaaccgggtccgggacccgttaacgggttacggggtaccgaacggtaaccgttacgttaacggtttaaccgttttaacccgaaaccggtacggttaaacgggtaaacggttaaacgggttttaaacggggaaccggggttaagggggttacggggggtaaacgggttaccgggttaaacgggggttaaggggtttaacggggtttttagggggtttaacggggttttttaaccgttttttaacggttttaccggttacgggttaaccttagggttaccggtaaccgttaaaccgggttaaaccttaacccggtaaaccggttaccggttaccggtttaacccggtttaacccgtttacccggggttttaccgggaacccggggtaaccggggtaaaccgtaacggtacgggtaacgggtagtaaaccggtaaacggtaacccggtaaggttacggttaccggtcgtaaccggtaccctacgtccggtttacg

SEQ ID NO: 236470 - DNA, 678 bp, Homo sapiens
  misc_feature: GYAE6OF01D8KRZ.3.35.D02.1.454.CMB.1.raw
  modified_base (673)..(673): a, c, t, g, unknown or other
  misc_feature (673)..(673): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtacaaagcctcgtgtacggtgatggaaacacctacttagaattggtatcagcaggagccaggcctaatcctaccgaaggccgtacctaattactaagttaaacgggttttaccgtaaaccggggacgtcggttccggggtacccaaggacgaagtacttacgacggcggaccgacgttcggggtacaacgggcctaacgtggttaactttaccgaactaaccgttaggaaagtaaacgtttacggaccggtaagggggttagggaagggtccgtaagggaagggttagtttaggggttttagggtttaacttttacgttttcgtacggtctaagtcgtaacgaacgtactaaccaacgtacgtcggtaccgtaccttacggtttcggaccgacgggaccaggtcgtaggaagtactacgaaacgtacgtaggtcgactagacctacgtnttccg

SEQ ID NO: 236471 - DNA, 850 bp, Homo sapiens
  misc_feature: GYAE6OF01C0H5A.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccaggtggggagtgttgtggtgactcagtctccactctccctcgcccgtcctaccttcggacacgcccggcctccactcctcctgcaggtctacggtaccaaacgcctggtcggtacggtgagtacggaaactaccttacgttagtaaattggtaactcgagacgagacggaccaggaccaactccgtaccgaacggccgtaccgttaattacgttaaggttaaacggtttacccggtaaaccgggtaccgaccgggttacggggtaccccaacggtaaccgtaagtactttaccggaacggtccgggtaccgtacggttacggggtaccgtaacgggtacctaaacgtttacgttaaccgttttaaccaaacctaacggttacgggtaaacgttaaacggtttacgggtaccgggtaagggggttacggggtaacgggtacgtcggggttaaagggtggttttagggttaagggtttaagtttttaccgtttaccggttaggtaacgtagttacggtaacgtaaacgtaacctaaaccgtaaccgtaccggtaccggttaacccggtttaacggttaccggttttacgggaacccggggtaaccgggtaacccgtaacggtaccgtaggggtaaaccgtaacggtaaaccgaaaccggttaaccgtacggttaccgggtacctacgaaccccgtaccgtaccgttaccgg

SEQ ID NO: 236472 - DNA, 791 bp, Homo sapiens
  misc_feature: GYAE6OF01AZ87J.3.35.D02.1.454.CMB.1.raw
  modified_base (277)..(277): a, c, t, g, unknown or other
  misc_feature (277)..(277): n is a, c, g, or t
tcagagacgcactccacgaccggtgctcgatttagcacacgatagttgggtttgggggatcaggactcctcagttcaccttctcacaactgaggctccctgctcagctcctgggctgctaatcgctctaggtcccaggatccagtggggatgttgtggtgactcgagtctccactctccctcgcccgtccacccttggaccacgccggcctccacgtcctcctgcgtacggtctggtacaaacgccgttcgtcgtacggttgacgtacggaaaaccnccttaacgttgtaaatttcgggtactcgtacgcaggacggaccaggtaccaaatcctaccgaaacggcgtacctaaactcgtaactttaacgggttttaccgaaaccggggtaccgtcgtacggggtaccccaaggtacgtacgtagtttccgaaggcccggacgtacgtggggtcaaggtctacgtgtactttcgactacgtacgtaagtaacgttacgtcgaagggtcgggtaaggtccgtagggtaacggtaggttagggtttagggttaagttttaacgtttccggttgtaaccgttaatcggtaacgtaaacggtaccttaaccgaaccggttaaccgtacgggttacccgttaacgtttacccggttttaccggggaaccccggttaaacgggggaacccgtaaagggtcccggttaagggtaaccgtaacggtaaacccggtaaaaccgtaaccgtttacgggaccggtacgttaacccgaaccggttcccgttaacggttacccgg

SEQ ID NO: 236473 - DNA, 702 bp, Homo sapiens
  misc_feature: GYAE6OF01COGRC.3.35.D02.1.454.CMB.1.raw
tcagagacgcactccacgaccggtgctcgatttagcacacgatagttgggtttgggggatcaggactcctcagttcaccttctcacaatgaggctccctgctcagctccgtggggctgctaatgctctgggtcccaggatccagtggggatgttgtggtgactcagtctccactctccctcgcccgtcacccttggacagccggcctccactctcctgcaggtctggtacaaagcctcggtgtacggtgagtaggaaacaccttacgttagtaagttggtatacgagacgaggacggaccgacggacccaatcctaccgaacggccgaccttaatactaagtttaacggttttaccgtaacccgggtaccgtcggtacggggtacccaaggtaacagtacgttacgacggccggacgacgtcggtacgaggtactacgtgtactttaccgactacgtagaagtaagttaggacggtaggggtagggaggtcgtaggaaggtaggttagggttagggtttaattttacgtttcgtagtacgagttacgactaacgactaacgacgtacgtacggtaccgttacgttacgtttaccgggaccggtaacgggaccgtaacggtacggtacggtaagaacgtaaccggtaaaaccggtacggttacggtaccgggacgttacggacccgtaaccgttcgttacccg

SEQ ID NO: 236474 - DNA, 755 bp, Homo sapiens
  misc_feature: GYAE6OF01EIBTX.3.35.D02.1.454.CMB.1.raw
tcagagacgcactccacgaccggtgctcgatttagcacacgatagttgggtttgggggatcaggactcctcagttcaccttctcacaatgaggctccctgctcagctccgtggggctgctaatgctcgtgggtcccaggatccgaggtggggattggttggtggtgactcagtcctccacttcctccctcgcccgtactacccgttggacacggccggccctccactctcctgccgtaggtctcggtacaaacgtcccgttcggtggtacggtgacgtacggaaaacctaccgttaacgttagtaagtttaggtatccgaaggacgagacggccgaacggaccaaactccgtaccgaagggtccgtaaccttaaagttccttaaagtttaacgggttttaccggtaaccgggacggtcgttacggggtaccaaggtaacgagtacgtcgaggcgacgacgtgggcacggctagtgtacttacaacgtacgtagtaagtaattggacgggaggggtacggacggtagtagggtaaggtggttagggtttagggtttaattttacgttcggtcgtaacgtttacgagtaacgtaacggtacctaaccgtacgttaaccggtccgttaaccggttaccgttaccgggtttccgggaaccggtaaaccggggtacgaaacggttcggtaaacgggtaaggaaccgtaaaccggtaaaaccgtcgtacggttacgggcctacgtaccctactacgttccg

SEQ ID NO: 236475 - DNA, 904 bp, Homo sapiens
  misc_feature: GYAE6OF01BUX0L.3.35.D02.1.454.CMB.1.raw
tcagagacgcactccacgaccggtgctcgatttagcacacgatagttgggtttgggccgagctgggttttcctggttgttattttacaaggtgtccagtgtgaggtgcagctggtgcagtcgtgggggagcttggtccagcctgggaggtccctgagactctcctgtgtgtctcgtggacttcaccttcgagggacctacttcagtggacgtcggggtcccgaccgagggcctaccgggaagggggaacgggggtccgtaggggtagggttcgggggtttacggacccggttaaagttaaaacggaaaaccgtaaaaggtacgttaaaacggtaaaacgtttacccaaacccgaacgtaacgggttaaacttttaacccgggccccggttccggttccgttacgggttacggaaccggacgggacctaaggtaacctttaccaacccgttacttacccgttaacgaaaaggtaggtaacgttacggttaaacctttaacgaaaacggtacccctaaacgttacgtaacggtttaccggtcccttacgtacgggtaaacctaaaaggttaccgtaaaacccgtacccggtaaaggaaaccggacccgggtaaacgggacccgtaaccggtacctttaacgtacgttaccgtacggaccgtacctaacgtacgttacttacgtaagttacggtacgtaccgtactaaccgtacgtaccggtacgggaaccgtacgggtaacgtccggtacggtacccgtaccggttcccgtccgtacgtaccgtccccgtaaccgaccccggtaaccggtccctaccggttccccgttaccccgttccccggcgtccccgcccgtccgaccgtcccgaccgtccgaccccgtaccgaccggacgcccgtaacccgg

SEQ ID NO: 236476 - DNA, 966 bp, Homo sapiens
  misc_feature: GYAE6OF01AJR7Q.3.35.D02.1.454.CMB.1.raw
tcagagacgcactccacgaccggtgctcgatttagcacacgatagttgggtttgggggagtcaggactcctcagttcaccttctcacaatgaggctcctgctcagctcctggggctgctaatgctcgtgggtcccaggactccaggtggggtattgttgtggtgactcagttctccactcctccctcgcccgtcctaccgttcggacgcggccggcctccattcctccgttgcggtacggttcgttcggtaacgtaaccgtccgttacggtggttaccggtaggtataccggtaaaacctacccgttagttacgtaaggtttcgtaacgttacgaccgagtaacggtaccggaccgacgggtaaccctaaacttccggtaaccggaacggacccgtaaccgttaaacgtttcccgttaaaagttttaaaccgggtttaccggaaaacccggggtcggttccggttaacgggggtaacccaacgggtaacgttacggtaaccgtttaccgggaacgggtacccgggtaacccggttcgttacggggtacccgtaacggggtacctttaaccggtcgtttaaacgtttaccgtaacctaccggttaagaaggttaaacgttacgggtacggggtacggggttacggggaacgggttcgttaaggggagggtttaagggtttacgggttttaggtttaaaccggtttttagtttccgggtttaaggtaccttaacgggtagtttaaccgggaaacctttaccgtaaaccggtaaaccggttaccggttaacccgggtccgttttaaaaccgggtccgttttaaacccggggacgggtaaaccggggttaccggtaaccggtaggggttaaccggtacggtaaaccggttacgtaaaaacccggggtttacggtacgggttaaccgttacccggtttaacggaaccccgttaaaggtccgtttaacccgg

SEQ ID NO: 236477 - DNA, 704 bp, Homo sapiens
  misc_feature: GYAE6OF01AYDO4.3.35.D02.1.454.CMB.1.raw
  modified_base (219)..(219): a, c, t, g, unknown or other
  misc_feature (219)..(219): n is a, c, g, or t
  modified_base (506)..(506): a, c, t, g, unknown or other
  misc_feature (506)..(506): n is a, c, g, or t
  modified_base (561)..(561): a, c, t, g, unknown or other
  misc_feature (561)..(561): n is a, c, g, or t
  modified_base (617)..(617): a, c, t, g, unknown or other
  misc_feature (617)..(617): n is a, c, g, or t
  modified_base (628)..(628): a, c, t, g, unknown or other
  misc_feature (628)..(628): n is a, c, g, or t
  modified_base (675)..(675): a, c, t, g, unknown or other
  misc_feature (675)..(675): n is a, c, g, or t
  modified_base (684)..(684): a, c, t, g, unknown or other
  misc_feature (684)..(684): n is a, c, g, or t
  modified_base (696)..(696): a, c, t, g, unknown or other
  misc_feature (696)..(696): n is a, c, g, or t
tcagagacgcactccacgaccggtgctcgatttagcacacgatagttgggtttgggggatcaggactcctcagttcaccttctcacaatgaggctccctgctcagctccgtggggctgctaatgctcgtcgggtcccgaggactccgaggtggggtattggttggtgggtcgactcacgtcctccctactcctcccgtcgcccgtcctaccgtggaccncggccggtcctcctactcctccgtgcgtacggtcgtacgtacgaacgtccgttcgtaggtacggtagtagtaaccggaacctaccgttagttagtaagttggtactacgagacgacggacggccgacggtacctactccgtaaccgacggtcctaaccttaattacgttaacggttacggttaccggacgggaccgtcgggtaccggtaccagacgtagtactcgacggcgacgtacggtcggtacgacgtctacgtacgtactacgactagtagaagtacgtaggnggtagggtgaggtcgtaggaggtaggtttcggttaaggtttactttcgtgacgtntaggtacgacgtacctacacggtacgtcggttaccggtacttaacggttaccgggngaacccggggngtaacctaggacccgtaagggtaacaacgtaaccggaagggttccgngggtaaccncgtacacccgtntcgttcgg

SEQ ID NO: 236478 - DNA, 881 bp, Homo sapiens
  misc_feature: GYAE6OF01EC7JT.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctcgtcggtccaggatcgaggtggggatgttcgtggtagactcagtcctcctactctccctcgcccgtcgtacccgttggaccacgcccggtccctccacttcctccgtcgcgtacggttctaggtaccaaacggtcccgttcggtaggtaccggttgtaacgtacggaaaacctaccgtttaacgttaggtaacgttggtaacttaccgaaggccgtaacggacggtaccgacggaaccctaacgtccgtaaccggtaacggggaccgtaccccgttaaagttaccgttaaaggtttaacccggggttttacccgtaaacccgggggtacgttcccgggtaccgggggttaccccaaggtaccgtaacggttaacttccgggaacggtaccggccggtacggtcgggtaccgaggtaccttaacgtgttacgttcccaaacgttacggtaggtaacgtaaacgtttacggaccggttaagggggtcggtaacggttacggtaagggtagggttagtttacggggtttacgggttttattttaaccgttttcggtacggtacgttaacgggtacgtaaccgttaacggtaaccgttacccgtaaacggttcccggtttacggggtaccccgtttaacgttacccgggtttacggggaacccggtaacgggtaaccgtaaacgtcggtaacgggtaacgtaaccgtacggtaaaccggtcgttacgggtacctacgtaccgtaccttcgtaccggttccg

SEQ ID NO: 236479 - DNA, 691 bp, Homo sapiens
  misc_feature: GYAE6OF01CS69G.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatcctcctgccaggtctggtacaaagcctcgtgtacggtgatggaaaactacctacttgaattggtatcagcagacggcagccaatctaccaggcacctaatctaagttaaggttcgtaaccgggacgtcgtcgggtacccagacagattccgagcggtacacgtgggtacaggacacgttagtactttcaccgtaacgtagtaacgtaagttaggtacgtaaggggtagggacggtacggtaggtaagggtagttgggtttagggttaattttaacgtttcgtacgtacgtagtacgacgtaacgtacctaactaaccgtaccgttacgggtaccgttaaccgttaccggttttacgggacccgggtaaccgggaaaccggtaaccggtcggttaacgggtaaggttaacgttaaccgggaaaaccgtaaaccggtttacgggtcggtaccgttacggaacccctaacggtaccctttaccgg

SEQ ID NO: 236480 - DNA, 736 bp, Homo sapiens
  misc_feature: GYAE6OF01A7LSC.3.35.D02.1.454.CMB.1.raw
  modified_base (496)..(496): a, c, t, g, unknown or other
  misc_feature (496)..(496): n is a, c, g, or t
  modified_base (603)..(603): a, c, t, g, unknown or other
  misc_feature (603)..(603): n is a, c, g, or t
tcagagacgcactccacgaccggtgctcgatttagcacacgatagttgggtttgggggatcaggactcctcagttcaccttctcacaatgaggctccctgctcagctcctggggctgctaatgctcgtggtcccaggatccaggtggggatgttgtggtgactcgagtctccactcctcccgtcgcccgtcctacccgttggactacgcccggtcctccactccgtcctgcgtaggtctaggtacgaaacgtcccttacggtgtacggtgactacggaaaacctaccttacgttagtaagtttgggtaacttacgaggtaccggaaggaccgggtacccgaacgggtaccctaaacgttcccgaacccggtaaccggtaccgtacccttaaacgtacgttaacgtttaaccgggtttaaccgtaaccggggaccgtcggtaccgggtaccccgaaggacgtaacggtactacggacggccgtagtcggtggtaccnggtactactagtaccttacacgtacgtacgtaagtaacgttacggaggtacgggtagggacggtacggtaggtaggtaggttagggttacgttacgttagtttccgngtacgtagccgtaacgactacgtaccactccggttacgccttacgttacggttacgccggtaagggacccgagtacggtagtacgtactaaccggaaactcggttacgtacgaccgtagacctacgtagtccg

SEQ ID NO: 236481 - DNA, 1035 bp, Homo sapiens
  misc_feature: GYAE6OF01CJF20.3.35.D02.1.454.CMB.1.raw
tcagagacgcactccacgaccggtgctcgatttagcacacgatagttgggtttgggccgagctgggtttcctggttgttattttacaaggtgtccagtgtgaggtgcagctggtgcagtcgtgggggagcttggccagcctgggacgggtccctgagactctcctgtgtcggtctctggtattcaccttgagggaccctactttcacgtgggaccgttcggggtcccgaccgtagggcccttacccggaagggggtaacgggggccgttaggggtaacgggttcgggggttttaccgggacccgttaaaagttaaaacggaaaaaccgtaaaaggtaccgttaaacggtaaaaccgtttaacccgaacccctaacgtaaacggtaaccgtttaacccggccccgtaccggtttaccgttaggtaccggaaccgtaggggacctaaggtaacctttcccaaacccgtaattcccgtaaacgaaaggacgtagttacgtaactttaccgaaaacggtccctaacgtccgtaacggttgttcccttacgtacgtaaaccgtaaacgttaccggaaaccctacccggttaagggaaaacccgtacccgggaacgggaacccgtacccggggttaccccgttattaacgttaccgtacgtacccgttaaccgttaacgaacggttaacctttacgtaaacgtttaacggttaccgggaacgtttaacccggttaaccggttaaccggttaaaccgggtccgggggtaaacccgtaacccggggtaaccggtttaacccggtaccgggttacccccttaaccccgggtttacccgttaccccgtacggtaaccccggtttccccaaacccccgggtacccgggtaaaaccccggggtccccgttaaccgggttccccgggtttaccccccgttccccgggtaacccggtccccggtacccccgttacggtacccccttacgggaaccccggtacccgttaaccccgaccccgtttaacccgggacggtcccgaaaccccgg

SEQ ID NO: 236482 - DNA, 639 bp, Homo sapiens
  misc_feature: GYAE6OF01EP74O.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacacgccggcctccatctcctgcaggtctggtacaaacgcctggtgtacggtgataggaaacctacttacttgtaagttggtatcagcagacgccgaggacctaatcgtaccgaaggccgtacctaattcctaagttaacggtttacgaaccgggacgtcggtacgggtacccagacgagtacttacgaggccggctacgtgggtacaggactacgtgtactttacactactaggaatacgttaggcgtagggtcggaggtcgtaggaggtgttacggtggttaactttagtctagtctagttcgaacgtaagtcctaagaccgtacgtaccggtacttaccgttacggtttccggaaccggacgggtaacctaaggtacgtaaggtacgtaaacgtaccgtaaaacgtgttacggtacggactaaccgtactccgtaagttccg

SEQ ID NO: 236483 - DNA, 837 bp, Homo sapiens
  misc_feature: GYAE6OF01DSIGX.3.35.D02.1.454.CMB.1.raw
tcagagacgcactccacgaccggtgctcgatttagcacacgatagttggggtttgggggatcaggactcctcagttcaccttctcacaatcgaggctccctgctcagctcctgggctgctaatgctcgtcggtcccaggatccgaggtggggtatgttgtggtgactcgacgtcctcctactctcctcgcccggtactaccgttcggacctacggcccgtcctccagtccctccgtcgcgtacggttcgtacgggtaaccaacggtccgttacggttaggtaccggtgtaacgtacggaaacctaaccttacgttaagtaacgttacggtactacgacgtaccgaggacgtacgaacggtccaagtccgaccgaaggtaccgtaaccttaacggtaccttaacggtttaaacggttacccggtaaaccgggtacgtaccggtccggggtaacccgtagaaccgtagtacgttacggacggtacggtacggtacgtcgggtacgtacggctaacgttgtaacgtttaccgaactacgtacggaagttaacgtacggaacggtagggtaacgggttacggtacggttacggtaaggttacgggtttacgggtttacggtttaagttttacgttacggttacggtacgtacgttacgtaacgtaaaccgtacttaaaccggtccgttaccggtcgggttaacccgtttacggttacccgggtttacgggaaaccccgggtaggtaaacccggtaggacggtaacgggtaagtaaccgttaaacggaaacccggttagtacggtacggtacgtaccgtaaccgtaccgtacgtttacccgg

SEQ ID NO: 236484 - DNA, 993 bp, Homo sapiens
  misc_feature: GYAE6OF01E047P.3.35.D02.1.454.CMB.1.raw
  modified_base (976)..(976): a, c, t, g, unknown or other
  misc_feature (976)..(976): n is a, c, g, or t
tcagagacgcactccacgaccggtgctcgatttagcacacgatagttgggtttgggggatcaggactcctcagttcaccttctcacaatgaggctccctgctcagctccgtggggctgctaatgctcgtcgggtccaggactcgaggtggggtattgttgtggtcgactcgacgtctccacttcctcccgtcgcccgtcctaccgttacggaccgacggtcccggtcctcctaccgtcctccgtcgtcgtacggtacgttcggtaaccgaaaccggtccgttacggtacggttaccggtagtaaacggtaacggtaaaacccttaccgttaacgtttacggtaacgtttacggtaactaccggaacggtaccggaaaggtaaccggacccgtaaccggtaaccgtaaccgttacccgtaaaccggaacgggtacccgttaaccgtttaaacgttaccgtttaaacggtttaaaccggggttttacccgggtaaacccgggtaccgggtacccgggttaacgggtaaccccgtaaggaacccgtaggttacgttacggaccggtcggaccggttacgtacgggtacgtacggtacgtaaaccgttgttaaccgtacgtaacgaacgttaaggtaacggtaagtaccggggtggtaacggggtacgggtacggtaaggtacgggttaagggttacggttacgggtttaaggtttacgtttacgtttacgtacgggttacaagggttaccgtaaccgtaacggtaccgttaaaccgtaacggtttaccccgggttacgggttaacccgttaccggttttaacggggtcccgggttaaacccggggtaaaacggggaaccccggttaaccgggttaaggttaaacccggggtaaacgtaacccgggtttaaaaccgaacgggtttacccggtaaacgggtcccggtttaaacggtaacccgtaaccccggttttaaccgngggtttttaaaccccgg

SEQ ID NO: 236485 - DNA, 742 bp, Homo sapiens
  misc_feature: GYAE6OF01B25O0.3.35.D02.1.454.CMB.1.raw
  modified_base (221)..(221): a, c, t, g, unknown or other
  misc_feature (221)..(221): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctggggggaggcttggtccagcctgggacgggtccctggagactctcctgtgtggtctctggattcaccttcgacgggaccacttcatggactcgggtccnccaggctcgagggagggctggaggtgggtggaccgtataaagaaacaagctaagaagtacacacagtactacgccgcgtctgtgacgaggcagtacttccacctatactacaagagtagtatactacaagacaacctgtagttctactcgtacgaactaatacgaaccctaaccgtacggaaacgaaccggacggacccgtaccggtacccgttacgttaacgttaccgtacggacccgtaacgtacgtaacgttactttacgtaagtttacgtacgggtaacgtaccgttaccggtaaccggttaccgggtacggggaccccgaacgggtaaccgtaccgttaccggtaacccgtacccgttacccgtacctacccgtacccgttacccgtacccgtaacccggaacccggtccccacggttccccgtccccgttaccccggtcggtccccgtaccccgtccggtacccgtacccggaccggtacccgtacccgaccccgtacggtaacgccgaacccgg

SEQ ID NO: 236486 - DNA, 840 bp, Homo sapiens
  misc_feature: GYAE6OF01EW1TC.3.35.D02.1.454.CMB.1.raw
  modified_base (232)..(232): a, c, t, g, unknown or other
  misc_feature (232)..(232): n is a, c, g, or t
tcagagacgcactccacgaccggtgctcgatttagcacacgatagttgggtttgggggatcaggactcctcagttcaccttctcacaatgaggctccctgctcagctccgtggggctgctaatgctcgtgggtcccaggatccgaggtggggattggttgtggtgactcacgtcctccactcctccctcgcccgtcaccgttggacacgcccggcctccatctccgtcgcgnggtctgtacaaacgtcctcgtgtacggtgaagtacggaaacctaccgtacgttagtaagttaggtactcaagtacgaaggacggaccgacggacctaacgtaccgtaaccgaacggtccgtacctaaacgttaccgttaaggtttaaacggtttaccggtaaaccggggtacgtaccggtacggggtaccctaacggaacgtaagtaacgtccgaacggtcggtaccgtaacggtcgggtacgacgggacgtaacgtacggttactttaccgaaccgtagtacggtaagtaacgttagggaccgggtaggggtacggggagtacgtagggttaaggtacggtttaggggtttacgggtttaactttttacggtttacgaggtacgtaacggtacggtaaccgtaacgtaactaaccgggtaccgtacgggttacccggtaccgtttacgtttaaccgggtttcgggaacccgggtaaaccggggtaactaaacggggttccgttaacggggaaacgttaaacccggttaaacgaaaaacccggggttacttaccggggtacggttaaacccgttcccgggaactttaacccggggttacttacccggg

SEQ ID NO: 236487 - DNA, 662 bp, Homo sapiens
  misc_feature: GYAE6OF01BGOQO.3.35.D02.1.454.CMB.1.raw
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (320)..(320): a, c, t, g, unknown or other
  misc_feature (320)..(320): n is a, c, g, or t
  modified_base (324)..(324): a, c, t, g, unknown or other
  misc_feature (324)..(324): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctgggggagcttggtccagcctggagggtccctgagactctcctgtgtggtctctggattcaccttcgagggaccacttcatggactgggtccgccaggctccgagggaagggctgggagtgggttgccgtataaagaacaaagctagaattacacacagatacgccgngtctgtgacnggcagacttcgaccatcctanaagngatgacttcaagcaaactcgaagtgtctactgacgaaatcgaaacacctagaaacgacgagtaccgaccggtccgtactacttaacgtcgacgtactacgaagtacttactaagttagtaggtacgactaacgtacgtaccgtaggggacccgaacgggtactaccgtacgtaccgtaccgttacctcccgttaccgaccgttacccgtaccgaacccgtaaccgggcccgtacggttacccggttccccgttaccccccgtcgggtaccccgccccggtcgacccgttacccgaacggtcccgtacccgacccgttaccggaccggtaccggacccg

SEQ ID NO: 236488 - DNA, 697 bp, Homo sapiens
  misc_feature: GYAE6OF01C4SFH.3.35.D02.1.454.CMB.1.raw
  modified_base (665)..(665): a, c, t, g, unknown or other
  misc_feature (665)..(665): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtccccaggatccagtggggatgttgtggtgactcagtcctccactcctccctcgcccgtcctacccttggacacgcccggccctccatctcctgcgagtctgtacaacgtcctcgtgtacggtagactggaaacaccttatagtagttgtatcgagcacgacggaccaggaccaatccgtccaacggccgtaccgtaatacctaacgttaaggtttccgtaaccgggacggtcgtccggggtcccagtaccgaagtattcgaacggtcggaccgtacgtcgggtacgacggtaccacgttagtacgttttaccaacgtactaggtaacgtaacgtaagggtacgtagggtagggacggtacggtagggaagggtacgtttggggtttagggttatttttaacgttcgttcgtagtactacggtactaacgtaacctacgaccgttaccgttacggaccgttacgttaccgttacggacccggacggggtaaacccacggtacgacggtaacgtaacgtaaccgtaaaccgtacgnggttccggtactagaccctactacgtttcccg

SEQ ID NO: 236489 - DNA, 665 bp, Homo sapiens
  misc_feature: GYAE6OF01CG22C.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctgggtcccaggatccagtgggatgttgtggtgactcagtctccactctccctcgcccgtccacccttcggacacgccgcctccatcctcctgcaggtctggtacaaacgccgtcgtgtacggtagataggaaacacctacttagtaattggtatcagcagacggccacggaccaatctaccgaacggccgacctaactactaagttaaacggtttccgtaaaccgggtaccggacgttcggggtaccccaacggacgaagtacttacgtacgcggaccgacgtcgggtacacggctactgtactttcactacgtagaagtattacgcggtagggtagggagtcgtaggtaacggtaggttgggttagggttagttttaacgtttcgtacgtcttaacggtgacgtaacgtacctaaccgtaaccgtacgttcgggtacccttaccgttacgttttacccgggccgtaacggggtaaccaacgtcgtaccggtagacgtaacgaaacgtacgtacggtacggtacacgacaccgtgttacg

SEQ ID NO: 236490 - DNA, 812 bp, Homo sapiens
  misc_feature: GYAE6OF01A1JZC.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacacgccggcctccatctcctgcgaggtctggtcaaacgtcctcgtgtacggtgatacggaaacaccttacttgtaagttggtatacgagcgagacggacccgaggaccctaacgtcctaccgaacgggtcccgtaccttaaattactttaagtttaaaccgggttttaccgtaaacccggggtacggtaccggttaccggggttaccccaaggaaccgtaagtacgttaccgaacggtccggaccgtaacgttcggggtacgacggtacctacgttagtaactttaccaacgtacttaggaaagtaactttacgggacggtacgggggttagggacgtacggttaggtaacgggttaaggtttggggtttaacgggtttaatttttacgttttccgacggtacgttaaggtacggtaaccgtaacggtacccttaaaccggtaaccgttaccggtacccgggtttacccgtttaaaccggtttccgggttttaaccgggaccccgggtaaacggggtaaacctaacgggtacccggttagggaacggtaaccgtaaacgtaaaccgggttaacgttcggtacggtaccgtaacggtaccctaaccgttacgtttccg

SEQ ID NO: 236491 - DNA, 815 bp, Homo sapiens
  misc_feature: GYAE6OF01ANJ88.3.35.D02.1.454.CMB.1.raw
  modified_base (781)..(781): a, c, t, g, unknown or other
  misc_feature (781)..(781): n is a, c, g, or t
tcagagacgcactccacgaccggtgctcgatttagcacacgatagttgggtttgggggatcaggactcctcagttcaccttctcacaatgaggctccctgctcagctccgtgggctgactatgctcgtcggtccaggtactcgaggtgggtattgttggtgtacgactcgtacgttcctcctacttcctcccgtcgtacccgtacctaccgttaggaccgacggtcccggtcctaccgacttcctccgtcgtcgtacggtcgtacgtaacgtaccgtccgtacgtcggtacggtatacgtaacgaaacctacgttacgtacgttaagttacgtacgtacgtacgacggtaaccggtacgaccgtacgacctaacgtccggtaccggtaacggtaccgtaaccgttaacgtaccgttttaacgggttaacccggttaaccggaaccgggtccggttaccggtaccgggtaaccgtaacgtacgtacgtacgtaccggacgtacgtaccggtacgtcggtaacgtacgtacctagtccgttaacgtccgtacggtagttaacgtagttaacgtacggtaacgggtagtacggtaggtaccgagggtacggttacggttagggtttacgttacgttttacgtacgtagttacgacgttaacggaaccgttaacgacgttaacctaccgggttccgttaaccgttaccggttaccgttacgggtacggacccggtaaggtaacctggtacggttaacgacgtacggtaaacccgtaggttaccgnggacccgtgttaaaccggccttaaggttcctcgg

SEQ ID NO: 236492 - DNA, 747 bp, Homo sapiens
  misc_feature: GYAE6OF01C7WJ8.3.35.D02.1.454.CMB.1.raw
  modified_base (140)..(140): a, c, t, g, unknown or other
  misc_feature (140)..(140): n is a, c, g, or t
  modified_base (543)..(543): a, c, t, g, unknown or other
  misc_feature (543)..(543): n is a, c, g, or t
  modified_base (601)..(601): a, c, t, g, unknown or other
  misc_feature (601)..(601): n is a, c, g, or t
tcagagacgcactccacgaccggtgctcgatttagcacacgataggttggggtttgggggatcaggactcctcagttcaccttctcacaatgaggctccctgctcagctccgtggggctgctaatgctcgtggtccaggntaccgaggtgggatgttgtggtgactacagtcctcctactcctcccgtcgtccccgttaccgaccgttcgggactacggccggcccttccactctccgcgacaggtctaggacaaacgtccgttggtacggtaccggtaagacgttaaacggaaaacctcccgttaaagttacggaagtttacggtaactacgacggataacggacggaccgaggaacccgaaacttccgtaaccgagtacccgtactaacttacgttaacggttaacggtttaaccgaaccggggtctaccggtccgggtaacccgagtaaccgagtaaccgttcgaccgggtacgccgtaaccggtcggaccgagggaccttagtaccgtaacgttacctacgactaggaatacggtacgngtaggggtacgagtacgagggtagtcgttagggttaggtaatttactcggtagtacgngttacgaacggtaactaccggactacggtacttaccggacggttaccttaccggtttacggaacgtaccgggaacctaggtaccggtaagggacgtaaaccttcgaaaacggttcgacggtcggccgtaaagccctagtcggttac

SEQ ID NO: 236493 - DNA, 783 bp, Homo sapiens
  misc_feature: GYAE6OF01CSXT5.3.35.D02.1.454.CMB.1.raw
  modified_base (196)..(196): a, c, t, g, unknown or other
  misc_feature (196)..(196): n is a, c, g, or t
  modified_base (382)..(382): a, c, t, g, unknown or other
  misc_feature (382)..(382): n is a, c, g, or t
  modified_base (438)..(438): a, c, t, g, unknown or other
  misc_feature (438)..(438): n is a, c, g, or t
  modified_base (469)..(469): a, c, t, g, unknown or other
  misc_feature (469)..(469): n is a, c, g, or t
  modified_base (521)..(521): a, c, t, g, unknown or other
  misc_feature (521)..(521): n is a, c, g, or t
  modified_base (543)..(543): a, c, t, g, unknown or other
  misc_feature (543)..(543): n is a, c, g, or t
tcagagacgcactccacgaccggtgctcgatttagcacacgatagttgggttgggccgagctgggttttcctggttgttattttacaaggtgtccagtgtgaggtgcagctggtgcagtctgggggagcttggtccaggcctgggagggtccctgagactctccgtgtgtggtctctggattcacttcgagggccntttcgatcgggacgttcgggaccgccgagggtccctaccggaaggggaacgggggtccttggggtacgggttcgggggtttacggacccggtttaaataaaaacgggaaaaacctaaacggcgttaaggtaaacgttaaaccacccgtaaaccaaaggtacgttaacccggcccggtcgtttccgnggttacgaaccgtagggacctagacgtttaccaacccgaatcgtaacgtaaagganagttacgtagttacaaacggactaacgtcgnggttactctaccgtgaaactaagtcgaaaacccttccaaggaaccggaccgnggaaaccgccggttaccttacngtttacgtcggacttacaacgatacgttactataagtttcggcttaccgtaacgtacgtaccggtacgggccgtacgggacgtaccgttcgggtacctaacccgttcgtcccgtagacccggtaccctacccggaaccgtacgggaccctgtttacccgggccctttaccccgggcgtacccgtaccccgcttaccgccggaacgtccgaccggacccttaccgggaacgccggaaccgg

SEQ ID NO: 236494 - DNA, 781 bp, Homo sapiens
  misc_feature: GYAE6OF01D7U69.3.35.D02.1.454.CMB.1.raw
  modified_base (333)..(333): a, c, t, g, unknown or other
  misc_feature (333)..(333): n is a, c, g, or t
tcagagacgcactccacgaccggtgctcgatttagcacacgatagttgggtttgggggatcaggactcctcagttcaccttctcacaatgaggctccctgctcgagctccgtggggccttgctaatgctcgtcgggtcccaggatccaggtggggatgttggtggtgactcagttctcctactcctccgtcgtcccgtctacccgttggaccgacggtcccggccctaccactccgtcctcgcgtacggtctggtacaacgtcccgttgtcggtacgggttagacgtacggaaacctaccgttacttaggtagtttaggtactacagtcaggngtaccagacctactcgtaccggaaggccgaccttaagtcgttagttaacgggtttaccggtaaccggaccgtcggtacggggtaccccagtaccgtaaggactttcgggaacgtccggaccgtggtacgggtcgtacgactgttaccgtagtttaccaacttcggtaagtaacgtaaaggtccggtaacggtagggggtacccgaggtacggttaagggtaacgggttacgttggggttaaaggtttttacttttacgtttaccgggaattccgaagttcgggaaacccttaagggtaaccttcgaaaccttccgggtaccgtttacccgtaacgtttagggtttccccggaaccggttaaaggggcccgtaaggttacggtaacgacgtaactaacccggaaaccggttacggttcgacggtccgtactacccgtacttacgttccg

SEQ ID NO: 236495 - DNA, 753 bp, Homo sapiens
  misc_feature: GYAE6OF01BOPSF.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctcgtgggtcccaggatccagtggggatgttgtggtgactcagtctccactcctccctgcccgtctacccgttgacacgccgcctccatcctcctgctaggtctaggtacaacgtcctgtggtacggtagagtacggaaacctaccttacgttgtaagttggtatcagtcagacggccgacggacctactccgtaccgacggtacctacctaagtcgtaagttaacgttaccgtaaccggtacgtcgtacgggtaccagacagtacgtacgacgcgtacgagtcggacacgtctatacgtacttacacgtagtagtaacgtaagttacggacggtaaggggtcggtacggtacggttagggtaagggttacgttagggtttagggtttaactttttacgtttaccggttagtaccgtaacgttaccgtaacgttaaccgtaacgttaaccccgtaccggttaacccggttccggttaaccccggttaaccgttaccggtttaccgggacccggtaaccgggtaaacccgtacgggtaccgtagggtaaacggtaacccgtaacccggtaaaaccggttaccggttacgggtacggttacccgaaggtacccctaaccgttaccgttcccg

SEQ ID NO: 236496 - DNA, 638 bp, Homo sapiens
  misc_feature: GYAE6OF01A4W35.3.35.D02.1.454.CMB.1.raw
  modified_base (520)..(520): a, c, t, g, unknown or other
  misc_feature (520)..(520): n is a, c, g, or t
  modified_base (523)..(523): a, c, t, g, unknown or other
  misc_feature (523)..(523): n is a, c, g, or t
  modified_base (542)..(542): a, c, t, g, unknown or other
  misc_feature (542)..(542): n is a, c, g, or t
tcagagacgcactccacgaccggtgctcgatttagcacacgatagttggggtttgggggatcaggactcctcagttcaccttctcacaatgaggctcccctgctcagctcctggggctgctaatgctctgggtcccaggatccagtggggatgttgtggtgactcagtctccactctccctgcccgtcacccttggacacgccggcctccatctcctgcaggtctggtaccaagtcctcgtgtacggtgataggaacacctacttgaattggtactcaagcgaagacggaccaggccaactctaccgaaggtccgaccttaaagtcttaagttaaacgggtttaccgtaaacccggggacgacggttccgggggtacccaggaaccagtacttcgaacggtcgggactaacgtcgggttcacggtacaccgtggtactttccaacctacgtagaagtaacttaggcgtaagggggttcgaggtctaggacggtaagttcgggttagggtattttcgttcngtnagtgactacgtctacgacncgtaggtcctaagtcgttacggcgtaacgggaccgtaagcgtagggatacgtacgtaaaacgcgttacggtcggtacctgaccctaactcgtaccg

SEQ ID NO: 236497 - DNA, 599 bp, Homo sapiens
  misc_feature: GYAE6OF01CEI2R.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctgggtcccaggatccagtggggatgttgtggtgactcagtctccactctccctgcccgtcacccttggacagccggcctccatctcctgcaggtctggtacaaagccctcgtgtacggtgataggaaacaccttacttagtaattggtatcagcaggacggccaggaccaatctaccaaggccgacctaactctaattaaggtttcctaaccgggacgtcgtgggtacccagacagattcgacgcggcacgtgggtcaggcatgactttcactactagagtaatagcgagggtggaggcgtagaaggagttggttaggttattttagttcgtgtactatgacaagtactacacgtacgtcggtaccttacgtacgtttacggacccgtacggggtaaccaaggtacgtaggtaagtaacgtaacgaaaacgtacgttacggtacggtacgtacgaccgtaaccgtacgttaccg

SEQ ID NO: 236498 - DNA, 822 bp, Homo sapiens
  misc_feature: GYAE6OF01CRRMC.3.35.D02.1.454.CMB.1.raw
  modified_base (374)..(374): a, c, t, g, unknown or other
  misc_feature (374)..(374): n is a, c, g, or t
  modified_base (381)..(381): a, c, t, g, unknown or other
  misc_feature (381)..(381): n is a, c, g, or t
tcagagacgcactccacgaccggtgctcgatttagcacacgatagttgggtttgggggatcaggactcctcagttcaccttctcacaatgaggctccctgctcagctcgtgggctgctaatgctcgtcgggtcccaggactccgagggtggggtattggttggttcggtcgtaactcgtaggtcccttaccctaccttcctccctccggtacccccgttaccgtaccccgttcgggacctacccggcccggtccccttccctacttcccgttccggtcgcgttacggttccgtacggtaccgaacggtcccgttacggtaggttacggtagtagtaaccggaaacttaccgttagttagtacgttgtactacgnggtacgnggacggaccgtacgaccacgttccgaccgacggtacctaccgttaactcgttaacggtttaacggtttacccgaacccgggtccgttcgggtacccgggtaccgaacgtacgaacgttcggtaccgacggtccggtacgtcgtacgggtaccgacgtactacgttacgttacgttacgactaaacggtgtaagtcggttaggacgggtggggtaacggtacggtagttcgggtaacgggttggtttagggtttacggtttaagttttccgttcgttaacggttcgtacgtcggtaactacgtaccgtaaccgtacgggttccgtacggttaccgttaccgtaccgggtttaccggaacggtacggtacgtacgtacggacggaataaccgtaccgaacgtaggttcgtaaccggtactaccggtaacctcgttgttacccg

SEQ ID NO: 236499 - DNA, 714 bp, Homo sapiens
  misc_feature: GYAE6OF01C186P.3.35.D02.1.454.CMB.1.raw
tcagagacgcactccacgaccggtgctcgatttagcacacgatagttgggtttgggggatcaggactcctcagttcaccttctcacaatgaggctccctgctcagctccgtgggctgctaatgctcgtgggtcccaggatccaggtggggatgttgtggtgactcagtctccactctccctcgcccgtcctaccctggacgacgccgcctaccactcctcctgcgtaggtcctggtacaaacgccgttcggtcggtacggtagagtacggaaactacctactagtaagttacggtatacgagacgaggacggccacggtacctatccgtaccgaaggcctaaccgttaatacgttaacgttaacggtttaccgaaacgggaccgtcggtacgggtaccccaagtaacgtacgtagttccgaggtccgactacggtcgggtacacggtacgtacgttagtactttaccacgtacgtggaaacgttaagtccggtagggtaggggtaggacgtcgtagggtaaggtcgtttaggggtttacggtttattttacgtcgtaggtactagtacgactaaccgtacgtaaccggaccgttacggttcgggttacccttaccgttacgggtttccggaaccgggtaagaccggtagtcgtaggaactaacgaaacccgaacgttacggtacggtccggtacacctaccctcgtagttaccg

SEQ ID NO: 236500 - DNA, 904 bp, Homo sapiens
  misc_feature: GYAE6OF01C4T78.3.35.D02.1.454.CMB.1.raw
tcagagacgcactccacgaccggtgctcgatttagcacacgatagttgggtttgggccgagctgggttttcctggtttgttattttacaaggtgtccagtgtgaggtgcgagctggtgcagtcgtgggggagcttggtccagcctgggacggtcctgagactctccgtgtgtcggtctcgtgattccaccgttcgacgggacctacttcgagtcgggtaccgttccggggtcccgacccggacggtcccgttaacccgggaagggggtaaacggggcggttacggggtagggtttacgggggttcgggaaccgtttaaaggaaaacggtaaaaccgaaaggtaccgtaaaagtaaccggttaaccaaccgtaacgtaacggtacgttaccggccggtcgtacgtcgtacggacgtacgacgtacgtaccgttaaccacctactaccgtaacgtaagtagtagtacgtaacgtacgaacgactaccgtacgtacgttcgtactacgtacgtaaacgtaaacgtaaccgaacccgtaaccgaacggaaccggtaaccgggtaaccggtaccggtaaccggttaccgtttaacgttaccggtaccgtaccggtaaccgtaccgttaacgttaacgttacgttaacgtaacgttacggtacggtacgtaaccgttaaccggttacggtacccgggtacgggaaccgtacggtacggtaccggttaccgtacccgtaccgtacccgtaccgtacccgtacccgtaacccgtaccccggaaccggtaacccggttcccgtacccgttccccggttccccgttcccggtaccgtacccgttccccggtaccgtcccggtacccggtaccggtacccgacccggtaccggtaccggaccggtaccgtaccgg

SEQ ID NO: 236501 - DNA, 674 bp, Homo sapiens
  misc_feature: GYAE6OF01CCNWB.3.35.D02.1.454.CMB.1.raw
  modified_base (159)..(159): a, c, t, g, unknown or other
  misc_feature (159)..(159): n is a, c, g, or t
  modified_base (163)..(163): a, c, t, g, unknown or other
  misc_feature (163)..(163): n is a, c, g, or t
  modified_base (215)..(215): a, c, t, g, unknown or other
  misc_feature (215)..(215): n is a, c, g, or t
  modified_base (235)..(235): a, c, t, g, unknown or other
  misc_feature (235)..(235): n is a, c, g, or t
  modified_base (274)..(274): a, c, t, g, unknown or other
  misc_feature (274)..(274): n is a, c, g, or t
  modified_base (567)..(567): a, c, t, g, unknown or other
  misc_feature (567)..(567): n is a, c, g, or t
tcagagacgcactccacgaccggtgctcgatttagcacacgataggttgggtttgggggatcaggactcctcagttcaccttctcacaatgaggcctccctgctcagctcgtgggctgctaatgctcgtcgggtccaggatccgaggtgggatggttgnggtnactcgacgtcctcctactccctccctacgccccgttaccaccgttggaaccncggcccgtcctccatcctcnggacgtacggtcgtaggacaacgccgtggtagtcggtanacgtaacggaactaccgttataggtagttaggactcgaacgcgacggacggccacggtacaaactccgtaccgaggtactacctaatacggttaacgttacggttacccgaacgggtccgtccgggttacgggaccagtaccgagttaacgtgacggtcgaccgtacgggtggacaaggtcctaattaggttacctacgtaacgtacgtaaggtaagtaaagttcggacgggtagggtaggaggttaccgtaggtagggttagttagggtacgtttagtttcttagacgttanacgtacgtacaacgtacgtactacgtacgtcgtacgtacgttcggtacgacggacgtatacgagcgtagaacgtaacgacgtaggcgtaggctacgctacgtcgtac

SEQ ID NO: 236502 - DNA, 928 bp, Homo sapiens
  misc_feature: GYAE6OF01A7S1X.3.35.D02.1.454.CMB.1.raw
  modified_base (164)..(164): a, c, t, g, unknown or other
  misc_feature (164)..(164): n is a, c, g, or t
tcagagacgcactccacgaccggtgctcgatttagcacacgatagttggggtttgggggatcaggactcctcagttcaccttctcacaatgaggctccctgctcagctcctggggctgctaatgctctgggtcccaggactccgaggtggggattgttgtggtnactcacgtctcctactcctcccctcggtcccgtcctacccgttggacacggcccggccctccactccgtacctgaccgtaggttcctgggttaccaaaccgtccgttcggttacggttacgggtacgtaacgtaacgggaaaaccctacccgtttaacgttaaggtaacgttttcggtaacgttacgaacggaccggaagggtaacggacccggaaccggaacctaaaccggttcccgttaaccggaaaacgggtaccccgtaaaccttaaaacgttacccgtttaaaacgggttttaaaaccgggtttttacccggaaaaccccgggggttccggtaccggggtttacccgggggaaccccaagggtaaacccgtacttacgggttaacgaccggggtaccggaccggtaacggtttcccggggacgtaacggtccgttaaaccgttacggtactttacccgaactaacgggttaactaaaggtaacgtttaacgggacgggttacggggtacgggggtaacgtacgggtaagggtaacgggttaacggttggggtttacgggttttaacgttttacggttttcgtaccgttaacgtaccgttacggtaaaccgtacggtaacccgttaaccggtaccgtacgggttaacccggttaccgttaaccggttcgtttacggacgggttaaccgggaccgtaacggtcggtaacggtacgaacgtacgaaacggtcgtaggtacgcgtaccgactcgtacgttccg

SEQ ID NO: 236503 - DNA, 766 bp, Homo sapiens
  misc_feature: GYAE6OF01A5BMO.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccaggtggggatgttggtggtgactcagtctccactctccctcgcccgtcaccgtggacacggcccgcctccatcctcctcgcgtaggtcgtacggtacaaacgcctcggttagtacggtgagtacggaaacctaccttacgttagtaagttggtactacagcgtaggacggaccgaagacctaacgtcctaaccggacggtaccggtaccttaacttacgttaagttaacgggtttacccgtaaaccggggaccgtcggtacggggtacccaaggacgtagtacgttcgacggcgtaccggtacgtcgggtacgacggactacgtagttaccttcctaacgtacgtaaggtaacgttaacggttaacgggtacgggtaaggggtacgggtaacgggtacggtaacgggtaagggttaggtttagggtttagggtttaacttttaggtttacgtagttactagtacgtaacgtaagtaaccttaacgaccgttacgtcggtaccgttaacgttaccgtttacgggaccggtaacggggtaaccgtaggtacggtacggtaagtaacgtaaaccggaaacgtacggttacggtacggtactaccggtaaccctaccgttagttacccg

SEQ ID NO: 236504 - DNA, 797 bp, Homo sapiens
  misc_feature: GYAE6OF01ANMC2.3.35.D02.1.454.CMB.1.raw
  modified_base (331)..(331): a, c, t, g, unknown or other
  misc_feature (331)..(331): n is a, c, g, or t
  modified_base (344)..(344): a, c, t, g, unknown or other
  misc_feature (344)..(344): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctggggggaggcttggtccagcctgggagggtccctgagactctcctgtgtggtctctggattcaccttcagggaccacttcatggactgggtccgccaggctccgaggggaaggggctgggagtgggttcgcgtataagaacaaagctagaagttacacacagtattacgccgcgtctgtgacaggcagtattaccaccatctacaaagngtatgattcgaanccaactcaagtgtctacgtgacctaaatcgaaacctaacccgtaggtaaaccggaacccggaacggaaccgtaaacccggggtccccggttaacgttaaccgttttaaccgtacggtacccggtaccgttaaccgtaacggtaagtttaaccctaaagtttaacgtttacggggtaaccggtaaccgttaacccggtaaacgttaacccggttacgggggtaccccgtaaaccggggtacgtaaccccgggttcgggtacccctaaacccgggttcccttaccccgttccgaaccggttaccccctccccgaacccggtaaaccggggccccctacgttcccccgggttacccctttcccccccggtacgggtcccccggccccgttaccggtccccgttcccggaacgggtccgaccccgtacccgtaccccgggtaaggtacccggaccgg

SEQ ID NO: 236505 - DNA, 252 bp, Homo sapiens
  misc_feature: GYAE6OF01BN1BJ.3.35.D02.1.454.CMB.1.raw
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
  modified_base (235)..(235): a, c, t, g, unknown or other
  misc_feature (235)..(235): n is a, c, g, or t
  modified_base (247)..(252): a, c, t, g, unknown or other
  misc_feature (247)..(252): n is a, c, g, or t
tcagagacgcactccacgaccggtgctcgatttagcacacgatagttgggtttgggccgagctgggttttcctggttgttattttacaaggtgtccagtgtgaggtgcagctggtgcagtcgtgggggaggcttggccagcctggagggtccctgagactctccttgtgtcggtctctggtattcaccttcgagggacccacttnatcggctgggccncaggctcgagggagggntggagtgggtannnnnn

SEQ ID NO: 236506 - DNA, 817 bp, Homo sapiens
  misc_feature: GYAE6OF01BCNR0.3.35.D02.1.454.CMB.1.raw
tcagagacgcactccacgaccggtgctcgatttagcacacgataggttgggtttgggggatcaggactcctcagttcaccttctcacaatgaggctccctgctcagctccgtgggctgctaatgctcgtcgggtcccaggactcgaggtggggtattggttggtggtcgactcgtacgtcctaccacctcctcccgtcgcccgtacctacccgttcggaccacggccccggtccctacctacttcccgtccgtcgacgtacggttccgttacggtaacaaccggtccgttacggtacggtacggtacgtaacgtaacggaaaccttacgttacgttagtaaggttcgtacgtcgaacgcgaacggacgaccgacggtacctactaccgtaccgaagaccgtactaacttacgttaagtttaaccggtaacggaccggtacgtccggtaccggtaccgacgacgtagtacgtacgacggtcgtacggtacggtcggtacgaccggactttacggtaattacccgttaacgaaccgttacggaaacggttaagttaaacggtttaacgggacggggttaagggggtacgggtacgggttacgtaacgggggttaaggtttacggggttaaggggttttacgggttttaaactttttcggtttcgaaagtgtaacggtcctaagaaccgtacctacgaccggttacccggtcggttaacctttccgggttagtaccggacggtaacgggaacctgggtaacgagaacgtacgaaaccggtacggtagttacgtacggtaccacgttacctattccgtacg

SEQ ID NO: 236507 - DNA, 727 bp, Homo sapiens
  misc_feature: GYAE6OF01C5XXC.3.35.D02.1.454.CMB.1.raw
tcagagacgcactccacgaccggtgctcgatttagcacacgatagttgggtttgggggatcaggactccctcagttcaccttctcacaatgaggctccctgctcagctcctggggctgctaatgctctcgggtcccaggatccaggtgggggatggttgtgggtgactcagtctccactcctccctcgcccgtcctacccgttggacacgccgcctccacttcctctgcgaggtctggtacaacgtcctcgtgtacggtagacgtacggaaacctaccttagttacgtaagttggtactcgaagcgaggaccggaccacggaccaagtccgtaccgtaaggccgtaccttaacgtacgttaacgttaaggttttaccgaaccgggacgtcgtcgggtaccagacgagtcttcgacgcggactcgtcggtcgagtcacgtagtacttcaactacgtagaagtaactacggacggtagggtggacgtcgtaggtaaggtgtttgggtttaagggttacttttagtttcgtacgtacgtagttacggaactaaggtacctaacgtaccgtaaccggtccgggttaaccgttaccggtttacggttttaccggggaacccggtaacggggtaaccgtaagggttccggtaacggggtaaacgaacggtaaacccggaaaacggttacccggtaggttacggacttacgggaaccctaccgtcgtttacccg

SEQ ID NO: 236508 - DNA, 666 bp, Homo sapiens
  misc_feature: GYAE6OF01BY8MS.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgcctcgtgggtcccaggatccaggtggggatgttgtggtgactcagtctccactcctccctcgcccgtcacccgttggacacgcccggcctccatcctcgtgctaggtctgacaacgtccgtcgtgtacggtgactacggaaactacccttagtagtaagttggtactacgtacgacgaggacgaccgacgacctaactcctaccgaaggcctacctaatctaagttacgttaccgaacggcgtcggtcggaccagacgtagtactacgacggcgcgacgtcgggacgagacgtcgtagtacttaccgactacgtaggaagtactacggacggtagggtgacggtcgtaaggtacgggtagttgggtttaggttaacgttttacgtttcagtagtacgtacgtacgtaacgtacctacgaacccttacggtaccggtaccttacggtaccgtttacgggaccggtaacgggaaccgtagtccgggtaagacgtaacgtaaaccgaacggtacgttcggtacgtcgtacgacctacgtcgttacg

SEQ ID NO: 236509 - DNA, 864 bp, Homo sapiens
  misc_feature: GYAE6OF01D2N1S.3.35.D02.1.454.CMB.1.raw
  modified_base (855)..(855): a, c, t, g, unknown or other
  misc_feature (855)..(855): n is a, c, g, or t
tcagagacgcactccacgaccggtgctcgatttagcacacgatagttgggtttgggccgagctgggttttcctggttgttattttacaaggtgtccagtgtgaggtgcagctggtgcagtcgtggggggaggcttggtccaggcctggacgggtccctgagactctccgtgtgtggtctctggattcaccttcgagggacctacgtttcagtcgggacgtcgggtcccgaccgaggcctccggaagggggaagggggtccgtggggaggttcgggggttcggacccgttaagtaaaacggaaaaacaaaggtacctaaggaaaacggtttaaccgaacccaacgaacgtaacgttaaccggcccggtaccgttaccgttcggttaggaacgacggggtacctaaggtaactttacccgaaacccgtaacttacccgttaaccgaaaagggtacggttaaagttacggtaacttttaaccgaaaacggtaaccctaaactaccgtaggttacgtccgtttacgtacggtaaacctaaaagtaaccggtaaaacccgtaaccccgttaacggaaaaaccggaccgggtaaaccgggtaacccgaaccggggttacccgttacgtttaacgtttaaccgtaccggtaccgtacgttaacgtaacgtacgtttactaagttagttacggtaacgtaccgtaaccggtacgtaaccggtcgggacccggaacggtacggtaccgtacggtaccgtacccgtccgtacctcgaccgtcctaccgaccgaccggacctccgtccgtcccgttccccgtcgtcccgcccggtcgcccgcgtacggccacccgtaccgtaccgnggtcgaccg

SEQ ID NO: 236510 - DNA, 840 bp, Homo sapiens
  misc_feature: GYAE6OF01ARWSL.3.35.D02.1.454.CMB.1.raw
tcagagacgcactccacgaccggtgctcgatttagcacacgatagttgggtttgggggatcaggactcctcagttcaccttctcacaatgaggctccctgctcagctccgtggggctgctaatgctctgggtcccaggactccaggtgggatgttgtggtcgactcgagtcctcctactcctccctcgcccgtcacccgttggaccacgcccggcctccatcctcctgacgtacggtcgtcggacaaacgtccgtcggttcggtacggtgacgtacggaaaacctaccttacgttacgtaacgttaggtacttcgacgacgaaggacggccgacggacctaacgtccgaccgaacggccgtaaccttaacgttacgtaaacgtttaacggtttacccggaaccgggacgtaccggtcgggtaccaagacgacgtactacgaggtccggacgtacggtacggtacgacggtacgtacgttacgttacgtttaccacgtaccgtaggtaacgttaacgttacggtacgggaagggggttcgggaacggttagggttaggaaacggggtttagggtttacggggtttagggtttttaaacgttttacggttttaccgtaaggttacgtacgttaacggaacgttaaccgtaccttaaaccggaccgttaccggtaccggggtttaaccctttaaccggtttaacccgggttacgggaaacccgggttaacgggacccgtaaagggttccggtaaacgggtaagtaaacccgtaaccggttaaaaccgggttaaaccgttgggtaccggtaaccttaccggaacccgtacgttaacgttaccgg

SEQ ID NO: 236511 - DNA, 843 bp, Homo sapiens
  misc_feature: GYAE6OF01AZ2JJ.3.35.D02.1.454.CMB.1.raw
tcagagacgcactccacgaccggtgctcgatttagcacacgatagttgggtttgggggatcaggactcctcagttcaccttctcacaatgaggctccctgctcagctccgtggggctgactaatgctcgtcgggtcccgaggtactccgaggttggggtagttggtttggtgggtgtacctactacgttcctcctaccttcccttcccgtccgcccgtccgtacccgttggaccgacggcccgtcctcctattcctccgtcgcgacggttcgtaggtacgaaacgtccgttcggtggtacggtagtacgtaacggaaacctaccttaacgttagtaagttacggttactacgacgtaacgacggtacggaccgacggaactaaccgtaccgtaaccggaacggtaccgtaacctttaacgtaaccgttaaacgtttaaccgggtttaaacccggtaaccgggtaaccggtaccgggttaccgggaccgtaacgtaacgtaacgtacgttacggacggtaccggacgtacggtcggaccgtacggtacctagtacgtacgtttaaccgacgttaacgtaacgtaaggttaacgttaacgggttaacggggtaaggggtacgggagggtacgggttaagggtaagttaacgggttttagggttaacggttttagtttacgtttagtaacgtggttacgtaactaaccgtagtaacctacgtaaccgtacggtaccgttaccgtacgttaccggttaaccgaccgggacggtaacgacgtacgggtagtaacggaacgtaaacgacggaacgttagggtacgtcgaaccctcgtaccgtcgttacg

SEQ ID NO: 236512 - DNA, 689 bp, Homo sapiens
  misc_feature: GYAE6OF01AWLPR.3.35.D02.1.454.CMB.1.raw
  modified_base (636)..(636): a, c, t, g, unknown or other
  misc_feature (636)..(636): n is a, c, g, or t
tcagagacgcactccacgaccggtgctcgatttagcacacgatagttgggtttgggggatcaggactcctcagttcaccttctcacaatgaggctccctgctcagctcctgggctgctaatgctcgtgggtcccaggatccgagtgggatgttgtggtgactcagtctccactctccctcgcccgtcctaccttggactacgccggtcctccactcctccgtcgacaggtcgtcgtacaaacgtccgtcgtaggtacggtgagtacgaacaccgtactagtaattcggtatcgtagacgagacgaccgacggacaatacctaccgaacgcgtaaccttataccgttaagttaacggtttaaccgtaaccgggcgtacggttacgggtacccgaagtacgtacgtacgtacgacggccggacgtacggtcggtacgaacggtacacgttacggttaacttccgaacgtagtaacgtaagttaacgtaggtacgtagggtacggtaacggtacgtaagggtacggtaacggtttgggttaacggtttaacgttttagtttacgtcgtagtctagtacgaatccggtaactacgtacctcggtaccttacgttacgttacggacgtacgggaccaaggngtacgagaagtaaccgaacgacgttacgggtactacgcgtaacctgtacttcg

SEQ ID NO: 236513 - DNA, 769 bp, Homo sapiens
  misc_feature: GYAE6OF01CKOTO.3.35.D02.1.454.CMB.1.raw
  modified_base (563)..(563): a, c, t, g, unknown or other
  misc_feature (563)..(563): n is a, c, g, or t
  modified_base (601)..(601): a, c, t, g, unknown or other
  misc_feature (601)..(601): n is a, c, g, or t
tcagagacgcactccacgaccggtgctcgatttagcacacgatagttgggtttgggggatcaggactcctcagttcaccttctcacaatgaggctccctgctcagctccgtggggctgctaatgctcgtcgggtcccaggatccgaggtggggtattggttgtggtacgactcgacgttcctcctacctccctcccgtccgtaccccgtcctacccgttcgggaccgaccggccccggccctcctaccttcctccgtagaccgtacggttcgtacggtaacgaacgtccgttacggttcggtacggtagacgtaagaacctaccgttacgttgtaagttcgtatacgaggtacgaggacggacgacggtacctagtaccgaacgacggccgtactaaacgtcgtttaaacgttacgggttaccgtacgggtaccgtcggttaccgggtaccacgtaacgaggtcgtaccggacgtcccgggacgtaccgtggtacgacggtacacgttacgtagttaccaacgtacgtaaagagttaaggttacggaacggtaggggtaaggnggtaacggtaggtaggttaggtttcgggttaaggtttnttttaccgtcgtagtagacgtacgaacgtacgtacctaaccgcgtaccggtacggtacccttacgggttacgttccggggaaccgtacgggaaacctaggtcggtaaaggtcaaaccggttaacggaaccggttgtacgtacggtaccctagacccttagccttacgg

SEQ ID NO: 236514 - DNA, 867 bp, Homo sapiens
  misc_feature: GYAE6OF01B7I1F.3.35.D02.1.454.CMB.1.raw
  modified_base (162)..(162): a, c, t, g, unknown or other
  misc_feature (162)..(162): n is a, c, g, or t
  modified_base (166)..(166): a, c, t, g, unknown or other
  misc_feature (166)..(166): n is a, c, g, or t
tcagagacgcactccacgaccggtgctcgatttagcacacgatagttgggtttgggggatcaggactcctcagttcaccttctcacaatgaggctccctgctcagctcgtgggctgactaatgctcgtcgggtcccaggactccgaggtggggattgttggnggtnactcagtctaccactccgtccctcgcccgtacaccgtaggacacgccggaccctcactcctcgtcgcgtaggtccgtaggtacaacgtcccgttaggtcggtacggtagtagtaacggaaaccctacttacgttagtagttcggtatcgagtccgaggacggaccgacggtacctaacttaccggacccgtaaggacccttaaccgttaaagttaccgttttaaccggtttaaaccggggttttaacccggaaaccggggtaccggttaccgggttacccggggtaacccctaagaacccgtaaggttcgttaccggacggtaccgtaccggtcggttaacggggaccgtaagggtcctacggttaaacgtttccgtaacctaacggtaacgtaaggtaacggtaacgtaggggaccggtaggggtacgggtaggtacggttagggtaaggttacggttgggtttaaggtttcgttttacgtcgtacgggacttcggtaactaacggacgttaccgtaaccgtaccggttaaccggtaccgtttaacccggttacggtttaaccggtccgggggaaacccggtaccgggttaaaccgaccgtttaggaaccggtttaagaaaccccgtaaggggtttaaacctcgggtttaggaaccccgggttcgtaacccgtaccggtttaactccggtttttaacccg

SEQ ID NO: 236515 - DNA, 803 bp, Homo sapiens
  misc_feature: GYAE6OF01B0QJA.3.35.D02.1.454.CMB.1.raw
  modified_base (237)..(237): a, c, t, g, unknown or other
  misc_feature (237)..(237): n is a, c, g, or t
tcagagacgcactccacgaccggtgctcgatttagcacacgatagttgggtttgggggatcaggactcctcagttcaccttctcacaatgagctccctgctcagctccgtgggctgactaatgctcgtcgggtccaggactccgaggtggggtattggttggttcggtcgacctctacgtcctacctcctcctcccgtcgccccgtcctaccgtcggaccacggccccgtacctccnctcctccgtgcgtacggtcgttcggtaaccaacgtccgttcggttacggttaaggcgtaacgtaaccggaaacccttacgttaacgttaggtaagttggtactacgaggtacgacggaccggaccgaaccggtacctaaccgttccgaaccggacggtcccctaaacttaacgtttacgttaaacggtttaaccggttaccgggtaaacgggtccgttccggttacccgggacctaacggaactacggtacttcggaacggcgtaaccggtggtacggacgacggtactagttcgttaacttcaaacgtacggtaagtaaggttacgtacggtagggtacgggtaggacggtagacgggtaagggttggtttaagggttttagtttaaacgttttcgtacgtacgtcgtaagtaccgtacgtaacgttacaaccgtacgtaccgtcccggttacgttaccggtaccgttaaccgggaccggtaacgaccggtagtaccggtaacggaacgtacgtaaacccggtaggttaccggtggtacgtcctaaccgccttacgtagttcccg

SEQ ID NO: 236516 - DNA, 887 bp, Homo sapiens
  misc_feature: GYAE6OF01BJZOK.3.35.D02.1.454.CMB.1.raw
  modified_base (215)..(215): a, c, t, g, unknown or other
  misc_feature (215)..(215): n is a, c, g, or t
  modified_base (234)..(234): a, c, t, g, unknown or other
  misc_feature (234)..(234): n is a, c, g, or t
tcagagacgcactccacgaccggtgctcgatttagcacacgatagttgggtttgggggatcaggactcctcagttcaccttctcacaatgaggctccctgctcagctccgtggggctgctaatgcctcgtcgggtcccaggactccgaggtgggattgttggtgtgacgtcacgtcctccacttcctcccgtcgcccgtcctacccgttggaccncgcccgtcctccatcctcncgctacggttcgtacggtacaacgtcccgttaggtacggtacggtagaacgtacggtaaacctaccgtttacgttaaggttaacgtttaggtaactcgaacggacgaagggtaccggacccgacggtaacctaacgttaccctaaccggacggtacccgtaaccttaagttaccgttaacggttttaacgggttacccggtaaaccggggtcgtccgggttaccgggtaccaggtaacctagttaactcgtacgccggaccgtaggtccggtcgacgctaggttctaacgttaccacgtagttaacggacgttaagttaccgggaggtacgggggtagacggttgtaacggggtaaggttcgttttggggttaaacggtttttgttaaccgtttgtaccgtaagttaaggtcctaaccggtacggtaacctaacccgtacggtttaaacccggtcggttttaacccccgtaagggttttaccccgggttaccgggggaaaccccgggtaacggggtaaacccgttacggggtaccgtaacggggaaaaccgtttaaacccggtaaacgggtaaaaacccgtaccggggttttacggggaaaccccggttcccttaaacgggtacccctagtttttaacccccggggtttaccc

SEQ ID NO: 236517 - DNA, 909 bp, Homo sapiens
  misc_feature: GYAE6OF01E10RW.3.35.D02.1.454.CMB.1.raw
tcagagacgcactccacgaccggtgctcgatttagcacacgatagttgggtttggccgagcgtgggttttcctggtttgtttattttacaaggtgtccagtgtgaggtgcagcgtggtgcgagtcggtgggggagtcttcggtaccaggtccgtgggtaccgggtccctaggaacgtccttccgttccgttggttcggttcggttccgttcgtacggttaactttcccgtaacccgtttaccggaccgggtaaccccttaactttaccgtaacggttcgggtaaccggttccggggtaccccgccggaaccggtcccgtaaccggggtaaacgggggtaacgggggtccggtagggggttacggggtttcggggttacggaaccggttaaaagtaaaacgaaaacgtaacggtacgttaaacgtaaccgttaaccaaccgtaagtaacgtaccgttaccggccgtacgttcgttgaccgacgaggctaaggttaccttaccgacctacgttaccgaagaaacggtattacggttaactaacgttaaccgaaacgtacccgtaaccgtaacgtcggttaccttcgtacgtaacgtaactaaacgaacaacccgtacgaaaggaccgaacggacgtaccggtacgtcccttagtacgtacgtacgaccgtactacgtagtacttaacgtagtacggtagaacgtaaccgtaacgtcgtaccggtacggccgtaacggtaccgtacgtaccgttacccgtaccctcccgtaccgtaccgtacccgtaccgttaacccgacccggtcccgtaccgtcccgttcccgttaccccgttcccggacccggtcccgtcccgtcccgtccgtacccggaccgtaccgtaccccgtaccggaaccggtccacggacccg

SEQ ID NO: 236518 - DNA, 762 bp, Homo sapiens
  misc_feature: GYAE6OF01BKO50.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtcctccactcctccctcgcccgtctacccttggacacgccggcctccactcctcctgcaggtctgtacaaacgtccgtcgtgtacggtagagtacggaaacctaccttactagtaagttggtactcgacgacgacggacggaccgaggaccaacgtacctaccgaacggccgtaccgttaactacgttaacgttaacgggttttaccggtaacccgggtaacggtccggttacggggtacccctaacggacgtaacgtacgttaccgacggcggaccgtacggtcgggtacgacggtactacgtcgttacttccaactacgtagaacgtaagttacggcgggtaggggtcgggaggtacgtagggtaacgggttaagtttgggtttagggttaactttttacgtttcggtacgacgttagtacggtacgtaacggtacctaacccgtaccgttaccggttaccggtaacccggttaccgtttaccgggtttaccgggaccggtaaaccgggtacgaaccggtcggtaaggtaacgtaacgtaaacggaaaccgtacggtacggtacggtacgtaacgtacccgtaccgtgttcccgg

SEQ ID NO: 236519 - DNA, 756 bp, Homo sapiens
  misc_feature: GYAE6OF01E1PB0.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctcgtgggtcccaggactccgaggtgggggtattggttgtggtgactcagtcctccaccttcctccctcgcccgtcctacccgttggacacgccggccctccactctccgtcgcgaggttcgtggtacaaacgtccgtcggtggtacggtagagtaggaaacctaccttacgttagtaagttggtactcgagcgaggacggaccgaacggtacctaactccgtaccgaacggccgtaccttaattacgttaacgtttaacgggttaccggtaaacccggggtccgtcgggttacggggtacccaacgacgtacgtacgttacggacggcggtacctacgggtcggtacgacgtacgtacgtagtacttacgaacctacggtagtaagttaacgtacggacgggtaggggtggacggtagtagggaggttaggtttaggtttagggttacgttttagttacgtcggtaactagggtacgtacgtaacgtacctaacgtaccgtaacgggttccggttaaccctttacgtaccggtttcggaaccggacgggttaaaccacggttgaccgggtattaacgtaaaccggtaacgtacggttacggttacggccgttaacacgtaaccgtgttaccg

SEQ ID NO: 236520 - DNA, 979 bp, Homo sapiens
  misc_feature: GYAE6OF01E09GI.3.35.D02.1.454.CMB.1.raw
  modified_base (173)..(173): a, c, t, g, unknown or other
  misc_feature (173)..(173): n is a, c, g, or t
tcagagacgcactccacgaccggtgctcgatttagcacacgatagttgggtttgggggatcaggactcctcagttcaccttctcacaatgaggctccctgctcagctccgtggggctgctaatgctcgtcgggtcccaggactccgaggtgggggattgttggtggtagactntagtctccacttcctccctcgcccgtctacccgttggacacggcccggtccctaccacgttcccttccgtaggtccgtacgggttccgttacggttaaccgaaaacggtcccgttccggttacgggttaacgggtaggtaacgtaacggtaaaaccttacccttaacgttttagtaaaggtttggtaacgtacgtaacggacgaacgggaaccggtacccggaacgggtacccctaaacgttacccgtaacccggaaacgggtacccgtaaccgttaaacgttaaccgtttaaacggtttaaaccgggttttaaccccgggtaaaccgggggtaccggttaccggggtttaccgggggtaaccccctaacggaaccgtaacggttaacgttcccggaacggggtcccggtacggttacccgggtttaaccgggggtaccggtaccggtaaccgttaaccggttagtttaacccgttttaaccgaaaacggtttaaccggttaagggtaaaacggtttaaacgggtttaaccgggtaacgggggtaacgggggggtttacggggtaacggggttaaccgggtaggggttaaagggggtttaacgggtttaggggttttaaacgggttttagtttttacgttttaacggaccgttaacggtacggttacgacggtaacgtactaacggacgtacgtacgggtcttacgtacgggtttccggaacggtacggacgtacgtaggtacgtacgtaactaacggtaaaccggtagttacggttcggaccgtacgtaccttacgtcgtttacg

SEQ ID NO: 236521 - DNA, 947 bp, Homo sapiens
  misc_feature: GYAE6OF01B1N9Z.3.35.D02.1.454.CMB.1.raw
  modified_base (211)..(211): a, c, t, g, unknown or other
  misc_feature (211)..(211): n is a, c, g, or t
tcagagacgcactccacgaccggtgctcgatttagcacacgatagttgggtttgggggatcaggactccgttcagttcaccttcttcacaatgaggctccctgctcagctccgtgggctgctaagtgctcgtcggtcccaggagtccgagtgggatgttgtggtgactcacgtcctccacttcctccctcgacccgtcctacccgttgacncgcccggcctccacgtcctccgtcgacgtacggtcgtaggtacgaaacggtccgtcggtacgtacggtagtacgtacggaaaacctacccgttaacgttaggtaaagtttaggtaacgttacgacggtaccgtaaggaccgggcccgtaaacgggacctaaaccgttcccgtaacccggaaacgggtaccctaccttaaactaccgttaaaggtttaacccgggttttaaccggttaaaaccccgggtaacccggtaccggtttacccggggtaacccctaaacggaaaccgtaacggttaacgtttaccgaagggtacccgggtaacgtaaccggtttacggggtaccgaacgggtaccctaacggttaacgtaacgtttaccgaaccgtaacggtttaacggaagttaaaccgtttacgggtaaccggttaagggggttagggtaacgggtaccgggtaagggttaaacggggtaggtttaaggggtttagggtttaacgttttaacgtttttaccgtaagggttacccgtagtaacggttaaccgtaagggtacccttaacggaacccggttacccgtaccgggtaccgttaacccggttacggtttaccggggacccgttaaaccggggaacccttaaccgggtacggtacggtaaggtaacccttaaccgggaaacccggttaacggtggttacccggtaccgtaaccgtaccctaccggtccgttaccgg

SEQ ID NO: 236522 - DNA, 745 bp, Homo sapiens
  misc_feature: GYAE6OF01AB4Y5.3.35.D02.1.454.CMB.1.raw
  modified_base (710)..(710): a, c, t, g, unknown or other
  misc_feature (710)..(710): n is a, c, g, or t
  modified_base (734)..(734): a, c, t, g, unknown or other
  misc_feature (734)..(734): n is a, c, g, or t
tcagagacgcactccacgaccggtgctcgatttagcacacgatagttgggtttgggggatcaggactcctcagttcaccttctcacaatgaggctccctgctcagctctggggctgctaatgctcgtcgggtacccaggactccgaggtggggattggttgtggtacgactcacgtcctccacctcctccctcgcccgtctaccgttgacacgccggtcctcactcctcgtcgcgtgtcgtcgtacaacgtcctacggtcgtacggtagacgtacggtaaacctaccttagttagtaaagttcggtaatcgacgtacgaggacggcccgtaaggacctaagtcctaaccggaacggaccgtaccttagtaccgtttaacggtaaccggttttaccgggacccgggtactccgggtaccggtaccaggactaggtactacgaccgcggaaccgtcgggtacgacgacgtcgacgttggttactcgtaacgtgaacgtaagttacgaggcgtaggggtcgtaagtcgtaggaggtttagtacgggtttagtttaagttacctgggcgtaaaccgtaggtagaacgtccctagaacccgcgttaaccgtaccgggtcctaacgggttttcggtaaccggacccgggaggtaaacccgtacggttaccgtaagggtaccctaacggtaaacgacccggttaagtcccggtaacncccggtaacccgcttaaacggttnttaaccccggg

SEQ ID NO: 236523 - DNA, 161 bp, Homo sapiens
  misc_feature: GYAE6OF02GXLNK.3.35.D02.1.454.CMB.1.raw
  modified_base (160)..(161): a, c, t, g, unknown or other
  misc_feature (160)..(161): n is a, c, g, or t
tcagagacgcactccacgaccggtgctcgatttagcacacgatagttgggtttgggctgaccaaggtcaccgtcctaggtcagcccaaggccaaccccactgtcactctgttcccaccctcctcgagtgcgtctctgagcgggctggcaaggcgcatagnn

SEQ ID NO: 236524 - DNA, 162 bp, Homo sapiens
  misc_feature: GYAE6OF02IEEW0.3.35.D02.1.454.CMB.1.raw
  modified_base (155)..(162): a, c, t, g, unknown or other
  misc_feature (155)..(162): n is a, c, g, or t
tcagagacgcactccacgaccggtgctcgatttagcacacgatagttgggttggctgaccaaggtcaccgtcctaggtcagccaaggccaacccactgtcactctgttcccgcctcctcgagtgcgtctctgagcgggctggcaaggcgcatagnnnnnnnn

SEQ ID NO: 236525 - DNA, 508 bp, Homo sapiens
  misc_feature: GYAE6OF02GEW6A.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtccccagacagattcagcggcactgggtcaggcactgatttcacactgagaattagcagggtggagggctgaggatgttgggatttatttctgcatgcaagctacacactggccgtacacttttggccaggggaccaagcgtggagatcaaacgactgtggctggcaccatccg

SEQ ID NO: 236526 - DNA, 498 bp, Homo sapiens
  misc_feature: GYAE6OF02FOE9F.3.35.D02.1.454.CMB.1.raw
tcagagacgcactccacgaccggtgctcgatttagcacacgatagttgggtttggggatcaggactcctcagttcaccttctcacaatgaggctccctgctcagctcctgggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttggatttatttctgcatgcaagctacacactggccgtacactttggccagggaccaagctggagatcaaacgaactgtggctgcaccatc

SEQ ID NO: 236527 - DNA, 504 bp, Homo sapiens
  misc_feature: GYAE6OF02F3LQ7.3.35.D02.1.454.CMB.1.raw
tcagagacgcactccacgaccggtgctcgatttagcacacgatagttgggtttggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggatttatttctgcatgcaagctacacactggccgtactactttggccagggaccaagcgtggagatcaaacgaactgtaggctgcaccatcg

SEQ ID NO: 236528 - DNA, 161 bp, Homo sapiens; identical to SEQ ID NO: 236523
  misc_feature: GYAE6OF02I6YQC.3.35.D02.1.454.CMB.1.raw
  modified_base (160)..(161): a, c, t, g, unknown or other
  misc_feature (160)..(161): n is a, c, g, or t

SEQ ID NO: 236529 - DNA, 160 bp, Homo sapiens; identical to SEQ ID NO: 236270
  misc_feature: GYAE6OF02GNAJ1.3.35.D02.1.454.CMB.1.raw
  modified_base (160)..(160): a, c, t, g, unknown or other
  misc_feature (160)..(160): n is a, c, g, or t

SEQ ID NO: 236530 - DNA, 505 bp, Homo sapiens
  misc_feature: GYAE6OF02HX3M2.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggatttatttctgcatgcaagctacacactggccgtacacttttggccaggggaccaagctggagatcaaacgaactgtcggctgcaccatcg

SEQ ID NO: 236531 - DNA, 508 bp, Homo sapiens
  misc_feature: GYAE6OF02GYMC8.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggatttatttctgcatgcaaggctacacactggccgtacactttggccaggggaccaagcgtggagatacaaacgaactgtggctgcaccattacg

SEQ ID NO: 236532 - DNA, 199 bp, Homo sapiens
  misc_feature: GYAE6OF02GT1RD.3.35.D02.1.454.CMB.1.raw
  modified_base (162)..(199): a, c, t, g, unknown or other
  misc_feature (162)..(199): n is a, c, g, or t
tcagagacgcactccacgaccggtgctcgatttagcacacgatagttgggtttgggctgaccaaggtcaccgtcctaggtcagcccaaggccaaccccactgtcactctgttcccgccctcctcgagtcgcgtctctgagcgggctgggcaaggcgcatagnnnnnnnnnnnnnnnnnnnnnnnnnnnnnnnnnnnnnn

SEQ ID NO: 236533 - DNA, 502 bp, Homo sapiens
  misc_feature: GYAE6OF02GT53F.3.35.D02.1.454.CMB.1.raw
  modified_base (476)..(476): a, c, t, g, unknown or other
  misc_feature (476)..(476): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggatttatttctgcatgcaagctacacactggccgtacacttttggcagggaccaagcgtgganatcaaacgactgtggctgcaccatcg

SEQ ID NO: 236534 - DNA, 161 bp, Homo sapiens; identical to SEQ ID NO: 236258
  misc_feature: GYAE6OF02GXXWM.3.35.D02.1.454.CMB.1.raw
  modified_base (160)..(161): a, c, t, g, unknown or other
  misc_feature (160)..(161): n is a, c, g, or t

SEQ ID NO: 236535 - DNA, 501 bp, Homo sapiens
  misc_feature: GYAE6OF02IN0O0.3.35.D02.1.454.CMB.1.raw
tcagagacgcactccacgaccggtgctcgatttagcacacgatagttgggtttggggatcaggactcctcagttcaccttctcacaatgaggctccctgctcagctcctgggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggatttatttctgcatgcaagctacacactggccgtacactttggccagggaccaagctggagatcaacgaactgtggttgcaccatctcg

SEQ ID NO: 236536 - DNA, 509 bp, Homo sapiens
  misc_feature: GYAE6OF02JAPLU.3.35.D02.1.454.CMB.1.raw
  modified_base (430)..(430): a, c, t, g, unknown or other
  misc_feature (430)..(430): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatggttgggatttattctgcatgnaagctacacactggccgtactacttttggaccaggggaccaagcgtggagatcaaacgactgtcggctgcaccattccg

SEQ ID NO: 236537 - DNA, 508 bp, Homo sapiens
  misc_feature: GYAE6OF02F8YLB.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactggtcaggcactgatttcacactgagaattagcagggtggaggctgaggatgttgggatttatttctgctatgcaagctacacacgtgccgtacacttttggccaggggaccaaggctggagatacaaacgaactgtggcgtgcaccatccg

SEQ ID NO: 236538 - DNA, 174 bp, Homo sapiens
  misc_feature: GYAE6OF02HEQRL.3.35.D02.1.454.CMB.1.raw
  modified_base (161)..(174): a, c, t, g, unknown or other
  misc_feature (161)..(174): n is a, c, g, or t
tcagagacgcactccacgaccggtgctcgatttagcacacgatagttgggtttgggctgaccaaggtcaccgtcctaggtcgagcccaaggccaaccccactgtcactctgttcccaccctcctcgagtgcgtctctgagcgggctggcaaggcgcatagnnnnnnnnnnnnnn

SEQ ID NO: 236539 - DNA, 161 bp, Homo sapiens; identical to SEQ ID NO: 236258
  misc_feature: GYAE6OF02GUB0Z.3.35.D02.1.454.CMB.1.raw
  modified_base (160)..(161): a, c, t, g, unknown or other
  misc_feature (160)..(161): n is a, c, g, or t

SEQ ID NO: 236540 - DNA, 503 bp, Homo sapiens
  misc_feature: GYAE6OF02GJAEK.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagctggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcagggcactgatttcacactgagaattagcagggtggaggctgaggatgttgggatttatttctgcatgcaagctacacactggccgtacacttttggccaggggaccaagctggagatcaaacgaactgtggctgcactac

SEQ ID NO: 236541 - DNA, 536 bp, Homo sapiens
  misc_feature: GYAE6OF02G5GSU.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgtatttcacactgagaattagcagggtgaggctaggaggatggttgggattttatttcgtgctatgcaagctacacacgtgccgtactacgtttggaccgtaggggacccaaggtccgtaggaacgtatacgaaacgtactaggtggaccgttgacctaccgattccg

SEQ ID NO: 236542 - DNA, 165 bp, Homo sapiens
  misc_feature: GYAE6OF02FQGU2.3.35.D02.1.454.CMB.1.raw
  modified_base (160)..(165): a, c, t, g, unknown or other
  misc_feature (160)..(165): n is a, c, g, or t
tcagagacgcactccacgaccggtgctcgatttagcacacgatagttgggtttgggctgaccaaggtcaccgtcctaggtcagcccaaggccaaccccactgtcactctgttcccaccctcctcgagtgcgtctctgagcgggctggcaaggcgcatagnnnnnn

SEQ ID NO: 236543 - DNA, 508 bp, Homo sapiens
  misc_feature: GYAE6OF02JUFI9.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgataattagcagggtggaggctgaggagtgttgggatttagtttctgctatgcaagctacacacgtgccgtacacttttggccagggaccaagctggagatcgaacgactgtaggctgctaccattccg

SEQ ID NO: 236544 - DNA, 501 bp, Homo sapiens
  misc_feature: GYAE6OF02HF3IJ.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccggacgctggggtcccagacagattcagcggcactgggtcaggcactgatttcacactgagaattagcagggtggaggctgagatgttggatttattctgcatgcaagctacacactggccgttactactttggccaggggaccaagtcgtggagatacaaacgacgtgtgctgcacatc

SEQ ID NO: 236545 - DNA, 503 bp, Homo sapiens
  misc_feature: GYAE6OF02FI94K.3.35.D02.1.454.CMB.1.raw
  modified_base (476)..(476): a, c, t, g, unknown or other
  misc_feature (476)..(476): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaagcgcctaatctataaggtttctaaccgggacgctggggtcccagacagattcagcggcactgggtcaggcactgatttcacactgagaattagcagggtggaggctgaggatgttgggatttatttctgcatgcaagctacacactggccgtacacttttggccaggggaccaagctgganatcaaacgaactgtggctgcaccatcg

SEQ ID NO: 236546 - DNA, 161 bp, Homo sapiens; identical to SEQ ID NO: 236523
  misc_feature: GYAE6OF02GJ2MK.3.35.D02.1.454.CMB.1.raw
  modified_base (160)..(161): a, c, t, g, unknown or other
  misc_feature (160)..(161): n is a, c, g, or t

SEQ ID NO: 236547 - DNA, 509 bp, Homo sapiens
  misc_feature: GYAE6OF02ITY1I.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggttttctaaccgggacgctggggtcccagacagattcagcggcactgggtcaggcactgatttcacactgagaattagcagggtggaggcgtgaggatgttgggtatttatttctgcatgcaagctacacactggccgtacacttttggccgagggaccaagcgtggagatacaacgaactagtggctggcacatcg

SEQ ID NO: 236548 - DNA, 509 bp, Homo sapiens
  misc_feature: GYAE6OF02F7RTO.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggtatttatttctgcatgcaagctacacactggccgtacacgttttgccgagggaccaagcgtggagacgtacaacgaacgtgtggctgcaccatcg

SEQ ID NO: 236549 - DNA, 568 bp, Homo sapiens
  misc_feature: GYAE6OF02G7Y54.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctaccaaggcgcctaatctataaggtttctaaccgggacgctcgggtcccagacagattcagcggcacgtggtcaggcactgatttcactactgagtaattagcgagggtaggaggcgtaggaggagttggttagggttagttttagtttcgttgcgtatgacaagactacgaacacgtcggaccgttacgtacgttttcggaccgtacggggacccaaggtctagggtacgaagtacgaaacgtaacgtacggtcggtacgtcgactacctattaccg

SEQ ID NO: 236550 - DNA, 161 bp, Homo sapiens; identical to SEQ ID NO: 236258
  misc_feature: GYAE6OF02HU4KD.3.35.D02.1.454.CMB.1.raw
  modified_base (160)..(161): a, c, t, g, unknown or other
  misc_feature (160)..(161): n is a, c, g, or t

SEQ ID NO: 236551 - DNA, 510 bp, Homo sapiens
  misc_feature: GYAE6OF02HR66T.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggcgtgaggatgttgggatttatttcttgcatgcaagctacacactggccgtacacttttggccagggaccaaggcgtggagatacaaacgaactagtggctgacaccatcg

SEQ ID NO: 236552 - DNA, 746 bp, Homo sapiens
  misc_feature: GYAE6OF02J3D2Z.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctggtcccaggatccagtggggatgttgtggtgactcagtctccactctccctgcccgtcacccttggaccacgccggcctccatcctcctgcaggtctcggtcaaacgcctcgtgtacggtgatacggaactacctacttgaattggtatcagcagacggccacggacctaactcctaccgaaggtccgtaccttaagtaccttaacgttaacggtttaccgtaacccgggtacggtaccgtacgggtaccccaagaccgagtacgttaccgacgccggacgtacgtcgggtacacggtcctaacgttaggtaactttaccgaaccgtacgtaggtaagtaacgtttacggacggaggggttacggaggtcgtaggtagggtagttcgggtttagggttaacttttacgtttccgtagtacgtacgtacggtaaccgaaacggttccttaaccgtaaccgttaccggttaccggtaacccgtttaacttaccggtttccgggaacccgaggggtaaccctaaggtccggttaaacggacgttaaaaccggtacccgtaaaaacgggtaccgttacgggtaccggtaccgtttaccggaacccgttacccgtagtttacccg

SEQ ID NO: 236553 - DNA, 510 bp, Homo sapiens
  misc_feature: GYAE6OF02HKEH8.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggcgtgaggatgttgggattttattctgcatgcaagctacacactggccgtactactttggccgagggaccaagcgtggagatacaaacgaactggtacggctgcacatccg

SEQ ID NO: 236554 - DNA, 512 bp, Homo sapiens
  misc_feature: GYAE6OF02JGH73.3.35.D02.1.454.CMB.1.raw
  modified_base (359)..(359): a, c, t, g, unknown or other
  misc_feature (359)..(359): n is a, c, g, or t
  modified_base (483)..(483): a, c, t, g, unknown or other
  misc_feature (483)..(483): n is a, c, g, or t
  modified_base (494)..(494): a, c, t, g, unknown or other
  misc_feature (494)..(494): n is a, c, g, or t
tcagagacgcactccacgaccggtgctcgatttagcacacgatagttgggtttgggccgagctgggttttcctggttgttatttacaaggtgtccagtgtgaggtgcagctggtgcagtctgggggaggcttggtccagcctggagggtccctgagactctcctgtgtggtctctggattcaccttcagggaccacttcatggactgggtccgccaggctccagggaaggggctggagtgggttggccgtataagaaacaaagctagaagttacaccacagattacgccgcgtctgtgacaggcagattcaccatctcaagagatgattcaagcaactcagtgtctctgcaaatgaacnccctgaagaccgagacacggccgtctattactgcgctacagattcatattggagctacgactactggggccaggagacctggtcaccgtctcctcagcctcaccaggccatcgtctcccgtgcnccctgcctccnggacgcacctcgagagcc

SEQ ID NO: 236555 - DNA, 508 bp, Homo sapiens
  misc_feature: GYAE6OF02I7M3E.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggatttatttctgtcatgcaagctacacactggccgtacacttttggccaggggaccaagcgtggagatcaaacgaactggtggctgcaccatccg

SEQ ID NO: 236556 - DNA, 505 bp, Homo sapiens
  misc_feature: GYAE6OF02G3G6L.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggatttagtttctgcatgcaagctacacactggccgtacacttttggccagggaccaagcgtggagatacaacgaactgtggctgcaccatcg

SEQ ID NO: 236557 - DNA, 501 bp, Homo sapiens
  misc_feature: GYAE6OF02HPDJH.3.35.D02.1.454.CMB.1.raw
tcagagacgcactccacgaccggtgctcgatttagcacacgatagttgggtttggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggatttatttctgcatgcaagctacacactggccgtacactttggccaggggaccaagctggagatcaaacgaactgtggctgcaccatc

SEQ ID NO: 236558 - DNA, 161 bp, Homo sapiens
  misc_feature: GYAE6OF02H3S7I.3.35.D02.1.454.CMB.1.raw
  modified_base (159)..(161): a, c, t, g, unknown or other
  misc_feature (159)..(161): n is a, c, g, or t
tcagagacgcactccacgaccggtgctcgatttagcacacgatagttgggtttgggctgaccaaggtcaccgtcctaggtcagcccaaggccaaccccactgtcactctgttcccgccctcctcgatgcgtctctgagcgggctggcaaggcgcatagnnn

SEQ ID NO: 236559 - DNA, 526 bp, Homo sapiens
  misc_feature: GYAE6OF02FW16G.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatggttgggtatttatttctgctatgcaagctacacacgtggccgtactacgttttggcccgtaaggggacccaaggccgtggagtactacgaaacgaactacgtggcttgcaccattcg

SEQ ID NO: 236560 - DNA, 505 bp, Homo sapiens
  misc_feature: GYAE6OF02GCBXG.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggatttatttctgcatgcaagctacacactggccgtacacttttggccaggggaccaaggcgtggagatcaacgaactgtggctgcaccatcg

SEQ ID NO: 236561 - DNA, 553 bp, Homo sapiens
  misc_feature: GYAE6OF02JOAOI.3.35.D02.1.454.CMB.1.raw
tcagagacgcactccacgaccggtgctcgatttagcacacgatagttgggtttgggggagtcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaaatctccaaggcgcctaagtctataaggtttctaaccgggacgctggggtcccagacagattcagcgcactgggtcaggcactgatttcacactgagaattagcagggtggaggctggaggatgttgggattttattcgtgcgtatgacaagctacacgacgtgaccgttaactacgtttcggccgtaaggggacctaaggtcgtcgggaagtacgtaaccgaaaccgtaacgtcggtacggacctggacctaccgacgttaccg

SEQ ID NO: 236562 - DNA, 564 bp, Homo sapiens
  misc_feature: GYAE6OF02HY2PR.3.35.D02.1.454.CMB.1.raw
  modified_base (245)..(245): a, c, t, g, unknown or other
  misc_feature (245)..(245): n is a, c, g, or t
tcagagacgcactccacgaccggtgctcgatttagcacacgatagttgggtttgggggatacaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtnatggaaacacctacttgaattggtatcagcagaggccaggccaatctccaaggcgctaatctataaggtttcaaccgggcgctggggtcccagacagattcagcggcactgggtcaggcactgactttcacactgagaattagacgagggtaggaggctaggaggagtggttaggtattttatttcgtgctagtgcgaagctaacacacgtcggaccgttactacgttttcggaccgaggggtacccaaggtaccgtgggaacgtaactaccgaaaacgtaacgttaggtcgggtactacggacctaccgtagttaccg

SEQ ID NO: 236563 - DNA, 544 bp, Homo sapiens
  misc_feature: GYAE6OF02IZZW7.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagtaatagcgaggggtggaggctggaggatggttgggtattttatttctgtctatgacaagctacactacgtcggccgttactacgtttcggccgaggggtacccaaggtcgtagggagtacgtacaaacgaacgttgtcggacgttggacctacgtattccg

SEQ ID NO: 236564 - DNA, 560 bp, Homo sapiens
  misc_feature: GYAE6OF02I3CJ9.3.35.D02.1.454.CMB.1.raw
  modified_base (315)..(315): a, c, t, g, unknown or other
  misc_feature (315)..(315): n is a, c, g, or t
  modified_base (406)..(406): a, c, t, g, unknown or other
  misc_feature (406)..(406): n is a, c, g, or t
tcagagacgcactccacgaccggtgctcgatttagcacacgatagttgggtttgggccgagcgtgggttttcctggttgttaattttacaaggtgttccagtgtgagtgcagctggtgcagtctgggggacggcttggtccagcctggagggtccctgagactctcctgtgtggtctctggattcaccttcagggaccacttcattggactgggtcccgccaggcctccagggaagggctggagtgggtggccgtataagaaacaaagctaagaagttacaccacagattacgccgcgtctgtgacaggcaggtntttcgaccatctcgaaagagatgattcaaagcaaactcagtgtctctcgctaaatgaaccaccctgaaacgaccgaggaccacggcccgtntaacttactcgcgactacagattcatattggagctacgactacgtgggccacggacgacctggtcaccgtctcctcacgcctccaccacggccagtccgttcctccccgtggcccgcccgtcgtcctccgacgacgccaccgtccgagcgaccg

SEQ ID NO: 236565 - DNA, 528 bp, Homo sapiens
  misc_feature: GYAE6OF02ILIT6.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaaatctcccaaggcgcctaaatctataaggtttctaaccgggacgctggggtcccagacagattcagcggcactgggtcaggcactgatttcacactgagaattagcgagggtggaggcgtgagggagtggttgggagttttatttcgttgcatgcaagctacacactggccgtacacttttcgggacaggggaccaaggcgtggagacgtacaaacgaacgtgtggcgtgctaccattccg

SEQ ID NO: 236566 - DNA, 539 bp, Homo sapiens
  misc_feature: GYAE6OF02HS4SR.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctcaaggcgcctaatctataaggtttctaaccgggacgcgtggggtcccaggacagattcagcggcactgggtcaggcactgatttcacactgagaattagcgagggtggaggctggaggagtgttgggattttattctgctatgcaagctacacacgtcgccgtactacgtttcggaccgtaggggacccaaggtcgtagggatagtaccgaaaacgaacgtggtacggctacggactaccgattaccg

SEQ ID NO: 236567 - DNA, 545 bp, Homo sapiens
  misc_feature: GYAE6OF02I1AWY.3.35.D02.1.454.CMB.1.raw
  modified_base (328)..(328): a, c, t, g, unknown or other
  misc_feature (328)..(328): n is a, c, g, or t
  modified_base (408)..(408): a, c, t, g, unknown or other
  misc_feature (408)..(408): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacncgtggggtcccagacagattcagcggcacgtgggtcaggcactgactttcacactgagaatagcagggtggagctgaggntggtggtatttagttntgnagtgcaagtctacactacgtcggtaccgtactacgttttcggaccgtagggaccgaagtcgtagggaacgtacgtaacgaaacgtaacgttggtcggtactcggacctaccattaccg

SEQ ID NO: 236568 - DNA, 505 bp, Homo sapiens
  misc_feature: GYAE6OF02GDJ4T.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtccccagacagattcagcggcactgggtcaggcactgatttcacactgagaattagcagggtggaggctgaggatgttgggatttatttctgtcatgcaagctacacactggccgtacactttggccagggaccaagcgtggagatacaacgaactgtggctgcaccatcg

SEQ ID NO: 236569 - DNA, 223 bp, Homo sapiens
  misc_feature: GYAE6OF02FKZ7U.3.35.D02.1.454.CMB.1.raw
  modified_base (170)..(223): a, c, t, g, unknown or other
  misc_feature (170)..(223): n is a, c, g, or t
tcagagacgcactccacgaccggtgctcgatttagcacacgatagttgggtttggggctgaccaaggtcaccgtcctacggtcagcccaaggccaaccccacctgtcactctgttccccaccctcctccgagtgccgtctctgacgcgggcttggcaagggcgacatagnnnnnnnnnnnnnnnnnnnnnnnnnnnnnnnnnnnnnnnnnnnnnnnnnnnnnn

SEQ ID NO: 236570 - DNA, 513 bp, Homo sapiens
  misc_feature: GYAE6OF02F0KJR.3.35.D02.1.454.CMB.1.raw
  modified_base (510)..(510): a, c, t, g, unknown or other
  misc_feature (510)..(510): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaaccgggacgctggggtcccagacagattcagcggcactgggtcaggcactgatttcacactgagaattagcagggtggaggctggaggagtggttgggtattttagtttctgcatgcaagctacacactggccgtactacgtttggccgaggggaccaagcgtggagatacaacgaactgtggctgcacntcg

SEQ ID NO: 236571 - DNA, 500 bp, Homo sapiens
  misc_feature: GYAE6OF02FV6E7.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggtatttagtttctgcatgcaagctacacactggccgtacactttgccagggaccaagctggagatacaacgaatgtggctgcacatcg

SEQ ID NO: 236572 - DNA, 599 bp, Homo sapiens
  misc_feature: GYAE6OF02I2OH9.3.35.D02.1.454.CMB.1.raw
  modified_base (295)..(295): a, c, t, g, unknown or other
  misc_feature (295)..(295): n is a, c, g, or t
  modified_base (336)..(336): a, c, t, g, unknown or other
  misc_feature (336)..(336): n is a, c, g, or t
  modified_base (370)..(370): a, c, t, g, unknown or other
  misc_feature (370)..(370): n is a, c, g, or t
  modified_base (411)..(411): a, c, t, g, unknown or other
  misc_feature (411)..(411): n is a, c, g, or t
  modified_base (440)..(440): a, c, t, g, unknown or other
  misc_feature (440)..(440): n is a, c, g, or t
tcagagacgcactccacgaccggtgctcgatttagcacacgatagttgggtttgggggtagtcaggactcctcagttcaccttcttcacaatgaggctccctgctcagctcctgggctgctaatgctctgggtcccaggatccagtggggatgttgtggtgactcagtctccactctccctgcccgtcacccttggcagccggcctccactctcctgcagtctggtcaaagcctcgtgtacggtgatggaaacacctattcgaattggtatctagcagaggccaggtaccaatcnccaaggccacctaatctagtaaggtttccgtaaccgggacncgtcgggtcccagacagattcagcggcactggcnggctactgtattcacactagagtaatagcgagggtggaggngtgaggagtggttaggttatttagtttcngtctagtgactaaggtcctaacactaacgtcgggtaacccgttacgttacgttttcgggtaccgaagggggtacccaaaggttccgtaagggaacgtaataacccggtaaaacggtaattacggggtacggtcgtttacggaccctaacctagttcccg

SEQ ID NO: 236573 - DNA, 581 bp, Homo sapiens
  misc_feature: GYAE6OF02JTNPL.3.35.D02.1.454.CMB.1.raw
  modified_base (257)..(257): a, c, t, g, unknown or other
  misc_feature (257)..(257): n is a, c, g, or t
  modified_base (304)..(304): a, c, t, g, unknown or other
  misc_feature (304)..(304): n is a, c, g, or t
  modified_base (321)..(321): a, c, t, g, unknown or other
  misc_feature (321)..(321): n is a, c, g, or t
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
tcagagacgcactccacgaccggtgctcgatttagcacacgatagttgggtttgggggtagtcaggactcctcagttcaccttctcacaatgaggctccctgctcagctcctgggctgctaatgctctgggtcccaggatccagtggggatgttgtggtgacgtcagtctccactctccctgcccgtcacccttggacagccggcctccactcctcctgcaggtctggtcaaagcctcgtgtacggtgatggaaacncctattgaattggtatcagcagagccagccaatcaccagcgcctaanctatagttcaacggacntcgggtccagacncggattcngcggcaacgtggcaggcaactgatttcacactgagaattagcgtagggtaggacggtcgtaggaacggtaggtacggttagggtactttaagtttcgtgtacgtagttagaccgtaagtacctacacgtcgtacggccgttaacgacgttttacgggccttaacggggcctaacggtacgtacggtaaggacttacgaaacgtacttaggtacggtcgtacgtcggaccagttacccgg

SEQ ID NO: 236574 - DNA, 545 bp, Homo sapiens
  misc_feature: GYAE6OF02G0BB7.3.35.D02.1.454.CMB.1.raw
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgtggtctctggattcaccttcagggaccacttcatggactgggtccgccaggctccagggaaggggctggagtgggttggccgtataagaaacaaagctagaagttacaccacagattacgccgcgtctgtgacaggcagattcaccatctcaagagatgattcaagcaactcagtgtctctgcaaatgaacaccctgaagaccgaggacacggccgtctattactgcgctacagattcatattggagctacgactacgtgggccacggagacctggtcaccgtctcctcacgccctccaccaacgggcccacgtccggtccttcccccgtcggcccgccctcgcctcccgacggacgccacccgtccggacgagacc

SEQ ID NO: 236575 - DNA, 508 bp, Homo sapiens
  misc_feature: GYAE6OF02FWLTF.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctggaggagtgttgggatttatttctgcatgcaagctacacactggccgtacacttttgccgtagggacaagcgtggagatacaacgaactgtggcgtgcaccatccg

SEQ ID NO: 236576 - DNA, 542 bp, Homo sapiens
  misc_feature: GYAE6OF02IH9YJ.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctgggtcccagacagattcagcggcactgggtcaggcactgatttcacactgagaattagcgagggtggaggcgtgagggatggttgggtagtttagtttcttgtctagtcgcgaagctacacactacggaccgtaccacgttttggaccgacgggaccgaaggcgtaggacgagtaccgtaaacgaacgtacgtcggactggccaccataccg

SEQ ID NO: 236577 - DNA, 610 bp, Homo sapiens
  misc_feature: GYAE6OF02G0SGD.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatcctcctgcggtcgtcgtcgaacacgtccgtggtacggtggataggaacgaacctaccttagtaagttaggttagtactagacgagacggaccgacggaccgaactacctaccgaacggacggcctaacttactacgttaaggtttaccggttaaccgggtaaccggcgtcggggtacccgaacgacgacgatactacgcggcgacgtacgggtcgacggacgactacgtattactacgactagagtaatagcgaggggtggaggcgtgaggagtggttagggtatttatttctgacatgtacaagtctacacacgtggtaccgttattacgttcggtacggacggacgtagcgtaggacgaataccgaacgtaacgtgtacggctcgtacaccgtatgtcg

SEQ ID NO: 236578 - DNA, 736 bp, Homo sapiens
  misc_feature: GYAE6OF02J2AEJ.3.35.D02.1.454.CMB.1.raw
tcagagacgcactccacgaccggtgctcgatttagcacacgatagttgggtttgggggagtcaggactcctcagttcaccttctcacaatgaggctccctgctcagctcctgggctgctaatgctctgggtcccaggatccagtggggatgttgtggtgactcagtctccactctccctgcccgtcacccttggaccagccggcctccatctcctgcaggtctggtcaaacgcctcgtgtacggtgatggaacacctacttgaattggtatcagcagaggtcaggcccaatccacgtaaggcgacctaatctaataaggtttacctaaccggggacgacgttcggggtaccctaaggactaacgatttacgacgcggcaacgtgggtacacggcaacgttgaacttttccgaactaccgtaggtaacgtaaacgttaaggtccgtaagggggtacggagggtaccgtacgggtaagggtacggttagggttaggggttaagtttttacgtttacgttcggtacgtaacggttgtaccgaaacgtccgttaaacctaaccgtacggttacgggtacccgttaaaccttaccggtttttaccgggaccgttaaccgggggaaccctaacgggtacccggttagggtaaacggacggtttaaacccgaaaaccggttaacggtttaccgggttacgggacccttaccgggtaaccctaacccgttacgtttaaccccgg

SEQ ID NO: 236579 - DNA, 566 bp, Homo sapiens
  misc_feature: GYAE6OF02ISF9R.3.35.D02.1.454.CMB.1.raw
  modified_base (415)..(415): a, c, t, g, unknown or other
  misc_feature (415)..(415): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgcagcctctgaattcaccttcagtaattatgctatgcactgggtccgccaggctccgggcaaggggccggagtggggtggcagttatatcttatgatggaaagagtgagtactacgcagactccgtgcagggccgattttatcatctccagagacagtctcaagaacaccctatatctgacaaatgaacagcctgacgacctgaggacacgggctctatattactgtgcgagagaggcgtcggacganagcgtgcgtgggtacttttgactacgtcggggaccacggggtaaccctgggtccaccgatcctcctcgacgccctccgaaccgaacgggacccacgttccggtcccgtttcccccgtcggcccctaccccgtccctacccgaacggtaccg

SEQ ID NO: 236580 - DNA, 617 bp, Homo sapiens
  misc_feature: GYAE6OF02HUMII.3.35.D02.1.454.CMB.1.raw
  modified_base (300)..(300): a, c, t, g, unknown or other
  misc_feature (300)..(300): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgtggtctctggattcaccttcagggaccacttcatggactgggtccgccaggctccgagggagggctggagtgggttggccgtataagaaacaaagctagaagttacaccacagattacgcgcgtctgtgacnggcagattcaccatctacaagagatgattcaagcaactcagtgtactctagacaaatcgaacctaccctagaaacgaccgaaggaccacgggcctactaagttactagcgactacgagtacttactattagtacggagactaacgtactacgtcgggaccacggacgaccgtcgtacctacccgtactcccgtacaccgtccctacccgaaccgaaccgggccctacgttccgggttacccgtttcccccgtcggcccgtccccgtccgtcccgtcccgacggtaccgccctaccccggtaccgtacggaccgaccg

SEQ ID NO: 236581 - DNA, 511 bp, Homo sapiens
  misc_feature: GYAE6OF02GQWK5.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtgaggctgaggatgttgggattttagtttctgctatgcaagctacacactggccgtactactttcggccgaggggaccaagcgtggagatacaaacgactgtggctgcaccattccg

SEQ ID NO: 236582 - DNA, 622 bp, Homo sapiens
  misc_feature: GYAE6OF02HJ3FI.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctaataaggtttactaaccgggacgcgtcggggtcccagacagattcagcggacacgtggtcaggcactgatttcacactagagaattagcgtaagggtggaggcgtaggaaggtagtggtttagggtatttttagtttcgttgtactagtgtacgaaacggtccgtaacgtaacctacgttacgggtcccgttaaccgtacgttttacgggacccgtaggggtaacccgaaggtaccggtagggaacgtaacgtaaccgaaaaccggaaccgttacggtacgggtaccgttacggacccgtacccgtaagttacccg

SEQ ID NO: 236583 - DNA, 760 bp, Homo sapiens
  misc_feature: GYAE6OF02ILNX3.3.35.D02.1.454.CMB.1.raw
tcagagacgcactccacgaccggtgctcgatttagcacacgatagttgggtttgggggtagtcaggactcctcagttcaccttctcacaatgaggctccctgctcagctcctgggctgctaatgctctggtcccaggatccagtgggatgttgtggtgactcagtctccactctccctgcccgtcacccttcggacacgccggcctccactctcctgcaggtctggtcaaagtcctcgtgtacggtgagtaggaaacaccttacttagtaactttggtaactcagacgtaagacgggccgaacgggcctaaacgtcctaccgaacgggaccggtaccttaaatcgttaaacgtttaacgggtttaccgttaaacccgggtacggtaccgttaccggggtaccccgaggaaccgtaaggtacgttacgacggcggacaccggtttagggtacgaacgggctaccgttaggtaactttccgacgtaccgttagaagtaacgtttaggacggtaagggtcgggaacggcgttacgggagggtagttgggtttagggttaattttttacgtttcgtaggtaccgtagtacggtacgtaaacgtaccttaaccaccgttaaccgtacggggttaccctttaacggttacgttttaccggggaccgggtaaccggggtaccaagggtccgttaaggggacgttaacgtaaccgtaaaaccggacgtttcgggtacggtaacccggtgtaaccctacgttctaccgg

SEQ ID NO: 236584 - DNA, 559 bp, Homo sapiens
  misc_feature: GYAE6OF02G4LLJ.3.35.D02.1.454.CMB.1.raw
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgtggtctctggattcaccttcagggaccacttcatggactgggtccgccaggctccgagggaaggggctggagtgggttggccgtataagaaacaaagctagaagttacaccacagattacgccgcgtctgtgacaggcagattcaccatctcaagagatgattcaagcaaactcagtgtctctgacaaatgaaaccaccctagaacgaccgaggacacgggccgtctaattactgcgctacagattcatagtggagctacgactacgtcgggccacggacgaccgtggtcaccgtctcctcacgcctccaccgaacgggcccacgtccggtccttccccgtcggcccgcccgtcgcctaccgacggacgccgacccgtccgacgacgaccg

SEQ ID NO: 236585 - DNA, 539 bp, Homo sapiens
  misc_feature: GYAE6OF02HTJHO.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgacctaatctataaggtttctaaccgggacgcgtgggtcccagacagattcagcggcacgtgggtcaggcacgtgatttcacactgagaattagcagggtggaggctggaggtagtggttagggtattttagtttctgtctatgacaagactacacctcgtcggtaccttacgtacgtttacggccgtacggggaccagcgtggagatacgaaacgacgtggtcggctggacaccattccg

SEQ ID NO: 236586 - DNA, 594 bp, Homo sapiens
  misc_feature: GYAE6OF02FYY7K.3.35.D02.1.454.CMB.1.raw
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgtggtctctggattcaccttcagggaccacttcatggactgggtccgccaggctccgagggaaggggctgggagtgggttggccgtataagaaacaaagctagaagttacaccacagattacgccgcgtctgtgacaggcagattcaccatctcaagagatgattcaagcaactcagtgtctctgacaaatgaaaccaccctagaacgaccgaggacacggccgtctattactgcgctacagattcatattggagctacgactacgtcgggccacgggacgaccgtggtccaccgttcctccgtcaccgtccctacccgaacccgaacgggacccctacgtccggttcccttccccccgtcgggcccgtaccccgtcgtcccgttccgacgggaccgcccgtaaccccgtccggacggacgtacccg

SEQ ID NO: 236587 - DNA, 557 bp, Homo sapiens
  misc_feature: GYAE6OF02G0SW1.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggcaggccaatctccaaggcgctaatctataagttctaaccgggacgctgggtcccagacagattcagcgcacgtggtcaggcactgatttcactactgagtaattagacgagggtaggaggcgtgaggtagtggttagggtatttagtttcgtgctatgacgaagactacactactggtaccgttactacgtttcggaccggtacgggacgacggtacgtaggtacgtaacgtaacgtaaaccgtagtacgtcggtacgtacgaccgtactagttaccg

SEQ ID NO: 236588 - DNA, 551 bp, Homo sapiens
  misc_feature: GYAE6OF02IP6CB.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttcaaccgggacgctgggtccagacagattcagcggccacgtgggtcaggcactgatttcactactcgagaattagcgagggtggaggcgtggaggagtaggtttgggtatttaattttcgtgtctagtgacgaagtactacactacgtggcctaactacgtttcggacgtacggggacctaggcgtggaagacgtacaaacggtaacgtggtacggtgtagccgtaccagttaccg

SEQ ID NO: 236589 - DNA, 545 bp, Homo sapiens
  misc_feature: GYAE6OF02GWOZK.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaacacctacttgaattggtatcagcagaggccaggccaatctccaaggcgcctaatctataaggtttctaaccgggacgctggggtcccagacagattcagcggcactgggtcaggcactgatttcactactgagaattagcaggggtgggaaggcgtaggagggtagtggtttggggtattttagtttctggctagtgtcaagtctacaccacgtggtccgtactacgttttacggccgtaggggaccaagcgtggagactacgaaacgtacgtagtacggctggcaccgattccg

SEQ ID NO: 236590 - DNA, 523 bp, Homo sapiens
  misc_feature: GYAE6OF02FY6C8.3.35.D02.1.454.CMB.1.raw
  modified_base (299)..(299): a, c, t, g, unknown or other
  misc_feature (299)..(299): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcncctaatctataaggtttctaaccgggacgctggggtcccagacagattcagcggcactgggtcaggcactgatttcacactgagaattagcagggtggaggctgaggagtgttgggtatttattcgttgctatgcaagctacacactcgaccgtacacgttttcggacagggaccaagcgtggacgagtacaaacgaacgtgtacggctagacaccgtataccg

SEQ ID NO: 236591 - DNA, 505 bp, Homo sapiens
  misc_feature: GYAE6OF02GG3AY.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtccccagacagatcagcggcactgggtcaggcactgatttcacactgagaattagcagggtggagctgaggatgttgggatttagtttctgctatgcaagtctaacacactgccgtatacgtttgaccgagggaccagcgtggagatacaacgactgtcgctgcaccatcg

SEQ ID NO: 236592 - DNA, 544 bp, Homo sapiens
  misc_feature: GYAE6OF02IQ7LK.3.35.D02.1.454.CMB.1.raw
  modified_base (305)..(305): a, c, t, g, unknown or other
  misc_feature (305)..(305): n is a, c, g, or t
  modified_base (431)..(431): a, c, t, g, unknown or other
  misc_feature (431)..(431): n is a, c, g, or t
  modified_base (443)..(443): a, c, t, g, unknown or other
  misc_feature (443)..(443): n is a, c, g, or t
  modified_base (450)..(450): a, c, t, g, unknown or other
  misc_feature (450)..(450): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaanctataaggtttctaaccgggacgcgtgggtcccagacagattcagcggcactgggtcaggcactgtatttcaacactggactaattagcgtagggtgggaggcgtgaggagtggttgggtattttnttcgtgctatgnaagctanacacgtcggaccgtactacgtttcggccgtaaggggtaccaaggtcgtaggagaagtacgaaacgtaacgtcggtacggctagcctacgattcg

SEQ ID NO: 236593 - DNA, 538 bp, Homo sapiens
  misc_feature: GYAE6OF02IQ8W1.3.35.D02.1.454.CMB.1.raw
  modified_base (383)..(383): a, c, t, g, unknown or other
  misc_feature (383)..(383): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctgtgacggtgatggaaacacctacttgaattggtatcagcagagcaggccaatctccaaggcgcctaatctaataaggttctaaccgggacgctgggtccagacagattcagcggcacgtggtcaggcatgatttcacactgagaattagngagggtggaggctagaggagtgttgggtatttatttctgtcatgcaagactaacactacgtcggaccgttaacgtacgttttcggacgtacggggaccgaaggaccgtgggtaacgacgtacaaacggaacgtcggtaggcctcgcacctatccg

SEQ ID NO: 236594 - DNA, 597 bp, Homo sapiens
  misc_feature: GYAE6OF02HPY6L.3.35.D02.1.454.CMB.1.raw
  modified_base (588)..(588): a, c, t, g, unknown or other
  misc_feature (588)..(588): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgcgtggggtcccagacgagattcagcggcacgtgggtcaggcacgtgtatttcacactagagtaattagcgagggtggaggctaggaggtagttggttagggtatttttagttcgtgtacagttgactaacgtacctacactacgtacggtaccgttaaccttacgtttcgggaccgacgggggtaccctaaggccgtaagggtaacgaacgtaaccgtaaaacccggaagttcgggtacggtcctaacggcctaacccgntttacccgg

SEQ ID NO: 236595 - DNA, 521 bp, Homo sapiens
  misc_feature: GYAE6OF02F5ZJS.3.35.D02.1.454.CMB.1.raw
  modified_base (436)..(436): a, c, t, g, unknown or other
  misc_feature (436)..(436): n is a, c, g, or t
  modified_base (512)..(512): a, c, t, g, unknown or other
  misc_feature (512)..(512): n is a, c, g, or t
  modified_base (518)..(518): a, c, t, g, unknown or other
  misc_feature (518)..(518): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttcctaaccgggacgctcggggtcccagacagattcagcggcacgtggtcaggcagtgatttcacactgagaattagacgagggtggaggcgtagaggagtggttgggtatttagtttctgntatgcaagctacacacgtgccgttactacgtttggaccgagggaccagcgtaggagagacaaacgactagtcgcgngcaccntcg

SEQ ID NO: 236596 - DNA, 518 bp, Homo sapiens
  misc_feature: GYAE6OF02GP622.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcacgtgggtcaggcactgatttcacactgagaatagcagggtggaggctgaggatggttgggtattttatttctgcatgacaagctacacacgtgccgttacacttttggccagggaccaagcgtggagagtacaaacgaacgtgtacggctgacaccgattacg

SEQ ID NO: 236597 - DNA, 548 bp, Homo sapiens
  misc_feature: GYAE6OF02F7XEP.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaagcgcctaatctataaggtttctaaccgggacgcgtggggtccccagacaggattcgagcggcactgggtcaggcactgatttcacatgagaattagcagggtggaggctggaggatggttagggtatttagtttctgcagtgcaagctacactactggaccgtactactttcgggacctaaggggaccaaggcgtagggaacgtagtaccgaaaaccgtacgttggtcggtacctggcctacccgattcccgg

SEQ ID NO: 236598 - DNA, 502 bp, Homo sapiens
  misc_feature: GYAE6OF02FH4J5.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtccccagacagattcagcggcactgggtcaggcactgatttcacactgagatagcagggtggaggctgaggatgttgggatttatttctgcatgcaagctacacactggccgtacacttttggccaggggaccaagctggagatcaacgaactgtggctgcaccatcg

SEQ ID NO: 236599 - DNA, 559 bp, Homo sapiens
  misc_feature: GYAE6OF02J1QZM.3.35.D02.1.454.CMB.1.raw
tcagagacgcactccacgaccggtgctcgatttagcacacgatagttgggtttgggggagtcaggactcctcagttcaccttctcacaatgaggctccctgctcagctcctggggctgctaatgctctgggtcccaggatccagtggggatgttgtggtgactcagtctccactctccctgcccgtcacccttggacagccggcctccactctcctgcaggtctggtcaaacgcctcgtgtacggtgatggaaacacctacttgaattggtatcagcagaggccaggccaatctccaaggcgcctaatctataaggttctaaccgggacgcgtgggtcccagacagatcagcgcactgggtcaggcactgattccacactgagtaattagcagggtggagcgtagagggatgttgggtactttagtttctagtctatgacgtaagctaacactacgtcggaccgttaccttacgtttacggaccgacgggaccgtagacggtaggacgaagtaaccgaaaccgacgttcggtacggcttacggaccaccgtagttaccg

SEQ ID NO: 236600 - DNA, 612 bp, Homo sapiens
  misc_feature: GYAE6OF02J2SBE.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatcctcctgcaggtctggtcaaacgcctcgtgtacggtgatggaaacacctacttgaattggtatcagcagaggccagggccaagtcctcaagcgcctaatctataaggtttactaaccgggacgctcgggtcccagaacagattacagcggcactgggtcaggcactgatttcacactagagtatagcgagggtggaggctaggacggagtaggttagggtattttaagtttcgttgagtacgtacgtcgaacgtactaccgactacgttacgggtacccgtacgttaccggttttcggccggtaacggggacccgtaagtccggtaagggtaggtaacgttaaccgaaaaccggtaaccgttacgggtacggccgttacggtacccgtacgtaaccgtttccg

SEQ ID NO: 236601 - DNA, 601 bp, Homo sapiens
  misc_feature: GYAE6OF02IHD5K.3.35.D02.1.454.CMB.1.raw
  modified_base (459)..(459): a, c, t, g, unknown or other
  misc_feature (459)..(459): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctaccaaggcgcctaatctataagtttcgtaaccgggacgcgtcgggtcccagacagattcagcggcactgggtcaggcactgatttcacactgaagtaattaagcgtaaggggtgggaggcgtaggagggtagttaggtttagggtagttttaatttcgttagtactangtactaagtactaacaacctacgtcggtacccgttacgtaacgttttcgggaccgtacggggaccaacggtcgtaagggaacgtaagtaaccgaaaccgtaacgttcggtacggtaccgtacggtaccacccgtattacccg

SEQ ID NO: 236602 - DNA, 541 bp, Homo sapiens
  misc_feature: GYAE6OF02FFZF0.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctactgaattggtatcagcagaggccaggccaatctccaaggcgcctaatctataaggtttctaaccgggacgctggggtccccagacagattcagcggcactgggtcaggcactgatttcacactgagaattagcaggggtggaggctggaggatggttggggtattttagtttctgtcatcgacaagcctaacacacgtcggtcccgtaactacgttttggaccgtaaggggaccaagcgtaggagactacaaaccgtacgtggtcggactgactaccagttccg

SEQ ID NO: 236603 - DNA, 628 bp, Homo sapiens
  misc_feature: GYAE6OF02GTXQK.3.35.D02.1.454.CMB.1.raw
  modified_base (217)..(217): a, c, t, g, unknown or other
  misc_feature (217)..(217): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcnggtctggtcaaagcctcgtgtacggtgatggaaacacctacttgaattggtatcagcagaggccaggccaatctcaaggcgacctaatctataaggtttctaacgggacgcgtcgggtcccagacagattcagcggcacgtggtcaggcaactgactttccactacgtgaagtaagttagcgtaagggtcggaggtcgtcggaggtagttggttagggtattttacgttttacgtgactagttcgacgtaaacgacgtttaaccaacgtaaccgttcgggtacccgttaacgttaaccgttttcgggacccgtaacggggtacccaagggtaccgtaagggtaacgtaacgtaaccgtaaaaccggtaaccgttagggtcggtaccgtacggtaccaacccgtattcccgg

SEQ ID NO: 236604 - DNA, 529 bp, Homo sapiens
  misc_feature: GYAE6OF02IMIDW.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgcgtgggtccacgacagattcagcggcactgggtcaggcactgatttcacactgagaattagcgagggtggaggctggaggagtggttgggtattttagtttctgtcagtgcaagctacacacgtcgccgtactactttcggccgacgggaccgaagtcgtaggtacgagtaccgaaacgaacgtcgtggcctgcaccatcg

SEQ ID NO: 236605 - DNA, 538 bp, Homo sapiens
  misc_feature: GYAE6OF02G79TA.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaaccgggacgctggggtccccagacagacttcagcggcactgggtcaggcactgatttcacactgagaatagcagggtggaggctgaggagtggttgggtattttatttcgtgtcatgcaagctacacactcggacccgttaactacgttttcggaccgtaggggaccaaggtcgtgggaagataacgaaacgaacgtgtcggactggacaccattccg

SEQ ID NO: 236606 - DNA, 573 bp, Homo sapiens
  misc_feature: GYAE6OF02JJTFT.3.35.D02.1.454.CMB.1.raw
  modified_base (254)..(254): a, c, t, g, unknown or other
  misc_feature (254)..(254): n is a, c, g, or t
  modified_base (333)..(333): a, c, t, g, unknown or other
  misc_feature (333)..(333): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgagtggaaacncctacttgaattggtaactcagcagaggccaggccaatcctcgaagcgacctaatctaagtaacgttctaaaccgggcncgtacgggtcccaagacagacttcgagtcgcacgtggtcaggcactgacttcactactgagtaatagcgagggtggaggctagaggtagtggttggtactttagttctagctagtgactaagtacttacacgtacgtacgtaccgtactacgtttacggaccgtaagggtaccaaggtcggtaacgggatacgtaacgaaaccgtaagtacggtcggtacctagaccgtaccgtattccg

SEQ ID NO: 236607 - DNA, 682 bp, Homo sapiens
  misc_feature: GYAE6OF02I7ITE.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtgggatgttgtggtgactcagtctccactctccctgcccgtcacccttggacagccggcctccatctcctgcaggtctggtcaaacgcctcgtgtacggtgatggaaacacctacttacgaattggtatcagcagaggaccaggcccaatccgtaccaacggcgacctaatcgtataacggtttaccgtaaccgggacgtcgtacgggtcccagacgagtacttacgaacgcggctaacgtcgggtacagggacacgtgtatttaccgactacgtagaacgtaaattacggacgtaacggggtggtaacggtccgtaggtaaggtagttcgggttagggttaatttttacgtttacgttagtacgtacgttacgacgtaaacgtaccgttaaaccgaccgtaaccgttcgggtaacccgttacgttaacgttttacgggaacccgtaaggggtacccaaggtccggtaaggtaacgtaagtaaccgaaaacggttaacgtacggttcggaccgttacggacccgtaacctagttaccgg

SEQ ID NO: 236608 - DNA, 846 bp, Homo sapiens
  misc_feature: GYAE6OF02I4PS9.3.35.D02.1.454.CMB.1.raw
tcagagacgcactccacgaccggtgctcgatttagcacacgatagtgggttggggaggtcaggactcgtacagttcgaccttctcgacggaatgtaggcctccctagctcacgctcctagggctgtctaatggctctggtcccaggctccagtggggatgttgtggtggacgtcagttcgtcctctctcctgccgtctaccgtgcagccggctccgatctctgcaggtctggtcgaagcctcgtcgtacggtctaagttcggaaacctacctacgttagtaaacgttgggtattccaaggtccgaagtacggtaccgtaggaccgtaattccgtacccgaaaggtcccgtacccctaaacgtccttaacgttaaccggttttaccgttaaaccccgggtaccgtacccggttacgggggttaccccaacggtaaccgtacgtaaccgttacgtaaccgtaccgggtccaaccggttacgggtaccgtaagggttacccgaacggttaccggttaaccgttttaccggaccgtaaccgtaacgttaaggtaaacgttaacggtaaccggtaacggggtaacgggttacggtacggttacggtaaggttacggttacgggtttagggttaacgtttaagtttccgttagtaccgttacgtacggtacctaacggtaccgttaacccgtacgttaaccggtacgttaccgttaacgtacggtttttaccggaaccggttaaccgggttaccgttaacggtaccggttaaggtaaccggtaacggtaacccgtaaccggtaacgtacggttacgggtaccgtacggacccggtaccggtaccgttaccgg

SEQ ID NO: 236609 - DNA, 542 bp, Homo sapiens
  misc_feature: GYAE6OF02GLNEA.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcacgtgggtcaggcactgatttcacactgagaattagcagggtggaggctggaggtatggttgggtatttatttcgtgcgtatgcaagctacacactcggccgttactacgttttggcccgtaggggaccaaggtcgtgggaacgacgtacaaacgtaacgtggtcggtacgtggactaccgattaccg

SEQ ID NO: 236610 - DNA, 530 bp, Homo sapiens
  misc_feature: GYAE6OF02H0Q40.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggcaggccaatctcaaggcgcctaatctataaggttctaaccggacgctgggtccagacagattcagcgcatggtcaggcactgatttcacactgagattagcgagggtggaggtctgaggagtgttgggtatttatttctgcatgcaagactacacacgtcggtacctacgtacgttttagaccgtacgggaccaagacgtggacgtagtacgaaaaccgtaagtagtaggtaccgtacgacacccattacg

SEQ ID NO: 236611 - DNA, 558 bp, Homo sapiens
  misc_feature: GYAE6OF02FZD6I.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttcaaccgggacgcgtggggtcccagacagattcagcggcacgtgggtcaggcactgatttcacacgtgagaattaggcgagggtgggaggcgtggaggtagtggtttgggtattttagtttctggtctagtgacgaagacttacaactacgtacgggccgttaactacgttttcggaccgtaggggaccaaggcgtgggagtacgtacgaacgaacgtggtcggcgtagacctaccgattacg

SEQ ID NO: 236612 - DNA, 559 bp, Homo sapiens
  misc_feature: GYAE6OF02HDQV7.3.35.D02.1.454.CMB.1.raw
  modified_base (329)..(329): a, c, t, g, unknown or other
  misc_feature (329)..(329): n is a, c, g, or t
  modified_base (404)..(404): a, c, t, g, unknown or other
  misc_feature (404)..(404): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagcccggcctccatctcctgcaggtctggtcaaagcctcgtgtacggtgatggaaacacctacttgaattggtatcagcagaggccaggccaatctccaaggcgcctaatctataaggtttctaaccgggacncgtggggtccccagacagattcagcgcacgtggtcaggcactgactttcacactagagattagcagggtggaggntagaggagtggttgggtattttagtttcgtgtcagtgctaagcttacactacgtggtacccgtatacgttttgccgtaaggggacctaaggtccgtaggacggtaagtaccgaaaccgtaaccgttggtacggtactcggacctaccgtattccg

SEQ ID NO: 236613 - DNA, 656 bp, Homo sapiens
  misc_feature: GYAE6OF02IMSTO.3.35.D02.1.454.CMB.1.raw
tcagagacgcactccacgaccggtgctcgatttagcacacgatagttgggtttgggggagtcaggactcctcagttcaccttctcacaatgaggctccctgctcagctctgggctgctaatgctctggtcccaggatccaggtggggatgttgtggtgactcagtctccactctccctgcccgtcacccttggacagccggcctccatcctcctgcaggtctggtacaaagcctcgtgtacggtgataggaaacacctacttgaattggtaatcagcgagacggccaggccaagtcctaccgaaggccgtacctaagtctaagttaaggtttaccgtaaaccgggacgcgtcggggtacccaagacagtacttcgagccggacaacgttcgggcaaggcacgtagtactttacgaactagtcgaagtaagttagcgaaggggtgaaggctaggaggtagtggttagggaatttttgttcgaggtactagtcgacgtaacgtacttaccgaacgtacggttcggacctttaacgttacgttttacgggacccgaacgggggtacccaaagggttccggtaacggggtaactaacggttaaccgaaaaaccggtacgtttaaggtcggaccgttacgaccgttaaccgtagttacccg

SEQ ID NO: 236614 - DNA, 566 bp, Homo sapiens
  misc_feature: GYAE6OF02HZKYK.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtacaaagccctcgtgtacggtgataggaaacacctacttgaattggtatcagcagaggccaggccaatctccaaggcgcctaatctaataaggtttctaaccgggcgcgtggggtcccagacagactcagcggcacgtgggtcaggcactgatttcacactgagaattagcgagggtggaggcgtaggaggagttggttagggttattttatttcgtgtctatgacgaagtctaacactacgtggacccgttacttacgttttcgggaccgtacggggacccgaaggtcgtaggaggtaactacaaaacggaacgtggtacggctcggactacctagttacg

SEQ ID NO: 236615 - DNA, 566 bp, Homo sapiens
  misc_feature: GYAE6OF02GPOWR.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgcgtcggggtcccagacagattcagcggcacgtgggtcaggcactgatttcacactgagtaatagcgagggtggaggcgtggaggagttggttagggttattttatttcgtgtactatgacgaagactacactacgtcggtacccgttactacgttttcggaccgacggggaccgaaggtcgtaggaagtacgtacgaaaacgtacgtacggtcggtactcggacctaccgtattccgg

SEQ ID NO: 236616 - DNA, 545 bp, Homo sapiens
  misc_feature: GYAE6OF02FLU43.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggcccaatctccaaggcgcctaatctataaggtttcctaaccgggacgctggggtccccagacagattcgagcggcacgtgggtcaggcactgatttcactactgagaagtagacgagggtggaggcgtggaggagtggttagggtatttatttctgctatgcaagactacacacgtcggtaccgtactacgtttggccgaggggaccagacgtgggaagagtacaaacgtaacgtaggtcggccgtagacctacctagtccg

SEQ ID NO: 236617 - DNA, 536 bp, Homo sapiens
  misc_feature: GYAE6OF02GKBZZ.3.35.D02.1.454.CMB.1.raw
  modified_base (403)..(403): a, c, t, g, unknown or other
  misc_feature (403)..(403): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcacgtgggtcaggcactgatttcacactgagaattagcgagggtggaggntggaggagtgttgggtattttatttctgtcatgacaagctacacacgtcggtaccgtactacgtttcggccgtacggggaccaggcgtggaagtacgtacgaacgaacgtcggtggtctgctacctattaccg

SEQ ID NO: 236618 - DNA, 630 bp, Homo sapiens
  misc_feature: GYAE6OF02HLHSP.3.35.D02.1.454.CMB.1.raw
  modified_base (470)..(470): a, c, t, g, unknown or other
  misc_feature (470)..(470): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtacaaagcctcgtgtacggtgataggaaacacctacttgaagttggtatcagcagaggccaggaccaatcctaccgaaggccgacctaatctaataacggtttacgtaaccggacgcgtcgggtacccagacagacttcgacgcggacacgtggtcgaaggcactgtactttcactacgtagtagtaattagacgagggtaggaggtctaggaggtagttggttacgggttattttacgtttacgngtacagtagacgtaaggacctacgaacgtacgtacggtaccgttaccgtacgttttccggaccgtaacgggggtaccaaggtccggtaacgggaagttaacgtaccgtaaaaccggtaacgtttacggtacggtacgtaccgaccgtaccgtagttaccg

SEQ ID NO: 236619 - DNA, 544 bp, Homo sapiens
  misc_feature: GYAE6OF02G9YXU.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccgggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctaccaaggcgcctaatctataaggtttctaaccgggacgctggggtccagacagattcagcggcacgtgggtcaggcactgatttcacactgaagtaattagacgtagggtaggaggcgtggagggtagttggttagggtattttagtttcgtgtcgtatgacaagtctacacacgtggtccgtactacgtttcggccgagggaccgagcgtaggagatacaaacgtacgtggtacggtcgtagcacatcttcg

SEQ ID NO: 236620 - DNA, 734 bp, Homo sapiens
  misc_feature: GYAE6OF02H9GEH.3.35.D02.1.454.CMB.1.raw
  modified_base (250)..(250): a, c, t, g, unknown or other
  misc_feature (250)..(250): n is a, c, g, or t
tcagagacgcactccacgaccggtgctcgatttagcacacgatagttgggtttgggggatcaggactcctcagttcaccttctcacaatgaggctccctgctcagctcctgggctgctatgctctggtcccaggatccaggtgggatgttgtggtgactcagtcctccactcctcccgtgcccgtcacccgttggacacgccggcctccatctcctgcaggttctggtacaaacgcctcggtggttacgngactacgaaactacctacttagattggtatcagcagagcagaccaactctacgaggctacctaatctacgttaacggttaccgtaaccgggacgtccggttaccggggtaccaagactagtaactcgagtccggacgtacgtcgggtacacgggacctacgtacgtaactttccaacgtacgtagaaagtaacgttacggacggtagggggtacgtaagggtcgtagggtaagggttaacggtttgggttaagggtttaattttttacgtttcgacggttactaggttacgtaacgtaacggttacctaaaccgtaccgttaacggttacccgggttactttaacccgggttaacggtttacccggggacgggtaacccggggtaacgtaacggtaccgtaaggggtaacgtacgtaacccggtaaaaaggtcccgtttagggacccggttactaccggtacccttaacccgttagtttaccgg

SEQ ID NO: 236621 - DNA, 626 bp, Homo sapiens
  misc_feature: GYAE6OF02HJ4Q7.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgataggaaacacctacttgaattggtatcagcagacggccaggccaatcctaccgaaggccgacctaatctaagttaacggtttaccgtaaccgggacgtcgtcggggtaccccaggacagtacttcgagcggcacgtgggtcaggcacgtgatttcactacgtagaagtaacttagacgtaggggtgggagcgtaggtaggtacgttggttagggttattttagttcgtgtctatcgacgtaacgtactaaccgtacacgtcggtaccgttaacgttacgttttacgggacccgtaaggggtaccaaggtacgtagggaacgtaacgtaaccgaaaccggtaccgtaggtacggtacgtaccggaccctaccgtacttccgg

SEQ ID NO: 236622 - DNA, 551 bp, Homo sapiens
  misc_feature: GYAE6OF02GU30C.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagcccggcctccatctcctgcaggtctggtcaaagcctcgtgtacggtgatggaaacacctacttgaattggtatcagcagaggccaggccaatctccaaggcgcctaatctataaggtttcaaccgggacgcgtgggtccagacagattcagcggcacgtgggtcaggcactgattcactactgagtaattagacgagggtgggaggctggaggtagtggtttagggtattttagtttcgtgtcctatgacaagtcctacacgtacgtcgaccgttaactacgtttcggaccgagggaccctaaggcgtaggaagtatacgtaaacgactggtacgctacgacctacgattccg

SEQ ID NO: 236623 - DNA, 563 bp, Homo sapiens
  misc_feature: GYAE6OF02I5W6O.3.35.D02.1.454.CMB.1.raw
  modified_base (404)..(404): a, c, t, g, unknown or other
  misc_feature (404)..(404): n is a, c, g, or t
  modified_base (431)..(431): a, c, t, g, unknown or other
  misc_feature (431)..(431): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgcgtgggtcccagacagattcagcggcacgtggtcaggcacgtgactttcacactgaagaattagcgagggtgaggntgaggagtggttggtatttatttctgnatgacaagactacgactacgtcgacccgttactaccgttttcggaccgaacggggtacccaaggtccggtacgggtaagacgtaaccgaaacgtaacgttaggtacgggtacttcggactaccgacttaccg

SEQ ID NO: 236624 - DNA, 591 bp, Homo sapiens
  misc_feature: GYAE6OF02FI0YD.3.35.D02.1.454.CMB.1.raw
  modified_base (393)..(393): a, c, t, g, unknown or other
  misc_feature (393)..(393): n is a, c, g, or t
  modified_base (443)..(443): a, c, t, g, unknown or other
  misc_feature (443)..(443): n is a, c, g, or t
tcagagacgcactccacgaccggtgctcgatttagcacacgatagttgggtttggggatcaggactcctcagttcaccttctcacaatgaggctccctgctcagctcctggggctgctaatgctctgggtcccaggatccagtggggatgttgtggtgactcagtcctccactctcccctgccccgtcacccttggaccagccggcctccatctcctgcaggtctggtcaacgcctcgtgtaccggtgatggaaaccacctacttgaattggtatcagcaggacggccaggccaatctccaagcgctaatctataacggtttcaaccggtacgccgtcgggtaccccagacgagacttcgacgcggcacgtggtcaggcacgtgactttcacnctgatatagcgaggtggagcgtggaggtagttggttaggttatttattcngctatcgtacaagtcctaaccactaccgttacggtccgtaactacggtttacggcccgaagggtaccacgtccggtaacggacgtaaaccgtaccaaaccggtaaccgttcgggtcggtaccgtacgcccctaacgtacgtttacccg

SEQ ID NO: 236625 - DNA, 604 bp, Homo sapiens
  misc_feature: GYAE6OF02JK4HZ.3.35.D02.1.454.CMB.1.raw
  modified_base (294)..(294): a, c, t, g, unknown or other
  misc_feature (294)..(294): n is a, c, g, or t
  modified_base (354)..(354): a, c, t, g, unknown or other
  misc_feature (354)..(354): n is a, c, g, or t
  modified_base (356)..(356): a, c, t, g, unknown or other
  misc_feature (356)..(356): n is a, c, g, or t
tcagagacgcactccacgaccggtgctcgatttagcacacgatagttgggtttgggccgagctgggttttcctggttgttatttacaaggtgtccagtgtgaggtgcagctggtgcagtctgggggaggcttggtccagcctggagggtccctgagactctcctgtgtggtctctggattcaccttcagggaccacttcatggactgggtccgccaggctccgagggagggctggagtgggttggccgtataagaacaagctagaagttacaccacagattacgcgcgtcgtgngagagagatactacacactactacagatagtatatacacacactactagtctctctacananacacacgacgacgacgacgacgacgtacgtactactacgtacgtacgtactacgtacgtatactagtagtagtacgtacgtacgtacgtacggtacggacgacgtacgtacgtacgtaccgtaccgtaccgtccgtaccgtaccgtaccgtaccgaccgtaccgtaccgtaccgtaccgtacccgtcccgtccgtccgtcccgtccgtaccgtaccgtaccggaccgtaccgtaccgtaccgacgacg

SEQ ID NO: 236626 - DNA, 589 bp, Homo sapiens
  misc_feature: GYAE6OF02F2AC7.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgcgtgggtcccagacagattcagcggcacgtgggtcaggcactgatttcacactgagaatagcagggtggaggctggaggagtggttgggtatttagtttcgtgctatggacaagcttacaccgtacgttcgggtacccgtaacctaccgtttttcgggacccgtaagggggaccctaacggtccgttagggaacggtaacgtaaccgaaaccggtaacgttaggttacgggaccgttcggacccgtaccgtactttaccgg

SEQ ID NO: 236627 - DNA, 902 bp, Homo sapiens
  misc_feature: GYAE6OF02H0PSU.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctagtcaaagcctcgtatacagtgataggaaacacctacttgaattggtttcagcagaggccaggaccaatcctaccgaaggtccgtaccttaaagttttaacttaacggtttaccgtaaaacccgggggtccttaccggttaccgggggttaccccaaggtaaccgtaagtaactttacggaacggtccgggacgtaaggggttcgggtaccgaaggggacctaaccggttggttaacttttaccgaaaccgtaaacccttaagggtaaaaaaccgttttcggaaacggtaaccggtaaacgggggggggtttacgggaacggggtaccgttaagggggtaacggggttaacgggttttagggggttttttaacggggggtttttttaaactttaacccggtttagggtaacctttaacgggttacggggtaaacccgtaaaaacgggggtttaccctaaaccggtaacccggtttcccggggtaccccggttacccgggttaacccgggtttacccggggacccggtaaaccgggggtaaaccctaaagggggttaaccgggttaaaacctaaccggtaaaacccgggtaagtttaccgggtacgggtacccgttacggaacccttaacccggtactttaccggttaccgtttaccgtttaccctaacgttttcccccgg

SEQ ID NO: 236628 - DNA, 852 bp, Homo sapiens
  misc_feature: GYAE6OF02H7YQ3.3.35.D02.1.454.CMB.1.raw
tcagagacgcactccacgaccggtgctcgatttagcacacgatagttgggtttgggggtagtcaggactcctcagttcaccttctcacaatgaggctccctcgctcagctcctgggctgctaatgctctgggtcccaggatccagtgggatgttgtggtgactcagtctccactctccctcgcccgtcacccttgaccacgccggcctccatctcctgcaggtctggtcaaagcctcgtgtacggtgagtaggaaacacctacttagaatttggtatcagctaaggacggacccgaggacccctaaatccctacccgaaaagggtccggacccttaaaattccttaaacggttaaacgggttttaccgtaaacccggggaccggttccggtacgggggtacccccaaggaccgtaagaacgttaccgaaggtccggacgtaaccggttagggtaccgaacgggccgtaacgttggtaacttttaccgaacctaacgggttagtaaaccgggtaaatttaagggtaccgggtaaagggggttcgggaacgggtacgtaaggggaaaggggttaggtttagggtttagggggttaaagtttttacgttttacggttacggttacgttaaggttacggtacgtaaaccggttaccttaaacccgaaccgttaaccgggttacccgggtaacccgtttaaaccggtttacccggttttaaccggggtaacccggtaacgggggggtaacccgtaacgggtaccgggtaacggggttaaagaacggttaaaccggtaaaaaccggtaaccggttagggtacgggttacccgtacggacctaccggtaccgttaccgg

SEQ ID NO: 236629 - DNA, 617 bp, Homo sapiens
  misc_feature: GYAE6OF02FJRBT.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaagcgacctaatctataaggtttcaaccgggacgcgtcggggtcccagacagtattcgagcggcacgtggtcaggcactgatttcacactagagaattagcgagggtggaggctaggaggtagtggttagggtattttagtttctgtcgtagttgacgaagtacctaacaccgtaacgtcggtacccgttaacgttaccgtttttacgggacccgtaagggggaccctaagggtccgttaacggggaacgtaacgttaaccgaaaaccggtaaacgtttacgggtaccggtacgttaccggacccgttaaccgtcgttaacccg

SEQ ID NO: 236630 - DNA, 578 bp, Homo sapiens
  misc_feature: GYAE6OF02F2WA4.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccgaaggcgcctaatctattaagttcgtaaccgggacgcgtcggggtcccagacagacttcgagcgcacgtggcaggcacgtgatttcacactgagtaattagacgagggtggaggtcgtaggacggtagttggttagggtattttagtttcgtggtacgtatggactaaggtactacaccgacgttcggaccgttactacgttttacggccggtaagggacctaaggcgtaggaacgtaactaacgaaacgtaagttcggtcggtactccggactaccgtattacg

SEQ ID NO: 236631 - DNA, 606 bp, Homo sapiens
  misc_feature: GYAE6OF02JNU3M.3.35.D02.1.454.CMB.1.raw
  modified_base (221)..(221): a, c, t, g, unknown or other
  misc_feature (221)..(221): n is a, c, g, or t
  modified_base (250)..(250): a, c, t, g, unknown or other
  misc_feature (250)..(250): n is a, c, g, or t
  modified_base (416)..(416): a, c, t, g, unknown or other
  misc_feature (416)..(416): n is a, c, g, or t
  modified_base (566)..(566): a, c, t, g, unknown or other
  misc_feature (566)..(566): n is a, c, g, or t
tcagagacgcactccacgaccggtgctcgatttagcacacgatagttgggtttgggggtagtcaggactcctcagttcaccttctcacaatgaggctccctgctcagctcctgggctgctaatgctctgggtcccaggatccagtggggatgttgtggtgactcagtctccactctccctgcccgtcacccttggacacgccggcctccatcctcctgacnggtctggtcaaacgcctacgtgtacggtnataggaaacacctactagaattacggtatacagtcgagacgcgacggaccaatctaccgaacggcgacctaaagtctaagtaacggtttcgtaaaccgggcgtcgtcggggtacccagacgagtacttcgagtcgcagtcgggtacaggactacgtgtacttcacncgtagagtatagacgtagggtacggaggcgtagtaggtacgtaggttggtacttttagttacgttcgattagtgtacaagtactacagtactcggtactacgttacgtttacggacggtaacgggtaccaaggtacgtaggtaacggtanacgaaacgtacgtaggttcggacctacgactaccgatcgg

SEQ ID NO: 236632 - DNA, 640 bp, Homo sapiens
  misc_feature: GYAE6OF02HSF4X.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgataggaaacacctacttgaattggtatcagcagacggccaggaccaatcctaccgaaggccgacctaataccttaagttaacggttttaccgtaaaccgggacgtaccggtcggggtaccccagaacagtacttcgaaggcggcacgtgggcaggcacgtgtacttcaacgtacgtagtaagaagttacgacggtaggggtaggacggtcgtaggaggtagttggttagggttaattttagtttcgtagtactagtcgacgtaagactaacacgtacgtacggtaccgttaacgttacgtttacggaccggtaacgggacctaacggtacgtacggacgtaacgtaaccgaaacggtaacgttacggtacggacgtacgacctaccgtattaccgg

SEQ ID NO: 236633 - DNA, 611 bp, Homo sapiens
  misc_feature: GYAE6OF02G560P.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaacgcctcgtgtacggtgataggaacacctacttgaattggtatcagcagaggccaggccaatctccaaggcgcctaatctaagttaaggttcgtaaccggacgcgtcggggtcccagacagattcagcgcacgtggtcaggcactgtactttcactacgtgagtaattagcgtaggggtggaggtcgtaggaggtacgtggttagggttaattttagtttactgtctagtgacgaacgtctacacgtacgtacggaccgttaaccgtacgttttacggaccggtaacggggacctaaacggtccgtaaggggtaactaacgtaaccgtaaaccggtaacgttacggtacgggtaccgttacggaccctaccgtacgtttccgg

SEQ ID NO: 236634 - DNA, 600 bp, Homo sapiens
  misc_feature: GYAE6OF02GTHAI.3.35.D02.1.454.CMB.1.raw
tcagagacgcactccacgaccggtgctcgatttagcacacgatagttgggtttgggggtagtcaggactcctcagttcaccttctcacaatgagctccctgctcagctcctggggctgctaatgctctgggtcccaggatccagtggggatgttgtggtgactcagtctccactctccctgcccgtcacccttggacacgccggcctccatcctcctcgcaggtctggtcaaacgcctcgtgtacggtgataggaaccactactagtaattggtatcgagcagacggccaggaccaatcctacgaaggccgtacctaatccgtaagttaacggttttacaaaccggggacgtccggtacggggttaccccagaacctaggtactacgacggcgactacgtgggtcaggctagtgtactttcgacacgtagacgtaatagagtagggtcggaggctaggagtagtaggttagggtattttacgttgttgactagtgactaagctacgactacgtacggtcgtaactacgtttacggacgtacgggactaaggcgtaaggagtacgtaacgaacgacgtcgacggtactgacgtactagtcg

SEQ ID NO: 236635 - DNA, 561 bp, Homo sapiens
  misc_feature: GYAE6OF02G2XZ9.3.35.D02.1.454.CMB.1.raw
  modified_base (364)..(364): a, c, t, g, unknown or other
  misc_feature (364)..(364): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctaataaggtttctaaccggacgctggggtcccagacagacttcagcggcactgggtcnggcactgatttcacactgagtaattgacgaggtgggagcgtggaggtatggttgggtattttagtttacgtgtactatgactaagctacgtactacgtaggacccttacgtacgttttcggaccgtaaggggacccaagtcggtggaagtagtacgaaaccgtaacgttcggtggtactcggtcaccctagttaccg

SEQ ID NO: 236636 - DNA, 646 bp, Homo sapiens
  misc_feature: GYAE6OF02IU8EU.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagcccggcctccatctcctgcaggtctgtacaaagcctcgtgtacggtgatacggaacacctactgaattggtatcagcagaggccaggaccaatcgtaccgaacggcgtacctaatcctaagttaacggtttacgtaaaccgggacgtcgtcgggtacccagacgagattcgagcggctacgtgggtcaggacactgtactttacacgtaactggtaagtaagttagacgagggtaggacggtcgaggacggtagttgggttaggtattttacgtttgtagtctagtcgacgtaagtccgtaacacgtaacgtacgggtaccgtttaaccgtaccgttttacgggaacccgtacggggtaacccgtaacggtcggtacgggtaacgtaacgtaaccgtaaacggtaaccgttagggtcggtacgtcggaccttacccgtatttacccgg

SEQ ID NO: 236637 - DNA, 710 bp, Homo sapiens
  misc_feature: GYAE6OF02JYT4M.3.35.D02.1.454.CMB.1.raw
  modified_base (336)..(336): a, c, t, g, unknown or other
  misc_feature (336)..(336): n is a, c, g, or t
  modified_base (705)..(705): a, c, t, g, unknown or other
  misc_feature (705)..(705): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacacgccggcctccatctcctgcaggtcctggtcaaagcctcgtgtacggtgatggaaacacctattgaattggtatcagcagaggccaggccaaatctaccgaaggcgacctaatctaagttaacggttctaaccgggacncggtcggggtccccaagacgagacttacgaggccggactacggtgggtacaacgggcctacgtacgtacgtttacgaaccttacgtaggtaataaacgtttaacggtacgtaacgggggttagggaacgggtccggttaagggtaagggtaacggtttagggttaacgggggttaacttttttaacgtttcgtttacggtacgtacgttaacgggtacgaaacgttaccgttaaaccgacgtaaccggtaccgggtaacccgttaccgtaaccggttttacgggacccgtaaccgggggtacctaacggtcggtaaggtaacggactaaccgaaagtacgtacggttcgacgttacggacctaaccgtntaccg

SEQ ID NO: 236638 - DNA, 624 bp, Homo sapiens
  misc_feature: GYAE6OF02IQRY2.3.35.D02.1.454.CMB.1.raw
  modified_base (256)..(256): a, c, t, g, unknown or other
  misc_feature (256)..(256): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacacgccggcctccatcctcctgcaggtctggtcaaagcctcgtgtacggtgatggaaaccnctacttgaattggtatcagcagaggccaggccaatctcaaggcgacctaatctattaacggtttctaaccgggcgacgtcggggtccccagacagattcagcggcacgtgggtcaggcacgtgatttcactacgtgaagtaattaggacgaggggtcggaggtcgtaggagggtagttgggttgggttaatttttagttttcgtcgttagtagtaggataacggtacctaacgaccgtacgttacggtacccgtttaacgttacgtttttacgggaccgtaacgggggtacccaaggtccggtaaggacgtagttaaccaaaacggtacgttagggtcggtaccgttacgacccgtaccgactttccg

SEQ ID NO: 236639 - DNA, 518 bp, Homo sapiens
  misc_feature: GYAE6OF02F6MM0.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtccccagacagattcagcggcactgggtcaggcactgatttcacactgagaattagcagggtggaggctggaggatggttgggtattttagtttctgctatgcaagctacacactggccgtactactttggccgagggaccaagcgtggagatacgaaacgaactggtcggctgacaccattcg

SEQ ID NO: 236640 - DNA, 560 bp, Homo sapiens
  misc_feature: GYAE6OF02GFUDZ.3.35.D02.1.454.CMB.1.raw
  modified_base (277)..(277): a, c, t, g, unknown or other
  misc_feature (277)..(277): n is a, c, g, or t
  modified_base (554)..(554): a, c, t, g, unknown or other
  misc_feature (554)..(554): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgataggaacacctacttgaattggtatcagcagnggccaggccaatctaccaggcgcctaatctaattaaggtttctaaccgggacgtcgtcggggtcccaggacagattcgagcggcacgtgggtcaggcactgatttcacactgagaattagcgagggtggaggcgtggaggtagtggttagggttatttatttcgtgatagtgacaagtctacactacgtcggaccgttactacgttttggccggacgggaccacggcgtagggacacgtaacgaaacgtaacgtggtcggtaccgtgacctaccgtnttaccg

SEQ ID NO: 236641 - DNA, 515 bp, Homo sapiens
  misc_feature: GYAE6OF02FX37B.3.35.D02.1.454.CMB.1.raw
  modified_base (511)..(511): a, c, t, g, unknown or other
  misc_feature (511)..(511): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgctaggtctggtcaaagcctcgtgtacggtgatggaacacctacttgaattggtatcagcagaggccaggccaatctccaaggcgcctaatctataaggtttcaaccgggacgctgggtcccagacagattcagcggcacgtgggtcaggcactgactttcactacgtgagtaattagcgagggtggagcgtgaggatggttgggtatttagtttcgtgcatgcaagctacacacgtcgccgtactacgtttgccgtagggaccagcgtggagatacaacgacgtgtcgcgtgcacntacg

SEQ ID NO: 236642 - DNA, 706 bp, Homo sapiens
  misc_feature: GYAE6OF02HJSZY.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgataggaaacacctacttgaattggtatcagcagaggccaggccaatctaccaaggcgacctaatctaacttaaggtttactaaaccgggacgaccgtcggggtaccccaggaacagacttcgaacgtcggaccgacgttgggtacgacgggacctaacgttgtaacttttaccaacctaacgtaggtaacggtaaacgtttaacggcggtaagggggtgggagggtacgttagggaaggggtagtttagggttaggggttatttttaacgtttcgtaggtactagtacgacgtaaacgtactaacccgtaacgtaacgttacgggtacccgttaacgttaccggttttacgggacccggtaacgggggaccctaaaggtccggtaacgggtaagaacgtaaccgtaaaaccgtaacggttacggttacgggtaccgttacgaccgtaccgtacgtttaccgg

SEQ ID NO: 236643 - DNA, 684 bp, Homo sapiens
  misc_feature: GYAE6OF02HPYO5.3.35.D02.1.454.CMB.1.raw
tcagagacgcactccacgaccggtgctcgatttagcacacgatagttgggtttgggggagtcaggactcctcagttcaccttctcacaatgaggctccctgctcagctcctgggctgctaatgctctgggtcccaggatccagtggggatgttgtggtgactcagtctccactctccctcgcccgtccacccttgaccacgcccggcctccactcctcctcgcgtcggtctcggtacaaaacggtcctcggtgtaccggtgagtacggaaacacctaacttgaaattggtatcagccaggacggccaggccaaatctaccgaaggccgacctaactccttaattaaacggtttaccgaaccgggtacgccggttcgggaccgagtaacagtacttcgaggtcggactacgtcggtcgaaggtcacttgagtttcactacgtagtaagaattagacggtagggtcggaggtacgaggaggtaggttggttagggttaagttttatttcgtagtacgtagtgtaccgtaagtaacctaaccgaacctaacggtaccggtacgttaaccgttaccgttttacgggaccgaacggggaaccctaagggacgtacgggtaactaacgtaacgtaaaaacccgtaacggtacgtacggtaccgtacggtacctacccgactttaacccgg

SEQ ID NO: 236644 - DNA, 735 bp, Homo sapiens
  misc_feature: GYAE6OF02JSX3W.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctcgcccgtcacccttggacagccggcctccatcctcctgcaggtctggtacaaagcctcgtgtacggtgatcggaaaccacctacttagaagttggtatcgagtcgaacggacggccaaggcctaatcctaccgaaggccgtacctaagtcttaagttaacggttttaccgaaaccggggacgtaccggttacggggtaccccaggaacgacgtaacgttcgacggccggtacacgttgggacacggtcacgtagtacttacgactacgtagacgtaaagttacgacggtagggtacgggtaggtcgtagggaacggttagttagggtttacgggttaattttttcgttttaccgttaggtacgttagttaggtaaccgtaacggttacctaacgtaaccgtacggttaccggttacccgttaaccggttaaccggttttaccgggacccggtaacggggtaacccgtaaggtaccgggtacggtaacgttaacgtaacccggtaaaacgtacggttacggtacggtaccgttaacggacccgtactaccgttacgg

SEQ ID NO: 236645 - DNA, 567 bp, Homo sapiens
  misc_feature: GYAE6OF02F1PAU.3.35.D02.1.454.CMB.1.raw
  modified_base (288)..(288): a, c, t, g, unknown or other
  misc_feature (288)..(288): n is a, c, g, or t
tcagagacgcactccacgaccggtgctcgatttagcacacgatagttgggtttggggctttccctggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaacgcccctaactcctgatctatgatgcctccagtttgcaagtgggtccatcaagttcagcggnagtggatcgtgggacagaattcactctcaccatcagcacgcctgcacgcctgatgtattttgactaactttattacgtgaccaactagtaactaacgtacccggtcgttacggtaccggttaccgggaccgaaacgggaccgtaagggttaggaagtactacgtaagtaaccgtaacgttgtcggctacgacctaccgtattccgttacgttcttctacttcccttcccgactacgtctaggagtagtcgtcgttctcggtgacggcgggtcgtggacg

SEQ ID NO: 236646 - DNA, 652 bp, Homo sapiens
  misc_feature: GYAE6OF02FWXBY.3.35.D02.1.454.CMB.1.raw
  modified_base (245)..(245): a, c, t, g, unknown or other
  misc_feature (245)..(245): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
tcagagacgcactccacgaccggtgctcgatttagcacacgatagttgggtttgggggatcaggactcctcagttcaccttctcacaatgaggctccctgctcagctcctgggctgctaatgctctgggtcccaggatccagtggggatgttgtggtgactcagtctccactctccctgcccgtcacccttggacagccggcctccatctcctgcacggtctggtcaaacgcctcgtgtacggtnatcggaaacacctacttagtaattggtatcagcagagcagcaatcncaggcncctaatctattacggttctaaccggacgcgtcgggtcctagaccagtacttacagcggcacgtgggtcacggcacgtgtactttccgactacgtgaagtaagtacgacgtaggggtggacggtacgtaggaaggtagttacgggtttagggttaactttttacgtttcgttacggtacgttagtacggactaaacgtactaacccgtacgtaccggtacggtacccttaaccgtaccggttttacgggacccggtaacggggtacctaacggtcggtacgggaacgtacgtaaaccgtaaaccggtaacggttaggtaccgggttaccgtacgtacccgtaaccgtagttacccg

SEQ ID NO: 236647 - DNA, 607 bp, Homo sapiens
  misc_feature: GYAE6OF02HDFBC.3.35.D02.1.454.CMB.1.raw
  modified_base (284)..(284): a, c, t, g, unknown or other
  misc_feature (284)..(284): n is a, c, g, or t
  modified_base (350)..(350): a, c, t, g, unknown or other
  misc_feature (350)..(350): n is a, c, g, or t
  modified_base (414)..(414): a, c, t, g, unknown or other
  misc_feature (414)..(414): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgtggtctctggattcaccttcagggaccacttcatggactgggtccgccaggcctccgagggaaggggctggagtgggttcggccgtaataagaaacaaagctagaagttacaccanagattacgccgcgtctgtgacaggcagacttcaccatctacaagagatgattcaagcaactcagtntctctgacaaatcgaacacccgtagaacgacgacgacacggccgtactatactgcgctacagtnttactatagtagacgtctaacgacgtacgcgggtaccgacggtacgaccgttacggtaccgtaccgtcctaccgtccacgtccctacccgaccgaaccggaccctacgtccggttcccgttcccccgtcggtacccgtcccgtcgtcccgtaccgtacggtaccgacctacccgtacccgtacgaccgacccg

SEQ ID NO: 236648 - DNA, 732 bp, Homo sapiens
  misc_feature: GYAE6OF02IIWZ3.3.35.D02.1.454.CMB.1.raw
tcagagacgcactccacgaccggtgctcgatttagcacacgatagttgggtttgggccgagctgggttttcctggttgttatttacaaggtgtccagtgtgaggtgcagctggtgcagtctgggggaggcttggtccagcctggagggtccctgagactctcctgtgtggtctctggattcaccttcagggaccacttcatggactgggtccgccaggctccgagggaagggctgggagtgggttggccgtataagaaacaaagctaagaagttacaccacagattacgccgcgtctgtgacaggcagtatcaccagtctacaagagtatgtaatcaaagcaaactcaagtgtctcgtgactaaaatcggaaaccaccccgtgaaacgtacccggaaggtaaccacgggcccgttaacttaacgtaaccgttgaccggtaccttaaacgaacggtacctttaactaacgttaagttagggtacgtaccgttaaaccgtaaccggttaacgttcggggggaccctaaacggggacgtaacccggttagggtaccgtaacccggttcctacccgtacaccgtcccttaacccgaccggtaaaccgggcccctaaggttccccggttaccctttaccccccggtaacgggtccccggtaccccgttcggtaccccttaccgggtacggaccggttaccccgtaccccggtacccggacggtaccggtaaccccgg

SEQ ID NO: 236649 - DNA, 736 bp, Homo sapiens
  misc_feature: GYAE6OF02H5HTZ.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacacgccggcctccatcctcctgcaggtctggtcaaagcctcgtgtacggtgagtaggaaactacctacttgaattggtatcgagcgagaggccaggcctaactccgtaccgaaggccgtacctaatcttaagttaacggtttacctaaaccgggacgtcgtcggggtacccacggaacagtagttacgaaggtccggctacgtcgggtcgaacggtccacgtacggtactttaccaacctaacgtagtaacgtaaagttacggacggtaaggggtagggagggtacgtaggaagggtacggttaggggtttaggtttaagtttttagttttcgttacggtacgtacgttacggacgtaaacggtaccgtaactaaccgtaaccgttacgggtacccgtttaaaccgttaccggtttttaaccgggaccggttaaccgggggacccgtaacggtaccggtaggtaaccggtaactaacccggtaaaaccggtaaccgttacggttacgggtccgtaccggtaacctaccctacgttacccgg

SEQ ID NO: 236650 - DNA, 662 bp, Homo sapiens
  misc_feature: GYAE6OF02HLU7G.3.35.D02.1.454.CMB.1.raw
  modified_base (328)..(328): a, c, t, g, unknown or other
  misc_feature (328)..(328): n is a, c, g, or t
tcagagacgcactccacgaccggtgctcgatttagcacacgatagttgggtttgggggatcaggactcctcagttcaccttctcacaatgaggctccctgctcagctcctgggctgctaatgctctgggtcccaggatccagtggggatgttgtggtgactcagtctccactctccctgcccgtcacccttggacagccggcctccatctcctgcaggtctggtcaaagcctgtgtacggtgatggaaacacctacttgaattggtatcagcagaggccaggccaatcctccaaggcgacctaatctataacggtttactaaccgggngtcgtaggggtcccaggacagacttcaggccggtcacgtgggtcaggcacgttgatttcacgactagagtaagttagacgtaggggtagggagggtcgtagggtacggagttgggttagggttaagttttagtttaccgttgtactacgtacggtacgtaacggtaccttaacgacctaaccggttacgggtacccgtttaaccgtaccgtttttacggcccgggtaacgggggtacctaacgggtaccggtaagggtaacgtaacgttaaaccggtaaaccggtaaacgttcgggtacggtaccgtacggtaccctaacccgtatttacccgg

SEQ ID NO: 236651 - DNA, 526 bp, Homo sapiens
  misc_feature: GYAE6OF02GEH6O.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagaccagattcagcggcactgggtcaggcactgatttcacactgagaattagcagggtggaggctgaggatgttgggtatttagtttctgctatgcaagctacacactcggaccgtactacttttggaccgtaggggaccaaggcgtggagtagtacgaaacgactgtacggtctgcgtaccattccg

SEQ ID NO: 236652 - DNA, 569 bp, Homo sapiens
  misc_feature: GYAE6OF02JKCQQ.3.35.D02.1.454.CMB.1.raw
  modified_base (316)..(316): a, c, t, g, unknown or other
  misc_feature (316)..(316): n is a, c, g, or t
  modified_base (389)..(389): a, c, t, g, unknown or other
  misc_feature (389)..(389): n is a, c, g, or t
  modified_base (437)..(437): a, c, t, g, unknown or other
  misc_feature (437)..(437): n is a, c, g, or t
  modified_base (487)..(487): a, c, t, g, unknown or other
  misc_feature (487)..(487): n is a, c, g, or t
  modified_base (495)..(495): a, c, t, g, unknown or other
  misc_feature (495)..(495): n is a, c, g, or t
  modified_base (509)..(509): a, c, t, g, unknown or other
  misc_feature (509)..(509): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgtggtctctggattcaccttcagggaccactttcatggactgggtcccgccaggctccgagggaagggctgggagtgggtgccgtataagaaacaagctagaagtacaccacagattacgccgcgtctgtgacaggcagattcacatcncaagagatgattcaagcaacctcagtgtctcgtagactaaatgaaactacccgtagaacgtaaccgacgaacnccggaccgtactattacgtgcgctacgagtacttacatagttacgganactaacgactacgtacgggaccacggacgacctggccgtaccgtcctccncaccgccnccaccgacgtaccncgtcgtcctcccggtcgcctccgtcctcgtccgacggcacccgcccgacgtacgagaccg

SEQ ID NO: 236653 - DNA, 864 bp, Homo sapiens
  misc_feature: GYAE6OF02GBZL5.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctgggtcccaggatccagtggggatgttgtggtgactcagtctccactctcctgcccgtcacccttggacagccggcctccatcctcctgcgaggtctggtacaaacgtcctcgtagtacggtgagtaggaaacacctacttagtaagttggtatcagcaggacggaccgaggacctaatcctaccgaacgggccgtacccgtaaacttctaaacgttaacgggttttacccgtaaacccggggtaaccggtccggttacgggggtacccctaacggaacgaacggtaactttccgaacgggtccggaccgtaacggttcggggtaccgaacgggaccgtaacccgttgttaaccgttttaccgaaccgtaaccgtaggtaaacggttaaaacgtttaacgggtaaccgggttaaggggggtacggggtaacggggtaccggtaagggtaaggggttaaggttaggggttttaggggggttttaacttttttaacgtttttaccggttacggtactaacggtttagggaaccgtaaacggtacccgttaaccgtaaaccgtaccggttaccgggttaccccgttaaaccgtttaccgggttttttaccgggacccgggttaacgggggtaacccgaaccgggttaccggtaacggggtaaacgttacggtaaaacccgtaaaaccggttaacggttacgggttcgggtaccgttcggaacccgtaccgtaacgtttccgg

SEQ ID NO: 236654 - DNA, 631 bp, Homo sapiens
  misc_feature: GYAE6OF02JX4KB.3.35.D02.1.454.CMB.1.raw
  modified_base (335)..(335): a, c, t, g, unknown or other
  misc_feature (335)..(335): n is a, c, g, or t
tcagagacgcactccacgaccggtgctcgatttagcacacgatagttgggtttgggggatcaggactcctcagttcaccttctcacaatgaggctccctgctcagctcctgggctgctaatgctctggtcccaggatccagtggggatgttgtggtgactcagtctccactctccctgcccgtcacccttggacagccgcctccatctcctgcaggtctggtcaagcctcgtgtacggtgatggaacacctacttgaattggtatcagcagacggccaggaccaatcctacgaacggccgacttaatctaagttaacggtttcgtaaccgggacncgtcgggtcccagacagactcgagcggctacgtcggacgagctacgtcgtatttacactacgtagacgtaagttacgacgtacggggtggtaacggtcgtaggtaaggagttaggttaggttatttagttcgtagtacgtacgtcgacgtaagtacctacgtaccacgttaccggaccgttaccgtacgttttacggaccgtaacggggacctaacggtacgtaccggaagttacgtaacccgtaaacgtaaccgttacggtacggtaccgttacgaccggtaccctgttaaccgg

SEQ ID NO: 236655 - DNA, 594 bp, Homo sapiens
  misc_feature: GYAE6OF02I6BTL.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctaccaaggcgcctaatctataaggtttctaaccggacgcgtgggtccccagacagattcagcgcacgtggtcaggcactgactttcacatagagtaatagcgtagggtggaggcgtggaggtagtggttagggtatttagtttactgtacgtatcgtacgaacgtacctaacgtaccgtacgtacgggtacccgttaactacgttttaccggaccgtaacggggacccaaggtcgtagggtaacgtagtaacgaaaccggtaacgttacggtacggtaccgtacgaccgaccctagtttacccg

SEQ ID NO: 236656 - DNA, 589 bp, Homo sapiens
  misc_feature: GYAE6OF02HULWB.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgataggaaacacctacttgaattggtatcagcagaggccaggccaatctccaaggcgacctaatctataacggtttctaaccgggcgcgtggggcccagacagattcgagcggcacgtgggtacaggcacgttgtactttacactactagaagtaattacgacgtagggtagggaggcgtaggaggtagttgggttagggttatttttagttctgctatcgacaaagtccttacaccgtacgtcgggaccttacgtacgtttggaaccgacgggtaaccaggtcgtaggacgtaacgtaccgtaaaccggtagttacggtcgggtctacggtccacgtacttaccg

SEQ ID NO: 236657 - DNA, 774 bp, Homo sapiens
  misc_feature: GYAE6OF02F3H9O.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacacgccggcctccatctcctgcaggtctggtcaaagcctcgtgtacggtgatacggaacacctacttagaattggtatcaagcagacggccaggacctaatcctacccgaaaggccgtaccttaatacctaagtttaaacggttttccgtaaaccggggacgtacggttacgggggtaccccaaggacgaacgtactttacgacggccgggtacaaccggttcggggtaccaacggggacctaaccgtacggttaactttaccgaacctaacgtacggtaaacggtaaagtttaacggaccgggtaagggggttacgggacggggttaccggttagggtaacggggtaggttagggtttaggggtttaagtttttaacgttttcgtacggtacctaaggttcggaacgtaacgtaaccgttaacctacgtaaccgttccgggtacccgtttaaccgttaacggtttttccggaccgggtaacggggtaccctacgggtaccgttagggaacgttaacgtaacccgtaaacggtaaccggttgtaccgggtccttacggaccctaaccgtacgtttaccg

SEQ ID NO: 236658 - DNA, 598 bp, Homo sapiens
  misc_feature: GYAE6OF02H9VOF.3.35.D02.1.454.CMB.1.raw
  modified_base (476)..(476): a, c, t, g, unknown or other
  misc_feature (476)..(476): n is a, c, g, or t
  modified_base (592)..(592): a, c, t, g, unknown or other
  misc_feature (592)..(592): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtacaaagcctcgtgtacggtgataggaaaccacctacttgaattggtatcagcagaggccaggcccaatcctaccaaggccgtacctaatctaacgtaacggttttaccgtaaccggggtacgccgtcggggtaccccagaccgagtacttcgagcggacacgtgggtcaggcagtgtacttcactacgtgagtaattaggcgagggtggacggtcgtaggaggtagttggttaggttattttattcgttgngtagtgacacgtactacacacgtcggccgttacgtacgtttcggaccgtacgggaccgaacggcgtaggacgtagtaaccgtaaacgtaacgtcggtaggaccgtgacctaccgtnttaccg

SEQ ID NO: 236659 - DNA, 543 bp, Homo sapiens
  misc_feature: GYAE6OF02FY20G.3.35.D02.1.454.CMB.1.raw
  modified_base (327)..(327): a, c, t, g, unknown or other
  misc_feature (327)..(327): n is a, c, g, or t
tcagagacgcactccacgaccggtgctcgatttagcacacgatagttgggtttgggggatcaggactcctcagttcaccttctcacaatgaggctccctgctcagctcctgggctgctaatgctactgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggtccaggccaatctccaaggcgcctaatctataaggttctaaccgggcncgtgggtccccagacagattcagcggcacgtggtcaggcactgatttcactactgagaattagacgagggtggagcgtgaggagtggttgggtatttagtttcgtgtcagtgacaaggctacacacgtggccgttactacgttttggaccgtagggacccaagcgtggactagtaccgaaacgtacgtggtacggccgttagacctaccattaccg

SEQ ID NO: 236660 - DNA, 620 bp, Homo sapiens
  misc_feature: GYAE6OF02JYKBC.3.35.D02.1.454.CMB.1.raw
  modified_base (309)..(309): a, c, t, g, unknown or other
  misc_feature (309)..(309): n is a, c, g, or t
  modified_base (337)..(337): a, c, t, g, unknown or other
  misc_feature (337)..(337): n is a, c, g, or t
  modified_base (415)..(415): a, c, t, g, unknown or other
  misc_feature (415)..(415): n is a, c, g, or t
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
tcagagacgcactccacgaccggtgctcgatttagcacacgatagttggggtttgggggatcaggactcctcagttcaccttctcacaatgaggctccctgctcagctcctgggctgctaatgctcgtgggtcccaggatccgagtggggatggttgtggtgactcagtctccactctcctcgcccgtcaccgttggacacgcccggcctccatctcctgcaggtctggtacaaacgcctcgtgtacggtgataggaacacctacttagaattggtatcagcagtaggccaggaccaatctccaaggcncctaatcgtaataggttctaaccgggcncgtgggacccagacagtattcgaggcggactacgtgggtacagggtccagtgtaacttcgacacgtgacgtaatcganagggtaggngtacgnggaggtacgtggttaggatttaagttcgttgactagtagactaacgtactacgacgtacgtcggtaccgttagtacgtttacgggcgtaaccgggtacgtaacggtacggtaaggaacgtaacggttaaccgtaaacggtaaccggttcgggtacggtaccgttacggacccttaaccgcgtttaaccgg

SEQ ID NO: 236661 - DNA, 616 bp, Homo sapiens
  misc_feature: GYAE6OF02IUGIE.3.35.D02.1.454.CMB.1.raw
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgtggtctctggattcaccttcagggaccacttcatggactggggtccgccaggctccgagggaaggggctggagtgggtggccgtataagaaacaagctagaagttacaccacagattacgccgcgtctgtgacaggcagattcaccatctcaaagagatgattcaagcaactcaagtgtctctgacaaatgaaccaccctagaaacgaccgaggacaccgggtccgtactacttacgtcgcgacctacagtatttacattagttaggatctaacgacttagtcggggaccacgggacgaccgtcggtacctacccgtctccctcgaccgtccctacccgaacccgaacgggccccacgtcccggttccctttacccccggtcgggtacccctccccgtacgtcccgtcccgacgggaccgcccgtacccgtcccggagtaccgaccgg

SEQ ID NO: 236662 - DNA, 524 bp, Homo sapiens
  misc_feature: GYAE6OF02FW115.3.35.D02.1.454.CMB.1.raw
  modified_base (509)..(509): a, c, t, g, unknown or other
  misc_feature (509)..(509): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctactgaattggtatcagcagaggccaggccaatctccaaggcgcctaatctataaggtttctaaccgggacgctggggtcccagacagattcagcggcacgtgggtcaggcactgatttcacactgagaattagcgaggggtggaggctggaggtatggttgggtatttagtttctgtctatggcaagtctactacacgtggacccgtactacgttttgaccgacgggaccaggctgggagatacaacgactgnggctggcacattccg

SEQ ID NO: 236663 - DNA, 585 bp, Homo sapiens
  misc_feature: GYAE6OF02JENUJ.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctaccaagcgcctaatctataaggtttctaaccgggacgcgtggggtcccagacagattcagcgcactgggtcaggcactgatttacacactgaagaattagcgaggggtggaggctagaggagtggttgggattttatttcgtgctagttcgacgaagtacctaacgtacacgttcgggtacccgttaacgtaccgttttcgggaccgaacggggtaccaacggtccgtaggaacgtaacgtaccgaaaaccgtaacgttacggtacgggaccttggaccctaccgtacttaccg

SEQ ID NO: 236664 - DNA, 610 bp, Homo sapiens
  misc_feature: GYAE6OF02HQPXT.3.35.D02.1.454.CMB.1.raw
  modified_base (375)..(375): a, c, t, g, unknown or other
  misc_feature (375)..(375): n is a, c, g, or t
  modified_base (396)..(396): a, c, t, g, unknown or other
  misc_feature (396)..(396): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagcccggcctccatcctcctgcaggtctggtcaaagcctcgtgtacggtgagtaggaaaccaccttaacttggtaaattgggtaatcagcaggacggccaggccaatcctccgaaggcgacctaatctaataaggtttctaaccgggacgcgtcgggtcccagacagattcgagcgacncgtggcaggcactgtattcanactgagtaattagcgtagggtggaggcgtaggaggtagttggttagggttattttagtttcgtgtactactgactaacgctacacgtacgtacggtaccgttacgtacgttttcggacccgtacgggtaccgtaacgtccgtagggtataacgtaaccgtaaaaccgtaacgttacggtcggtaccgttacggtacctaccgtagtttaccccg

SEQ ID NO: 236665 - DNA, 580 bp, Homo sapiens
  misc_feature: GYAE6OF02F811U.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctaccaaggcgcctaatctaataaggtttctaaccgggacgcgtcggggtcccagacagacttcagcggcacgtggtcaggcactgactttacactactgagaattagacgtaggggtggaggcgtaggaggagtggttagggttattttagtttcgttgtacgtataggtacgaagtactaactacacgtcggaccgttactacgtttacggaccgtaacggggacctaaggtcgtaggaacgtacgtaacgaaacgaacgtagtacggcgtacgaccgtactattaccg

SEQ ID NO: 236666 - DNA, 617 bp, Homo sapiens
  misc_feature: GYAE6OF02HXS9U.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacaccttacttgaattggtatcagcagaggccaggaccaatcctacaacggccgacctaatactaagtaaggttttccgtaaccgggacgcgttcggggtaccccagacagacttcgacgcggcacgtgggtacacggacacgtagactttcaacactagagtaattagcgtagggtgggagtcgtaggaggtagttggttagggttagtttttatttcgtgtactagtcgagtaacgtacttacacgtacgtcggacccgttaacgttacgtttcgggaccgtacggggacctaaggtccgtaaggacgtaagtaaccgtaaacggacgttacggtcggtaccgtcggaccgtaccgtagttaccg

SEQ ID NO: 236667 - DNA, 651 bp, Homo sapiens
  misc_feature: GYAE6OF02G7U6L.3.35.D02.1.454.CMB.1.raw
  modified_base (214)..(214): a, c, t, g, unknown or other
  misc_feature (214)..(214): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgtggtctctggattcaccttcagggaccacttcatggactgggtccnccaggctccgagggagggctggagtgggtgccgtataagaacaagctagaagttacaccacagattacgccgcgtctgtgacaggcagacttcaccatctacaagagatgattcaagcaactcagtgtctcgtagactaaatcgaacctacccgtagaacgaccgaacggaccgaccgggtcccgtacttaacttaccgtcgaccgtaccgtaacgaacgtacttacctaagttaacgttcgggacgtaccgtaacggtaccgttaacggttcggggaccctaacgggtacgtacccgtgggttacccaccggttcctacccgtcgaccgtccctacccgaacccgaacgggccctacgttcccggttcccttccccggtcggcccgtcccgtcgcccgtaccgacggtccgaccacccggtccggacgacgacccg

SEQ ID NO: 236668 - DNA, 591 bp, Homo sapiens
  misc_feature: GYAE6OF02GEL6O.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataggttactaaccgggacgcgtgggtcccagacgagattcagcggcacgtggtcaggcacgtgtacttcactactgagtaatagacgtagggtaggtaggtcgtaggacggtagttaggttgggttattttacgtttcgtcgtgtagtcggacgtaacgtctaacgacctacgtacggtaccgttaacgtacgttttcgggaccgtacggggtaccctaacggtcgtagggaacgtagtaaccgaaacgtacgtagtcggtactaccgacgtacctagttcccg

SEQ ID NO: 236669 - DNA, 757 bp, Homo sapiens
  misc_feature: GYAE6OF02GJM7R.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccactcgtcctgcaggtctggtcaaagcctcgtgtacggtgatggaacacctacttgaattggtatcagcaggacggccaggccaactctccgaaggcgtaccgtaatcttaagttaacggtttaccgtaaccgggtaccgtccggtcggggtaccccaaggaccaggtacttaccgacggccggacgtacgtacggggtacagggtctaacgttggtaactttaccgaaccgtaccgttaggaaacggttaaagttaacggcgggtaaggggggttacgggaacgggtcgttacgggtaaggggttgttacggggtttaggggtttaacttttaacggtttttcgacggtacgtaagttcgggtaaccgtaaaggtaccttaaaccgtaccgtaacgttcggggttacccctttaacggtttacccggtttttaccgggacccgggtaacgggggtaccctaaacgggtcggttaacggggaagtaccggtaaccgtaaaaccggtacggttacggttcggtccgtacgtacccggtaccttaagttcccg

SEQ ID NO: 236670 - DNA, 723 bp, Homo sapiens
  misc_feature: GYAE6OF02HHSP2.3.35.D02.1.454.CMB.1.raw
  modified_base (163)..(163): a, c, t, g, unknown or other
  misc_feature (163)..(163): n is a, c, g, or t
  modified_base (196)..(196): a, c, t, g, unknown or other
  misc_feature (196)..(196): n is a, c, g, or t
  modified_base (213)..(214): a, c, t, g, unknown or other
  misc_feature (213)..(214): n is a, c, g, or t
  modified_base (221)..(221): a, c, t, g, unknown or other
  misc_feature (221)..(221): n is a, c, g, or t
  modified_base (225)..(225): a, c, t, g, unknown or other
  misc_feature (225)..(225): n is a, c, g, or t
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (263)..(264): a, c, t, g, unknown or other
  misc_feature (263)..(264): n is a, c, g, or t
tcagagacgcactccacgaccggtgctcgatttagcacacgatagttgggtttgggggagtcaggactcctcagttcaccttctcacaatgaggctccctgctcagctcctggggctgctaatgctctgggtccaggatccagtggggatgttgtggtgactnagtctccactctccctgcccgtcaccttggacncgccggcctcatctccnncaggtcngtanaancctcgtgtagtganggaacacctatgaagttgtannagcgagagccagcaatcaccgaaggcctactaactacgtaacgttaacggttttccaaaaccgggcgaccggtcggggtacccaaggaaccgtagaacttcgacgacggtacgtaacggcgggtacacgggtactaccgtgtaaactttcccaacgtaacgttcgaaacggtaaatttacgggacgtaaaggggggtcggtaagggacgtacggaagggtaaacgtttgggttaaggggttaacttttttaacgtgttacggtaactggtaacgtccggaaattccgttaaaccgacgttacggtaccgggtaccgttaaccgttaacgtttttcggggacccggttaacgggggaacccagggttaccgtaaggtacccgggtaaattaaacccgaaaaacgggtacctttaggggcccggtacgtttaccgggaaccctaacgttaggtttaacccc

SEQ ID NO: 236671 - DNA, 593 bp, Homo sapiens
  misc_feature: GYAE6OF02I6N2Y.3.35.D02.1.454.CMB.1.raw
  modified_base (213)..(213): a, c, t, g, unknown or other
  misc_feature (213)..(213): n is a, c, g, or t
  modified_base (362)..(362): a, c, t, g, unknown or other
  misc_feature (362)..(362): n is a, c, g, or t
  modified_base (571)..(571): a, c, t, g, unknown or other
  misc_feature (571)..(571): n is a, c, g, or t
tcagagacgcactccacgaccggtgctcgatttagcacacgatagttgggtttgggccgagctgggttttcctggttgttatttacaaggtgtccagtgtgaggtgcagctggtgcagtctgggggaggcttggtccagcctggagggtccctgagactctcctgtgtggtctctggattcaccttcagggaccacttcatggactgggtccnccaggctccgagggaagggctggagtgggttgccgtataagaaacaagctagaagttacaccacagattacgccgcgtctgtgacaggcagattcaccatctcaagagatgattcaagcaactcaagtgtctctgactaaatgaaaccncccgtagaaacggaccgaaggaccaccgggtccgttactaattactcgtcgtactacagtattcatagttggaatacgtacgtactacgtcgggaccgtacggacgtaccgtcggtacgaccgtctacctcacgtaccctccaaccgaacggccctacgtccgtcccgttccccgtacggccgtaccctcgtccgtaccgacggtaccnccgacccgtccgacgacgaccg

SEQ ID NO: 236672 - DNA, 604 bp, Homo sapiens
  misc_feature: GYAE6OF02GMUT1.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcagtctggtcaaagcctcgtgtacggtgatggaaacacctacttgaattggtatcagcagaggccaggcccaatctccaaggccgacctaatcctagtaacggtttacgtaaccgggtacgcgtcggggtcccacgacagacttcgacgcggcacgtggtcgagcactgatttcacactgagaattagcgtagggtggaggctaggaggagttgggttgggttaattttacgtttctagtctaagttgacgtaagacctaaccaccgtaacgttccgggtaccgttaacgtacgttttccggacccgtaaggggtaccgaaggtccgtagggactaacggtacaaacggtaacgtcgggttacggtaccgtagtacctaccgattcccg

SEQ ID NO: 236673 - DNA, 606 bp, Homo sapiens
  misc_feature: GYAE6OF02GRBSO.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccgaaggcgcctaatctataaggtttctaaccgggacgcgtcggggtcccagacagattcgagcggcacgtggtcgagacacgtgactttcactacgtagaagtaattaggcggtaaggggtagggaggtcgtacggtaagggtagttgggtttaggggttattttagtttcgtgtactagtcgacgtaagtaccgtacctacgaaccgtcggtaccgttaacgttacgtttaccggaccggtaacggggacccaaggtcgtaagggacgtaacgtacgaaacgtacgtagtacggccgtgacctacctattccg

SEQ ID NO: 236674 - DNA, 737 bp, Homo sapiens
  misc_feature: GYAE6OF02G916U.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacacgccggcctccatcctcctgcaggtctggtcaaagcctcgtgtacggtgatggaaaccacctacttgaattggtatcgagcagaggccaggaccaatcctaccgaaggcgaccgtaaatcctaattaaacggtttaccgtaaaccgggacgcgtcggggtcccaagacagtattcgagcgcacgtgggtacaggacacgtgtactttaccactacgtaggaagtaaacgtttaaggacggtaaggggttcgggaagggtcgttacgggaagggttacgttggggttaggggttaactttttaacgttttcgtagtaccgtaatcggtacctaaaggtaccttaaaccgtaaccgttaacggttaccgggtaccccggtttaaaccgttaccggtttttacggggaacccggtaacggggggtacccctaaagggtcccggttaggggtaaaccgttaaagttaacccggaaaaaccggttaaccggttaggggttaccgggtacgttacccggaacccgtacccggttactttacccggg

SEQ ID NO: 236675 - DNA, 897 bp, Homo sapiens
  misc_feature: GYAE6OF02JEIMQ.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcacggtctggtcaaagcctcgtgtacggtgatcggaaacacctacttgtaagttgtatcagcgaggaggccacggaccaatcctaccgaaggccgaccttaagtactaagttaacggtttccgtaaccgggacgtcggtacgggtacccgagtactaggtacttcgaacggtccggactaacggttcgggtacgacgggtaccgtaaccgttacgttaactttaccgaacgtaacccgtttaggaacgtaaacggtttaacggtaccgggtaaggggggtttacggaacggggtaccgttagggggtaaacgggttaacgtttacgggggttttaacgggggtttaacttttttaacggttttacccggttaggtaacccgtttaacggtacggtaaacccgttaaaccgggtacccgttttaaaccgtaaacccgttaacccgggttaccggggttaacccccgtttttaaccggttttaaaccccggggttttttacccggggaacccggggttaaaccgggggtaaaccccgtaaaggggttcccggtttaaacgggggtaaacccgtaaacggttttaaaccccgggaaaaacccggtttaacccggtttcggggttaacgggttaacccccgttaacgggtaaccccgttaaacccggtttccggtttaaaccccgg

SEQ ID NO: 236676 - DNA, 582 bp, Homo sapiens
  misc_feature: GYAE6OF02GARE8.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctgggtcccaggatccagtggggatgttgtggtgactcagtctccactctccctgcccgtcacccttggacagccggcctccatctcctgcaggtctggtcaaacgcctcgtgtacggtgatggaaacacctacttgaattggtatcagcagagccaggccaatctccgaaggcgtacctaatctaagttaacggtttacgtaaccgggacgcgtcgggtcccagacagacttcagcggcagtggcaggacacgtgtattcgactacgtgacgtaagtagacgaggggtagaggcgtaggtaggagttggttggttattttattctgactatgactaacgactaacacgtacgtcggtaccgttacgtacgttttacgggaccgaacgggtacctaggacggtggaacgtacgtacgaaaccgtagtacggtcgtacgtcggacctacctcgttaccg

SEQ ID NO: 236677 - DNA, 707 bp, Homo sapiens
  misc_feature: GYAE6OF02H9MSQ.3.35.D02.1.454.CMB.1.raw
  modified_base (216)..(216): a, c, t, g, unknown or other
  misc_feature (216)..(216): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgtggtctctggattccaccttcgagggaccacttcatggactgggtccnccaggctcgagggagggctggagtggtggcgtataagaaacaagctagaagttacacacagtattacgccgcgtctgtgacaggcagtacttcacctatcctacaagagatgaattacaagacaactcagtcgtactctacgacaaatcgaaccaccgtagaaacggacccgtaaggaaccaaccgggtcccgttaatacgttaccgtacgaccgtacgtaacgtaacgtacttactaagttagttacgggaagtaccgtaaccgtaacgtacggtacgggaacccgaacggtacgtaccgttagggtacccgtacccgttaccgtacccgtaccgtccgtaccccttacccgaaacccggtaacccggtacccgtaaccgttcccgggttccccgtttaccccccggtcggtaccccgtccccgttaccgtaccccgttccgaacggacccggtacccgtaaccccggtaccggaccggtacggaccccg

SEQ ID NO: 236678 - DNA, 610 bp, Homo sapiens
  misc_feature: GYAE6OF02IKP73.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgataggaaacacctacttgaattggtatcagcagacggcaggccaatcctaccaacggcgacctaatctaattaacggtttaccgtaaaccgggacgcgtacggggtccccagacagtattcgacgcggacacgtggcaggcacgtgtacttcactactgaagtaattagcgtaaggggtggacggtcgtaggaggtagttgggttagggttaatttttacgttctgtactagtgactaacggtattacccacgtaccgttacggacccttacgtttaacgtttccgggaccgtaacgggacctaacggtcgtacgggtaacgactaaccgaaacgtaagtcggtcggacctgacctacctattccg

SEQ ID NO: 236679 - DNA, 654 bp, Homo sapiens
  misc_feature: GYAE6OF02H7UEB.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatcctcctgcaggtctggtcaaacgtcctcgtgtacggtgatggaaacacctacttgaattggtatcagcagaggccaggaccaatcctaccaaggccgacctaagttcttaataacggtttccgtaaccgggacgtcgtcggggtaccccagacctagtacgttaccgaaggccggacacggttcgggtacgaggcctacgtacgtactttccactaccgtagagtaagttacggacgaggggttgggacggtcgtaggtaggtagttacgggtttagggttatttttagttcgttagtactagtagacgtaagtacctactaaccacgtcgtaccgttacgttacgttttaccggaccggtaacgggacgacggtacggtggtaacgtacgtaaccgtaacgtacggttacggtacggtacgtcgaaccgtaccgtagtttaccg

SEQ ID NO: 236680 - DNA, 710 bp, Homo sapiens
  misc_feature: GYAE6OF02H1SBY.3.35.D02.1.454.CMB.1.raw
tcagagacgcactccacgaccggtgctcgatttagcacacgatagttgggttttgggggatcaggactcctcagttcaccttctcacaatgaggctccctgctcagctcctggggctgctaatgctctgggtcccaggatccagtggggatgttgtggtgactcagtctccactcctccctcgcccgtcacccttggacagccggcctccatcctcctgcaggtctggtacaagcctcgtgtacggtgataggaaactacctaacttagaattaggtatcgagcgacggacggaccgaggaccaaacgtcctaccgaaaggccgacctaaacttacttaaagtaaacggttttaccgtaaacccgggtaccggtaccggttacgggtaccccgaggtaaccgagtaacgttacgacggtcggacgtaccggtacgggtacgaggaccgtaacttaggtacttttacaacctacgttagaagtaaacgtttaggacggtaggggtagggaggtcgtaggaggtagttgggttaggttagttttactttctagtactagtacaacgtaacgacttaacgaacgttaaccgtcgggtaccttaaccgttacggtttccgggaccgtaaacgggtactaacggacgtaacggaagttaactaaaccgaaaacgtaacggttacggtcggtacctaggacctaaccctagtaccg

SEQ ID NO: 236681 - DNA, 849 bp, Homo sapiens
  misc_feature: GYAE6OF02IZFI6.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctcctcgcccgtcaccttggacagcccggcctccatctcctgctaggtcgtagtcaaacgtcctcgtgtacggtagatacggaaacctacctacgttacgtaatttcgggtaatcgtaagccgtaaggtaccggacccgtacgggacccaaacttaccctacccggaaagggtccctaccgttaaactacgtaaacggtttaaaccggttttaccggtaaaccgggaccgttcggtaccgggggtaccccaaggaaccgtaacggtaccttacgaacgggacggacctacggtcgggttaacgacggtactacgtacggttaactttcccgaacgtaaccgttaggtaaccgtaaacggtttaacggaccgggtaacgggggtacgggaacgggtcggtaacgggtaagggtaacgggtttagggttaacgggtttaacgtttttaacggtttacggtagtaaccgttaggtacgtaacgaacgggttaccctaaaccggtaccgtaaccgtttaccgggtaacccggttttaaccgttaccggtttttaaccggggacccgggtaacccgggtaaccggttaaacggtccggttaacgggtaactaacggtaaccgtaaaaccggtacggttggtaaccggtacgtacggtaaccgtaccgttaccgtttaccgg

SEQ ID NO: 236682 - DNA, 781 bp, Homo sapiens
  misc_feature: GYAE6OF02IYWES.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctgggtcccaggatccagtggggatgttgtggtgactcagtctccactctccctgcccgtcacccttggacacgccggcctccatctcctgcaggtctggtcaaacgcctcgtgtacggtgagtacggaaacctacctacgttgtaacgttggtactcagcaggagccaggcctaactccgtaccgaaggccgacctaacttactaagttaacggtttaccgtaacccggggacgtccgtcggggtaccccaagacacgtacttacgaggccggactacggtgggtacagggacctactcggtaacttttccaccctaacgtacgaaggtaaactttaacggacggtaaggggttcgggaagggtccgttagggtaacgggttagtttacggggtttaggggtttaaagttttttacgttttccgttagtaccgtacggttacggtaaccgtaaacgttacccgttaaccgtaaccgtaccggtttaccgggtaacccgttaacccggtttaacgtttttaccggggacccggtttaacgggggaaccccgtaaacgggttaccggttacgggtaaacgtaaaccgtaaaccggtaaaaccggtaacgttaccggttacgggtacctaacgggtcccgtaaccctacgtttacccgg

SEQ ID NO: 236683 - DNA, 715 bp, Homo sapiens
  misc_feature: GYAE6OF02HKBI7.3.35.D02.1.454.CMB.1.raw
  modified_base (290)..(290): a, c, t, g, unknown or other
  misc_feature (290)..(290): n is a, c, g, or t
tcagagacgcactccacgaccggtgctcgatttagcacacgatagttgggtttggggatcgaggactcctctagttcaccttctcacaagtgagctccctgctcagtctcctgggcctgctaatcgctcgtggtccaggatccagtgggatgttgtggtgactcgaagtctccactctcctgtcccgtccaccgttggaccacgccggccttccgacttcctccgtagccgtaggtctggtactaaagcctcgtgtacggtgagtcgaaactctattgtaagttcgtacnagcagcgcaggacctaatcacgaacggcgtacctaatcctaagttaacggtttcgaaaccgggcgtcggtcggtccacgacgtagacttacgaacgtacggactacggtcggtacgaaggactaacgtcgtagttccaacgtacgtagaacgtaagttacggaacgtagggtagtacgtcgtagggtacggtagttggttaagggttacttttagtttccgtacgtacgttaacggtcggtaacaacggtttaccgaacgttaccgtaacgtttcggtaccccgtttaagttacccgtttacgggacccgtacggggttaaccccgaggttacccgttagggtaactaaccgttaaacccggtaaaaccgtacgttacgggttaaccggccgtttaaaccggaccctaccgtaccgtttaaccgg

SEQ ID NO: 236684 - DNA, 590 bp, Homo sapiens
  misc_feature: GYAE6OF02HOYRW.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacacgccggcctccatctcctgcaggtctggtacaaagcctcgtgtacggtgataggaaacacctacttgaattggtatcagcagacggccaggccaatcctaccgaaggccgacctaatactagtaaggtttacgaaccggacgcgtacgggtcccagacagtacttcgacgcggctacgtggtacaggcacgtgtactttcaacacgtagagtaagttagacgtagggtggaggctaggaggtagtggttaggttattttacttcgtgactagtacgaactagtacctacgtacacgtcggtaccttacgttacgttcggacgacgggtacagtcggtaggaacgactaaccgaaacgtacgtacggtcgtacgtacggaccctaccgatttcg

SEQ ID NO: 236685 - DNA, 701 bp, Homo sapiens
  misc_feature: GYAE6OF02G4GQC.3.35.D02.1.454.CMB.1.raw
tcagagacgcactccacgaccggtgctcgatttagcacacgatagttggggtttgggggatcaggactcctcagttcaccttctcacaatgaggcctccctgctcagctcctggggctgctaatgctcgtgggtcccaggatccaggtggggatggttgtggtgactcagtctccactctccctgcccgtcacccttggacacgccggcctccatctcctgcaggtctggtacaaagcctcgtgtacggtgagtacggaaactacctacttgaattggtaatcgagcaggacggccaggccaatctacgaaggccgacctaatactaagttaacggtttaccgtaaaccgggacgtccggtcggggtaccccagtacgagtactacgagcggacacgtgggtacacgggctaacgtgtaatttcaaccgtagtacgaaagtaacgttaggacggtaaggggtaggacggtacgtaggaagggtagttagggtttagggttaattttacgtttacgtagacgtagtacggtacgtaacgtactaaccgtacgtaccggttacgggtacccgttaacgtttacggtttaccgggaacccggtaacggggtaaccctaaggtccggtaacgggtaacgtaccgttaaacgaaaaccggtacggtacggtacggtaccgttaacggaccctaccgtacttaccgg

SEQ ID NO: 236686 - DNA, 697 bp, Homo sapiens
  misc_feature: GYAE6OF02IH3GM.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccgcctccatctcctgcaggtctggtacaaacgcctcgtgtacggtgataggaacacctacttgtaattcggtatcagcaggacggccaggacctaatccgtaccgaaggccgtacctaatacttaagttaacggtttaccgaaccgggacgtccggttcggggtacccaaggaccaggtacttcgacggtccggacgtaccggtcgggtacgaacgggcctaacgtcgttaactttcgaacctacgtagaacgtaagtacggacggtaggggtacgggtaggtcgtaggaggtgttagggttagggttatttttagttcgttgtacgtagtacgtacgtaacgtactaacgacgtacgtacggtacccgttaacgtttaccggtttccggtaccggtaaccggggtaacgtaacggtcgggtaaacggaacggttacgtaaaacccgtaaaccgtacgggttcgtaacgggtccacggtaccgtactacgtttcccgg

SEQ ID NO: 236687 - DNA, 731 bp, Homo sapiens
  misc_feature: GYAE6OF02HDCPB.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctcgcccgtcacccttggacacgccggcctccactctcctgcacggtctggtacaacgcctcgtggtacggtgatacggaaacacctacttagaattggtatcgagcaggacggccgacggaccaatccgtaccgaagggtccgaccttaaactaccttaagttaaacgggttttaccgaaaccggggtaccgtcggttaccggggtacccaacggtaaccgagtacgtttacgacggtcggccgacggttacgggcgaaggctaacgtgtaacgtttacaacctacgtcgaaggtaaagttaggacggtaaggggtgggaacgggtcgtagggaacggtagttcgggtttaaggttacttttagtttcgtcgtacgtagtcggtacgaaacgtaccgttaccaaccgtacgtaccgggttaccgttaaccgttaccggttttacggacccgggtaacgggtaccgtaacggtccggtaagggtaacgtaagtaacccgtaaaaccggtacgttaccggtacggtccgtacggaaccctaccgacgtttacccg

SEQ ID NO: 236688 - DNA, 681 bp, Homo sapiens
  misc_feature: GYAE6OF02IEVNO.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcaccttggacagccgcctccatctcctgcaggtctggtacaaagcctcgtgtacggtgataggaaaccaccttacttgtaaagtttggtatcagcagaggccaggccaatcctaccaaggcgacctaatctaataacggtttcgaaaccgggacgcgtcggggtcccaaggacagtacttcgaggcggactacgtgggtacacggtcacgttgtaactttccacgtaaccgtagaacgtaagtttaacggacggtaaggggtacgggagggtacgtaggtaacgggtagttagggtttgggttaagtttttacgttttcgttgtactacgtaggtacaacggtacctaacgtaaccgtacggttacggtaccgttaaccgttaccggttttacggacccggtaacggggacccgtaacggtcggtaaggtaacgtaacgtaaccgtaaaaccggtaacgttcggtacggtaccgtacggacctacccgtattaccg

SEQ ID NO: 236689 - DNA, 736 bp, Homo sapiens
  misc_feature: GYAE6OF02IC2TB.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactcctccctgcccgtcacccttggacacgccggcctccatcctccttgagtcgtggtacaaagcctcgtgtacggtgatacggaaactacctacttagaatttaggtatcagcagaggccgaggaccaatctccaaggacgccctaaatcttaagttaacggtttacgtaacccgggacggcgtcggggttaccccagacgagtactttacgcggacggccacgtcgggtacgacggcctacgtgtacttttacaaccacgttcggaaagtaacgttaagaccggtaggggttagggaacgggtcgtagggtaaagggtagtttagggtttaggggtttaagtttttaacgttttcgttcggtacttagttacggaacctaaggtacctaacgtacctacgttaccgggtaccttaaccgtttaccgttttacgggaccgggtaacccggggtaacgtaacgggtacgtacgggtaacggtaacgttaacggaaaacccggttaacgttcggggttaacggtcccggttacggtacccgaacccgttacgttaccgttttaccgg

SEQ ID NO: 236690 - DNA, 729 bp, Homo sapiens
  misc_feature: GYAE6OF02HIQNY.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccattcctcctgcaggtctggtcaaagcctcgtgtacggtgatggaaacacctacttgaattggtatcagcgagaggccaggccaatctccaaggcgtacctaatctaagtaacggtttaccgtaaccgggacgtccggtacggggtacccaggaactacgagttaccgagccgggacctacgtacgggtacacgggacctaacgttacgtacttttaccgaactaaccgttagaaggtaaattacggcgtaaagggggttgggacgggtacgtagggacgggtagttcgggttagggttaatttttacgtttccgtagtacgtacgttcgactaaaggtacccgttaacaaccgtacgttaccggggtaccccttaaacgttaccggttttccgggacccggtaaccgggggtacccaaacggttacccggttaggggaacgttaccgttaaacccggaaaaccggttaacgttcgggttacgggtacccgtacggtaaccccttaccgtacgtttaccccgg

SEQ ID NO: 236691 - DNA, 753 bp, Homo sapiens
  misc_feature: GYAE6OF02HM6I9.3.35.D02.1.454.CMB.1.raw
  modified_base (280)..(280): a, c, t, g, unknown or other
  misc_feature (280)..(280): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgccccgtcacccttggacagcccggcctccatcctcctgcaggtctggtacaaacgcctcggtgtacggtgataggaaaccacctacttagtaattggtanctttttagcgagacggaccgacggacctaactacctaccgaacggtacgtacctaacttacttaacttaacggtttaccgtaaccgggtaccgtacggtccgggtacccgtacgaacgagtacttacgtacggcggtaccgtacggtacgggtacggacgggtacgtaaccgttacgttacgtttaccgtaaccgtaacgttacggtaaggtaaagtttaacggacgggtaagggggtacggggtaagggtcggttaagggtacgggtaggtttagggtttagggtttaagtttttacgtttcgttacgtacgtagtacgtacgtaacgtaccgtaaccgtaacgtaccgtacggtaccgttaacgttaccgtttacgggtaccggtaccgggtaccgtaacggtacggtaacggacgtaacgtaacgtaaaccgtacgtacggtcggtacgtacgacctacgtacgttaccg

SEQ ID NO: 236692 - DNA, 784 bp, Homo sapiens
  misc_feature: GYAE6OF02F5QR3.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagacggccgaggcctaactcctaccgaaaggccgacctaattccgtaattaacggtttaccgtaaaccgggcgtccgttacgggggtaccccaaggaactacgtagttaccgaggccggctaccggttgggtacgaggcctaacgttcggtaactttccaactaccgttaggtaagtaaagtttacggacgtaagggggtagggacgggtcgttagggaagggtagtttagggtttacgggggtttaatttttacggttttcgttacggtaccgtaattacggtaaccgtaaacggtacgttaacccgtaaacccgtaaccggttaccgggttaaccccgtttaaacccgttaccggttttttaaccggggaccccggtaaacgggggtacccgaaacgggtaccggttaacggggtaaaggttaaaccgtaaacccgttaaaaaccggtaacccggtttgggtaaccggtaccggttaccgacccgttaacccgtacggtttaacccgg

SEQ ID NO: 236693 - DNA, 577 bp, Homo sapiens
  misc_feature: GYAE6OF02G48GR.3.35.D02.1.454.CMB.1.raw
  modified_base (388)..(388): a, c, t, g, unknown or other
  misc_feature (388)..(388): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggttactaaccgggacgcgtcggggtcccagacagattcgagcggcacgtgggcaggcactgtatttcacactaganaattagcgagggtggaggcgtaggaggtagtggttagggtaattttagtttctgactagtcgacgtaagtactacacctacgtacggtccgttaacgtacgttttacgggaccgtaacggggtacaaggtccgtggacgtactaaccgaaacgtagttacggtagggccttacggacctacgtattccg

SEQ ID NO: 236694 - DNA, 705 bp, Homo sapiens
  misc_feature: GYAE6OF02F35ZC.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacacgccggcctccatcctcctgcaggtctggtacaaagcctgtgtacggtgatggaaaccacctacttgaagttggtatcagcagaggccaggaccaatcctaccgaaggccgacctaatctaattaacggtttcgtaaaccgggcgtcgtcggggtccccagacagtacttcaggcggcacgtggggttcgggactacgtgtacttttcaccgtacgtaggtaagtaaacgtttacgggacggtaagggggtcggggtaaacgggtcggttaggaagggggttacttagggggtttaggggtttaatttttacgtttcgtggtacctagttcgaacgtagaccgtaactacgacgttcgggtacccgttaacgtttaaccgttttcgggaacccgggtacggggtaaacctaggtaccgggtaagggaaccgtaacgttaacccggaaaaacccggttagttaccgggtacgggtcctaacgtacccgtaaccttagttcccgttacgg

SEQ ID NO: 236695 - DNA, 640 bp, Homo sapiens
  misc_feature: GYAE6OF02G1IUZ.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtacaaagcctcgtgtacggtgataggaaacacctacttgaattggtatcagcagaggccaggccaatctcgaacggcgacctaatctaataacggtttactaaaccgggacgcgtcggggtcccagacagattcagcgcacgtggtcgaggcactgtacttcacacgtgaagtaattagacgagggtggaggctggaaggtagttgggttagggttaatttttagtttcgtacgagtattcgagtaacgtaccgttaacaacctaacgttacggtcccgttaaaccgttaccgtttttacgggacccgtaacggggggtaaccctaacggtacgttacggggaaagttaacgtaaccgaaaaccgggtaacgtcgggttacgggtaccgtaaccggacctaacccgtagtttaccg

SEQ ID NO: 236696 - DNA, 677 bp, Homo sapiens
  misc_feature: GYAE6OF02IHXKV.3.35.D02.1.454.CMB.1.raw
  modified_base (416)..(416): a, c, t, g, unknown or other
  misc_feature (416)..(416): n is a, c, g, or t
  modified_base (502)..(502): a, c, t, g, unknown or other
  misc_feature (502)..(502): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtgggattgttgtggtgactcagtcctccactcctccctgcccgtcacccttggacagcccggctccatctcctgcaggtctggtacaaagtcctcgtgtacggtgataggaaacctaccttacttagaattggtactcagcaaggacggacgacggcccaaatcctaccgaagggccgtacctaaatcctaagtttaacggtttacgtaaccgggacgcgtcggggtacccagtacagtattcagcgcacgtggacacggctactagtacttnacgtacgtagaacgtaagttacgcggtagggtcggaggtcgtaggacgggtagttagggttagggtttaagttttactttacggtntacgtagtacggacgtaacgaccgtaacgtaaccgtaacggttacggtaacccgtttacgttacgttttacgggaccgggttaacggggaccgtaacggtacggtaaggaagtaacggtaaaccaaaccggttaacgttacggcggtaccgtacggtacctacccgtattaccgg

SEQ ID NO: 236697 - DNA, 898 bp, Homo sapiens
  misc_feature: GYAE6OF02HREI3.3.35.D02.1.454.CMB.1.raw
  modified_base (248)..(248): a, c, t, g, unknown or other
  misc_feature (248)..(248): n is a, c, g, or t
tcagagacgcactccacgaccggtgctcgatttagcacacgatagttgggtttgggggatcaggactcctcagttcaccttctcacaatgaggctccctgctcagctccgtggggctgctaatgctctgggtcccaggatccaggtggggatggttgtggtgactcagtctccactctccctgcccgtcacccttggacagcccggctccatctcctgcaggtctggtacaaagcctggtgtacggtnagtaggaaacctaccttacgttgtaaacgttggtatcgagacgaaggaggccgaacggaccctaaacttccgtaacccgaacggggtcccgtaaccccttaaagttacctttaaaacgtttaaacggggttttacccgtaaaaccccgggggtaccgtaccgggttaccggggggttacccccaagggtaacctaacgggtaactttacccggaagggacccgggtacctaaccggtttacgggggtaccaacggggtacctaaccgttaggttaaccgttttaccgaaaccgtaacccgttaggtaaacggttaaacgtttaacgggaccggttaagggggtacggggaggttccgtaggggaacgggttaggtttaggggtttagggtttaacgttttttacgtttacgttacgtaccgttaagttaccggtaacgtaaacggtaaccttaccgtaaaccgttacggttaccgggttaaccccgtttaaccgttaaccggtttttacggggaacccgggtaacgggggtaacccgtaacgggtaccgggttaacgggaaccgttaaaaccgtaaccgtaaaaccgggtaaccggttacggttacgggcccgtttaaccggaacccgttaaccggttacgtttacccgg

SEQ ID NO: 236698 - DNA, 655 bp, Homo sapiens
  misc_feature: GYAE6OF02GM06D.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgataggaaacacctacttgaattggtatcagcagaggccaggccaatctccgaaggcgacctaatctataacggtttacgtaaccgggacgcgtcgggtccagacagtactcagcggcacgtggtcaggctactgtattcacacgtagagtaattaggacgtaggggtacggaggtcgtagggagggtacgttagggtttagggttaatttttacgtttcgttgtacgtaacgtggtaccgtaaacggtacctaaccgtaacctaacggttccgggtaccgttaaccgtttaccgttttcgggacccggtaacggggaccctaagggtacggttacgggaaacgttaacgtaaacccgaaaacggtaacgttacgggtacggtaccgttaggaccctaaccgtcttacccgg

SEQ ID NO: 236699 - DNA, 692 bp, Homo sapiens
  misc_feature: GYAE6OF02IBN1Y.3.35.D02.1.454.CMB.1.raw
  modified_base (455)..(455): a, c, t, g, unknown or other
  misc_feature (455)..(455): n is a, c, g, or t
  modified_base (559)..(559): a, c, t, g, unknown or other
  misc_feature (559)..(559): n is a, c, g, or t
tcagagacgcactccacgaccggtgctcgatttagcacacgatagttgggtttgggggatcaggactcctcagttcaccttctcacaatgaggcctccctgctcagctcctggggctgctaatgctctgggtcccaggatccaggtggggatgttgtggtgactcagtctccactcctccctcgcccgtcacccttggaccacgccggcctccatcctcctgcaggtctggtacaaacgtcctcggtgtacggtgagtacggaaacctaccttaacgttagtaagtttcggtatcagcgaaggacggccaggaccctaaagtcctaccgaacggccgtacctaaagttaccttaacgttaacggtttacccggtaaaccgggacggtccggttacggggtaccccaaggaccgagtaacttacgacggaccggcacgtgggtcagggcctacgtntactttaccgacgtacgtagaagtacgttacggacgtagggacggaacggtcgtagggaacggttacgttgggttaacggtttaatttttacgttcgtacggtntaagtcgtactaacgtacctacgaccgtacgtcggtaccttaccgttacgttcgggaccgacgggtacaggtcgtaacggaactacgtaaacgaaccgtcggttagacggtactcgaacctactacgttaccg

SEQ ID NO: 236700 - DNA, 682 bp, Homo sapiens
  misc_feature: GYAE6OF02JBDU2.3.35.D02.1.454.CMB.1.raw
  modified_base (221)..(221): a, c, t, g, unknown or other
  misc_feature (221)..(221): n is a, c, g, or t
  modified_base (601)..(601): a, c, t, g, unknown or other
  misc_feature (601)..(601): n is a, c, g, or t
  modified_base (675)..(675): a, c, t, g, unknown or other
  misc_feature (675)..(675): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatggttgtggtgactcagtctccactctccctgcccgtcacccgttggacacgccggtcctccatctcctgcncggtctggtacaaacgccgtcgtgtacggtgatacggaaacctacctacttaggtaattacggttaatcagcaggacggaccacggaccaactccgtaccgaaggcgacctaatctaagtacgttacgtaaccggacgtcgtacgggtccaagacgagtactcgagcgtacacggttggacgacgactacgtacgttacgttccactaacgtgaaacgtaattcggacggtacggggtaggtacgtcggttaggaaggttagttacggttaggggtttattttaaggtttcaaccgttgttaacggtccaagaacgtacgtaacgaccgtacggttcggaccccttttaaggtcgtttaacccgggaggtacccgggtanaaacggttcgggtaagtaaccgtacgtaaaccgtaaaccggttgtacgggttacgtccgtaccggtactaccgntttccgg

SEQ ID NO: 236701 - DNA, 925 bp, Homo sapiens
  misc_feature: GYAE6OF02G1J24.3.35.D02.1.454.CMB.1.raw
tcagagacgcactccacgaccggtgctcgatttagcacacgatagttgggttgggccgagctgggtttcctggttgttatttacgaaggtgtccagtgtgaggtgcagctggtgcagtctgggggagcttggtccaggcctggaggtccctgacgactctcctgtgtggtctcgtggacttcaccttcgaaggggtacccactttccagtcgggaccttgggggtcccaccgtaagggccttacccggaagggggaacgggggtccttaggggaagtttcggggggtacgacccgtttaaagaaaacggtaaaaaccgaaagggtccgtttaaaggaaaccggttttaaccaaccccgtaagtaacgggtaactttaacccgggccgtaaccggttttaccgacgggttacgaaccggtaacggggtacctaaacgggttaccctttacggaaaccccgtttacgttccgaaccggtaaaacggtaacggaattacggtaaaccgtttaccgaaaaggttacccgaaacgttttacccgagggtttaccttaccgtccggtaacgtaacgtaaaaacgtttccggaaaaccttacccggttaacggaaacggtaacggtacggaaaccgttaccgggtacccgtttaataacgttactacgggacctacgtaaccgtaagtactttaccgagttaaccgtacgggtacgtaaacgttacgaacttacggggtaccgggtccgaaacgtcgggtaaccgtacgggtctaacccgggttcttaccgtaaccggtacgtccccgtaaacgtacccggtaacgggaccccgtttagacccgtttccctaccccgggtggtacccgtaccccgttgtaccccgttggaaccgggtcctaccgtacccgttaccgggagtaccctaaccgg

SEQ ID NO: 236702 - DNA, 605 bp, Homo sapiens
  misc_feature: GYAE6OF02GOQG9.3.35.D02.1.454.CMB.1.raw
tcagagacgcactccacgaccggtgctcgatttagcacacgatagttgggtttgggggatcaggactcctcagttcaccttctcacaatgaggctcccctgctcagctcctgggctgctaatgctctgggtcccaggatccagtggggatgttgtggtgactcagtctccactctccctgcccgtcacccttggacagccggcctccatctcctgcaggtctggtcaaagcctcgtgtacggtgatggaaaccacctacttgaattggtatcagcagaggccaggccaatctccaaggccgcctaatctagttaacggtttcgtaaccgggacgcgtggggtccccagacagattacagcggctacgtgggtacaggcactgactttcacactgagtaatagcgaagggtggaggctaggagggtatggttagggttattttacgtttacgtagtcagttgacgaagtacctaccgtaacgtacgtacgggtacccgttactaccggttttggaccgtacggggtacccgaggtaccgtagggaacgtaacgtaaccgaaacgtaacgttaggtacggtacctacggaccctaccgtacgttccg

SEQ ID NO: 236703 - DNA, 672 bp, Homo sapiens
  misc_feature: GYAE6OF02GD3F3.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctcgcccgtcacccttggacagccggcctccatctcctgcaggtctggtacaaagcctcgtgtacggtgataggaaactacctacttgaattggtatcagcagaggccaggaccaatcctaccgaacggccgaccttaactactaagttaacggttttaccgtaaaccgggacgtccgtcggggtacccagacgagtattacgacgcggtcacgtgggtacaggctacgtagtactttaccactacgtagtaagtaagttacggacggtaaggggtgggaacgggtcgtagggagggtagttaggggtttagggttaattttacgtttcttaggtaccgtagtcggtaacgtaaggacctaacaagtaccgtcggtacccgtttactaccgttttaccgggaccgtaacggggaccgtaaggtccggtagggaagtaaccggtaacctaaaccggtaattacgggttcggacgtacggtacccgtactacttacg

SEQ ID NO: 236704 - DNA, 745 bp, Homo sapiens
  misc_feature: GYAE6OF02JNZ49.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccaggtggggatgttgtggtgactcagtctccactctccctgtccctcacccttggacacgcccggcctccatcctcctgacaggtctggtacaaacgccttcgtgtacggtgtagtggaaacctccgtacttacggaattggtactactagcaggacggccacggtaccaattccgtaccgaaggtccgtaccttaataccgttaacgttaacgggttttaccgtaaaccggggaccggtaggttccggggtacccaacggtacgacgtaacgttcgacgggacggacctacggtacggggacgtacggacctacgttacggtacttacggaacctacgtagtaagtaaacggttaggaccggtagggacggggtagtccggttaggtacgggtaagttagggttacggtttaactttaacgttttcgtgtaacgtagtcggtacgtaaacgttaccgtaaccgtacgtaccgtacggtacccgtacgtttaaacccgtttcgggaaccggtaacgggaccgaacggtacgtaacgggtagtaaacgtacggtaaaacgtaccggttggacgggttaccgtacgggacgtacccgtattaaccgg

SEQ ID NO: 236705 - DNA, 647 bp, Homo sapiens
  misc_feature: GYAE6OF02FH1U6.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttgacacgccggcctcatctcctgcagtctggtcaagcctcgtgtacggtgatggaacacctactagattggtatcagcagagccaggccaatctcagcgctaatctataagttactaccggacgtcgtgggtccccagactagacttcacgcggctacgtcggtcgacggctacgtgtactttccaacactgaagtaagtagtcgtacgggtgggaacggcgtacggaggtagtggtttagggttattttaacgtttcgtacgtctacgtacgactaaacgacttaaccgaaccgttaccgtaccggttcccgttaaacccgtacgtttttacggacccggtacggggtaacccgtaacggacccggtaagggtaaccgtaacgtaaacccgtaaacccggtaaccggttacgggtcggtaccgtccggtaaccctacccgttaacgtttaccccg

SEQ ID NO: 236706 - DNA, 921 bp, Homo sapiens
  misc_feature: GYAE6OF02FKR1P.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatggttgtggtgactcagtctccactctccctgcccgtcacccttggacacgccggcctccatcctcctgcaggtctggtacaacgcctcgtgtacggtgatcggaaacacctactgaattggtactcagcaggacggccgacggcctaactctaccgaaggccgtacctaaacttccttaagttaaacgggttttacccgtaaacccggggtacggtaccgttacgggggtacccccaacggaacgtaacggtacgtttccgaacgggtcccgggtaccgtaaccgggttcggggttaccgaacggggaccgtaaccgtttacggttaaccgtttttaccgaaacccgtaaccgtagggtaaacggtaaacgtttaacggtaccgggtaacggggggtttaggggaacgggtaccgttaacggggtaaacggggttaacggtttaggggttttacggggtttaaacgttttttaacgtttttacggttacgggtaccgttaaggttcccggtaaacggtaaaccggtaacccgtttaaacccgtaaaccgttaacccggtttaacccggggttaaccccgttttaaacccggttaaccgggttttttaaccggggaacccgggttaaaccggggggtacccccgtaaacggggtacccgggttaacgggaaaccgggttaaacccggttaaaccggtaaaacccggtaacggttaccggggttaccggtacccgttacccggtaaccctaacccggttaccgtttaacccgg

SEQ ID NO: 236707 - DNA, 592 bp, Homo sapiens
  misc_feature: GYAE6OF02JGEN4.3.35.D02.1.454.CMB.1.raw
  modified_base (274)..(274): a, c, t, g, unknown or other
  misc_feature (274)..(274): n is a, c, g, or t
  modified_base (286)..(286): a, c, t, g, unknown or other
  misc_feature (286)..(286): n is a, c, g, or t
  modified_base (303)..(303): a, c, t, g, unknown or other
  misc_feature (303)..(303): n is a, c, g, or t
  modified_base (358)..(358): a, c, t, g, unknown or other
  misc_feature (358)..(358): n is a, c, g, or t
  modified_base (400)..(400): a, c, t, g, unknown or other
  misc_feature (400)..(400): n is a, c, g, or t
  modified_base (408)..(408): a, c, t, g, unknown or other
  misc_feature (408)..(408): n is a, c, g, or t
tcagagacgcactccacgaccggtgctcgatttagcacacgatagttgggtttgggccgagctgggtttcctggttgttattttacaaggtgtccagtgtgaggtgcagctggtgcagtctgggggaggcttggtccagcctggagggtccctggagactctcctgtgtggtctctggattcacctttcagggaccacttcatggactgggtccgccaggctcgagggagggctggagtggtgccgtataagaaacagctagaagttacaccanagattacgccgngtctgtgacaggcagtntccaccatctacaagagatgtatacaacgcaactctagtctctactgaccaaatnaaccgacctaggaagaccgtaggaaccacggcgtactatcgngcgactanagatctatagtagagcacgtactacgtcgggacacggtacgctagacctaccgtaccgtctaccacgtaccctaccgtaccgaacggaccccgtacgttacccggtccgtcccccgtgggaccccgtcccgtaccgtccctccgaaccggtctaccccgacccgtacccggtacgaccgtaccg

SEQ ID NO: 236708 - DNA, 634 bp, Homo sapiens
  misc_feature: GYAE6OF02GQJDC.3.35.D02.1.454.CMB.1.raw
tcagagacgcactccacgaccggtgctcgatttagcacacgatagttgggtttgggccgagctgggttttcctggttgttattttacaaggtgtccagtgtgaggtgcagctggtagcagtctgggggaggcttggtccagcctggagggtccctgagactctcctgtgtggtctctggattcaccttcagggaccacttcatggactgggtccgccaggcctccgagggaagggctggagtgggttggccgtataagaacaaagctagaagttacaccacagattacgccgcgtctgtgacaggcagatcacatctacaagagatgacttcaagcaactcagtgtctcgtgacaaagtgaaccaacccgtagaacggaaccgagggtaccaccgggtacccgtctaactttactcgaccgtctaacagtacttacctattagttgggacgtccgtaaccgtacgtacggtcggggaccgaacgggacgtaccggtcggtccgacccggttcctcccttcgaccgtccctacccaccgaacggcctacgtcccgttccttcccccgtcggcccgtccccgttcggcccttaccgacgggtaccgacccggtaccctccggtacgaccggacccg

SEQ ID NO: 236709 - DNA, 802 bp, Homo sapiens
  misc_feature: GYAE6OF02FGDI7.3.35.D02.1.454.CMB.1.raw
tcagagacgcactccacgaccggtgctcgatttagcacacgatagttgggttcggggatcaggactcctcagttcaccttctcacaatgaggctccctgctcagctcctggggctgctaactgcctctcgggtcccaggactccgaggtggggtatgttgtggtcgacctcgacgtcctccacctcctccctcgtccccgtaccacccgttaggaccacgcccggcctccactccgtcctcgctacggtcctcggtaccaaacgtcctacggtagtacggtcgacttacggaaacctaccttatagtacgttacgtactacgacggacgacggaccggtaccgacgaccctaccgtaccgtaaccgaacgtaccgttaccttaacgttacgtaacggtttaaccggttacccggtaccgggtaccgtccggtaccggtaccaacgtacgtacgtaccgtaccgaccgtaccgtacgtaccggtacggtaccgacgtaccgtacgtacgttactaccgaacgtacgtaagtaacgtacgtacggacggtaggtacggtagtacggtaggtacggtagttacggttacgttacttacgttacgacgtacgtacgtaccgacgtaactaccgtaaccgtaccgttaccggttaccggttaccgttaaccggttaccgggttaccggaacccgggtaaccggtacccgaacggttaccggtaacggtaaccgttaacccgtaaccggtaaccggtaccggttacggtaccggtacccgtacctacccgttaccgttaccgttaccg

SEQ ID NO: 236710 - DNA, 600 bp, Homo sapiens
  misc_feature: GYAE6OF02HHS77.3.35.D02.1.454.CMB.1.raw
  modified_base (241)..(241): a, c, t, g, unknown or other
  misc_feature (241)..(241): n is a, c, g, or t
  modified_base (327)..(327): a, c, t, g, unknown or other
  misc_feature (327)..(327): n is a, c, g, or t
  modified_base (377)..(377): a, c, t, g, unknown or other
  misc_feature (377)..(377): n is a, c, g, or t
tcagagacgcactccacgaccggtgctcgatttagcacacgatagttgggtttgggggatcaggactcctcagttcaccttctcacaatgaggctccctgctcagctcctgggctgctaatgctctggtcccaggatccagtgggatgttgtggtgactcagtctccactctccctgcccgtcacccttggacagccggcctccatctcctgcaggtctggtcaaagcctcgtgtacggtnatggaaacacctacttgaattggtatcagcagaggccaggccaatctaccgaagcgacctaatctattaacggttctaaccggacncgtcgggtcccagacagatcgagcgcacgtggtcaggcactgatttcacnctagagtaatagacgtagggtggaggactaggagtagtggttagggttattttatttcgtgtcgtatcgtacgtaacgtactaacgacgtacgtcggacccgtttaacgtacgttttcgggacccgttacggggaccgtaacggtccgtaagggtacgtaacgtaaccgtaaaccggtaacgttacggtacggtacctacggtaccctaccgtacgttaccgg

SEQ ID NO: 236711 - DNA, 760 bp, Homo sapiens
  misc_feature: GYAE6OF02JW40Y.3.35.D02.1.454.CMB.1.raw
  modified_base (125)..(125): a, c, t, g, unknown or other
  misc_feature (125)..(125): n is a, c, g, or t
  modified_base (218)..(218): a, c, t, g, unknown or other
  misc_feature (218)..(218): n is a, c, g, or t
tcagagacgcactccacgaccggtgctcgatttagcacacgatagttgggtttgggggagtcaggactcctcagttcaccttctcacaatgaggctccctgctcagctctgggctgctaatgctntggtccaggatccagtggggatgttgtggtgactcagtctccactctccctgcccgtcacccttggacagcccggccgtccagtcctcctgcncggtctggtcaaacgtcctccgtagtcggtgataggtaaacacccgtattacggaactttgggtattcgaagccgtaaggaggcccaagggaccctaagtccgtccgaaacggccgaccttaatacttaagttaacgggttttaccgtaaccggggtacgccgttaggggttccccaggactagacgttcaaggccggcgacgtcgggtacacgggcgtaacgtcgtacgtttccaactacgtacggtaagtaaacgtttacggacggttaaggggggtcggaacgggtcgttagggtaacgggtagtttacgggttagggttaagtttttacgtttcggtggttacccgtagtacggtaacgaaggtccctttaaacgaacccggttaccgggtaggttaacccggtttaacgtttaacccgggtttggttaaccggtaacccgggggtaccgtaaaccggttcggtaagggtaacggtaaacgtaaccgtaaaccggtaccgttaggtacggtccgtaggaccctacggtactttaccgg

SEQ ID NO: 236712 - DNA, 678 bp, Homo sapiens
  misc_feature: GYAE6OF02JJIRG.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcagtctggtcaaagtcctcgtgtacggtgagtcggaaactacctacttgaattggtatcagcgagacgccgaggccaatccgtccgaaggccgcctaaagtcctaagtaacggtttccgtaaaccgggcgaccgtcggggtacccaggacagtatcgagcgactacggtgggcggacgactacggtacttacaccgacttaggaacgtaagttacggacgtaggggtacggaaggaccgtagggaggttacgttacgggttagggttaacttttagtttccgtaggtacgtagtacggacgttaacgacgttaaccgacgttacgacgggttaccgtaacgttaccgttttaagggcccgtaaacgggtaccgtaggtaccggcgggtaacgaaccgttaaaccgaaacggtaaccgttcggtacggacgttaccggacccttaccgtacgttaccgttaccg

SEQ ID NO: 236713 - DNA, 671 bp, Homo sapiens
  misc_feature: GYAE6OF02G97T1.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactcctccctgcccgtcacccttggacagccggcctccatctcctgcaggtctgtcaaagcctcgtgtacggtgataggaaacacctacttgaaattggtatcagcagaggccaggaccaatctaccaaggccgccctaatcctaacgttaaaggtttaccgtaaccggggacgcgttcggggtaccccaaggacagtattcgagcgggcacgttgggcgacggacacgtgtactttcactactgaagtaattaggacgtaggggtggacgggcgtaggaagggtaggtttggtttaagggtttaagtttttacgttttacgtcggtactacgtacgtacgaacggtaccttacctaaccgtacgttaccgggttacccgttaaccgttaccggtttttaccggggaccgtaacggggtaccgtaaggccgtaagggaacgtaagtaaccgaaaccgttaacgtacggttacgggacgttaccgacctaccgtacgttccg

SEQ ID NO: 236714 - DNA, 694 bp, Homo sapiens
  misc_feature: GYAE6OF02JQWCP.3.35.D02.1.454.CMB.1.raw
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
  modified_base (666)..(666): a, c, t, g, unknown or other
  misc_feature (666)..(666): n is a, c, g, or t
tcagagacgcactccacgaccggtgctcgatttagcacacgatagttgggtttgggccgagctgggtttcctggttgttattttacaaggtgtccagtgtgaggtgcagctggtgcagtctgggggaggcttggtccagcctggagggtccctgagactctcctgtgtggtctctggattcaccttcagggacctacttcatggactgggtccnccaggcctccgagggagggctgggacgtgggttcgcgtanaagaacaagctaagaagttaccacacagattacgccgctcgtgtgactaggcagtacttcaccattctacgaagagactgtattacaagacctaaactcgagttcgtactctagactaaaatcgaaccaccctaggaaacgaaccgtacggaaccgaccggggtcccttacgtaacgttaccgtggacccgtacctaacgaacggtacttactaagttacgttagggaactacgtaccggaacgttacggtcgggtaccgaacgggtacgtacccgttcgggtaccaccggtccctccgtaaccacgtaccccgttaaccgaaccgaacccggccgtaccgttccggttaccccgtacccccggttcggccccgtacccgtcgcccgtaccggaaccggtccggtacccccnccggtaacccggaccgtaccgtaacccg

SEQ ID NO: 236715 - DNA, 591 bp, Homo sapiens
  misc_feature: GYAE6OF02HFZR1.3.35.D02.1.454.CMB.1.raw
tcagagacgcactccacgaccggtgctcgatttagcacacgatagttgggtttgggggatcaggactcctcagttcaccttctcacaatgaggctcccctgctcagctcctggggctgctaatgctctgggtcccaggatccagtggggatgttgtggtgactcagtctccactctccctgcccgtcacccttggacagccggcctccatctcctgcaggtctggtcaaaagcctcgtgtacggtgataggaaacacctaacttgaattggtatcagcagagccaggccaatctccaaggcgacctaatctataaaggtttctaaaccgggacgggctcggggtacccagacagattcagcggcacgtgggtcaggcacgtgatttcactactgagtaattaggacgaggggtaggaggctaggaaggtagttgggtttagggtaatttttagtttcgttgacgtagtggtacaagacctaacacgtacgtcggaccttacgtactttcggaccgaagggaccaaggtcgtagggactaagtaacccaaaaggtaacgttggtacggtactacggacctacctagttaccg

SEQ ID NO: 236716 - DNA, 643 bp, Homo sapiens
  misc_feature: GYAE6OF02H55KU.3.35.D02.1.454.CMB.1.raw
  modified_base (245)..(245): a, c, t, g, unknown or other
  misc_feature (245)..(245): n is a, c, g, or t
  modified_base (254)..(254): a, c, t, g, unknown or other
  misc_feature (254)..(254): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatggttgtggtgactcagtctccactctccctgcccgtcacccttggacagccggcctccatctcctgcaggtctggtacaaagcctgtgtacggtnatggaaacncctaacgttgaattggtatcagacagacggccaggaccaaatcctaccaaaggccgaccctaattctaattaaacgggtttcctaaaccgggacgcgtcggggtaccccaggaccagattccgagcggacacgtgggtacaggcactgtatttcacgtactgaagtaagttagacgtagggtcggagtcgtaggagtagttgggttaggttagttttacgttcgtagtcgtagtagtactaaacgacctaacgaccgtaaccggtcggtaacccggttacgtaacggtttttaacggaccgggtaaacgggaccgaacgtaccggtggaaacgtacgtaaacgaaaacgtaacgttggtacggtaccgtacggactaccgtattaccgg

SEQ ID NO: 236717 - DNA, 740 bp, Homo sapiens
  misc_feature: GYAE6OF02I16AI.3.35.D02.1.454.CMB.1.raw
  modified_base (163)..(163): a, c, t, g, unknown or other
  misc_feature (163)..(163): n is a, c, g, or t
tcagagacgcactccacgaccggtgctcgatttagcacacgatagttgggtttgggggtagtcaggactcctcagttcaccttctcacaatgaggctccctgctcagctcctgggctgctaatgctctggtcccaggatccagtggggatgttgtggtgactnagtctcctactctccctcgcccgtccacccttggacacgcccggcctcccactcctcctcgcgacggtcttcggtacaaacgcctcgtcggtaccggtagaagttacggaaacctaccttacgttacgtaaagtttcggttaatacaagcgaaggtacggccgtacggacctaactccgtaaccgacggaccggtacctaacttcttaacgttaacgggtttaaccgtaaacccgggtaccggtccgggttaccggggtaccccgtaacggtaacgtaacggtaacttcggaccgtaccggaccgtacggtcggggtacagggtacctaacgtgtaccttacactacctaggtaacgtaagttagacgtacgggggtagtaggggtctacgggaggtagttgggttaaggttattttagtttcgacggtctaggtatacgaagtaccttagacctaaccggttcgggcccttaacggttaccgtttacgggacgtaacgggaccgttacggtaggtaacggagtaaccgtaactaaaccggtagtacggtcggtaactcgaacccgtagtcctacgg

SEQ ID NO: 236718 - DNA, 624 bp, Homo sapiens
  misc_feature: GYAE6OF02HP08E.3.35.D02.1.454.CMB.1.raw
  modified_base (246)..(246): a, c, t, g, unknown or other
  misc_feature (246)..(246): n is a, c, g, or t
tcagagacgcactccacgaccggtgctcgatttagcacacgatagttgggtttgggggatcaggactcctcagttcaccttctcacaatgaggctccctgctcagctcctgggctgctaatgctctgggtcccaggatccagtggggatgttgtggtgactcagtctccactctccctgcccgtcacccttggacacgccggcctccatcctcctgcaggtctggtacaaagcctcgtgtacggtnagtaggaaaccaccttacttgtaattggtatcagcagacggccaggaccaatctaccgaaggccgacctaatctaattaacggtttacaaccgggactcgtcgggtcccagacagtattcgagcggcagtgggtacacgggactacgtgtactttaccaactaccgtaggaagtaaagtttacggacggtaaggggtggaggtcgtagggtaggtaggttagggttagggttaatttttagttccgttagcgtaagtgacgtaagtacctaacacgtacgttcggacccttacgttacgtttcgggaccgtagggaccgtaagtcgtaggacgtaactaacgtaaacgtacgtagtcgacgtagacctacgtattacg

SEQ ID NO: 236719 - DNA, 593 bp, Homo sapiens
  misc_feature: GYAE6OF02I9US1.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgataggaacacctacttgaattggtatcagcagaggccaggccaatctaccgaaggcgacctaatctattaaggtttctaaccgggacgcgtgggtcccagacagattcgagcggcacgtgggtacaggcactgatttcactactgagaattagacgtagggtgggaggctcggagggtagttaggttagggttattttagtttcgtgtactagtgcgaagtacctaacgactacgtcggtaccgttacttacgttttcggaccgtacggggaccgtaacggacggtagggaacgtaataaccgaaacggtaagttcggtacggtccgtacggacctaccgtattaccgg

SEQ ID NO: 236720 - DNA, 855 bp, Homo sapiens
  misc_feature: GYAE6OF02HZXPR.3.35.D02.1.454.CMB.1.raw
  modified_base (126)..(126): a, c, t, g, unknown or other
  misc_feature (126)..(126): n is a, c, g, or t
tcagagacgcactccacgaccggtgctcgatttagcacacgatagttgggtttgggggatcaggactcctcagttcaccttctcacaatgaggctccctgctcagctcctggggctgctaatgctntgggtcccaggatccaggtggggatgttgtggtgactcagtctccactctccctgcccgtcacccttggacagcccggcctccatcctcctagctaggtctggtcaaagcccttcgtgtacggtgataggaaaccacctacttggaattggtatacagcgagacggccaggaccaactccgtaccaagggccgtaccgtaagtacttaacgttaacggttttaccggtaaaccggggtaccgtaccgttacgggggtaccccgaaggaaccgtaaggtaacgtttccgaacggaccggtacgtaccggttacgggtaccgaacgggtacgtaccgttaggaactttttaccaaccgtacgttacggtaacgtaaacgtttaacgggtaaccgggtaagggggttacggggtaagggtaaccggttagggtaacggggtaaggtttacgggttttaaggggtttaacggttttaaacgttttttccggtacggttacgtaacgttacgggtaacgtaaacgtaccgttaaaccggtaacccttaaccggttaccggtacccggtttaaccgttaaccggttttttaccgggacccgggtaaaccggggttaaccgtaacgggttaccggtaacgggttaacggtaaaccgttaacccggttaaaaccggtaaacggttgggtttacccgggtacggttaaccggacccgttaaccgtacgtttaacccgg

SEQ ID NO: 236721 - DNA, 548 bp, Homo sapiens
  misc_feature: GYAE6OF02JZJ34.3.35.D02.1.454.CMB.1.raw
  modified_base (256)..(256): a, c, t, g, unknown or other
  misc_feature (256)..(256): n is a, c, g, or t
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
  modified_base (315)..(315): a, c, t, g, unknown or other
  misc_feature (315)..(315): n is a, c, g, or t
  modified_base (366)..(366): a, c, t, g, unknown or other
  misc_feature (366)..(366): n is a, c, g, or t
  modified_base (379)..(379): a, c, t, g, unknown or other
  misc_feature (379)..(379): n is a, c, g, or t
  modified_base (483)..(483): a, c, t, g, unknown or other
  misc_feature (483)..(483): n is a, c, g, or t
  modified_base (491)..(491): a, c, t, g, unknown or other
  misc_feature (491)..(491): n is a, c, g, or t
tcagagacgcactccacgaccggtgctcgatttagcacacgatagttgggtttgggggagtcaggactcctcagttcaccttctcacaatgaggctccctgctcagctcctgggctgctaatgctctgggtcccaggatccagtggggatgttgtggtgactcagtctcactctccctgcccgtcacccttggaccagccggcctccatccgtcctgcacggtctggtacaaagcctgtgtacggtgatggaaacncctactgaattggtatcagcagngcagcatcncagcncaatcatagtttcgaacggacncgtgggaccagaactgattcgagcgcacgtggcagcacgtgaacgtttcancgtagagaatcgntagggtcgagtctggacgagttggttaggattttacgttgagtcagttgacgaatcgtaacagaccgtgtaccgtaacttcgttacggccgaaggggtaacccnggttacgnggtaacagtaaccgtaaagtaacgtggacggtaccaggtacctaaccgtagttaccg

SEQ ID NO: 236722 - DNA, 659 bp, Homo sapiens
  misc_feature: GYAE6OF02GA4ZP.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgccccgtcacccttggacagccggcctccatctcctgcagtctggtacaaagcctcgtgtacggtgatcggaaacaccttacttagaattggtatcagcaggacggccaggccaatcctaccgaaggccgaccttaaatcgttaagttaacggtttaccgaaccgggacgtcggtcggggtaccccaagacgagtacttcgacggcggactacgtggggtacagggtcacgtgtactttaccgaacaacgtggtaacgtaagttagacggtaggggttagggacggtagacgggtaagtaggtggtttagggttaatttttagtttcgtagctagtggagaacgtacctacacgtaccgtacggaccgttaacctacggtttaggaccggtaagggacctaacggacggttacgggtaataacgttaaccggaaaacgttacgttacggtacggtccgtaggaccctacgtacttaccgg

SEQ ID NO: 236723 - DNA, 704 bp, Homo sapiens
  misc_feature: GYAE6OF02I1WDA.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctggtcccaggatccagtggggatgttgtggtgactcagtctccactctccctgcccgtcacccttggacacgccggcctccatcctcctgcgaggtctggtacaaacgtcctcgtcgtacggtgatacggaaactaccttacttagaagtttggtatcgagacagacggccgaggaccaactccgtaccgaaaggccgaccttaaatctaacgttaacggtttaccgaaccgggacgtcgtcgggtacccaagaaccagattcaacggcgactacggtagggtacacggtcacgtagtaactttaccaactacgttaggaaacgtaagttaagtacggtaacggggttaggaacgggttacgtaggtaagggtagttacggtttaggttaacgtttttaatttcgtacgtacgtagtacggtacaacggtaccttaacggaactacggtacgttacccgttaacgtacggttttaccggaccggtaacgggaccgtaacggtacgttaacgggtaagtaacgtaaaccgtaaaccgtacggtacggtccggaccgttcggaacctaccgtaacgttccg

SEQ ID NO: 236724 - DNA, 875 bp, Homo sapiens
  misc_feature: GYAE6OF02HO0VL.3.35.D02.1.454.CMB.1.raw
  modified_base (218)..(218): a, c, t, g, unknown or other
  misc_feature (218)..(218): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgtggtctctggattcaccttcagggaccacttcatggactgggtccgccgngcctacggagggacggtcggaggtgggtgggcgacgtagttataccactagtagtaggtaggacgacgtaagtaaccgtaccgtacgacgtaacgtaccgtacggtaacgggaccggtacgttacctaccaacgtaccgtcctaccgaaggaacgtaactaccgtaacgaaacgaaccgacgtacgtagttactacgtacgtaaactaacgtaacgaacgaccgtacggtagaacggtacgtaggtacgggaaccgaccgggtaccggtacgttaggtttacgttttaacgttcggtacggggtaccggaaaggtaacggtacgttaggtacggttagggggtccggttaaaggttaaacggttaacggggtttaaacggggtacggaaaggttttaacgttaaacgttaaggttacggttaacgggttaaccgggttaaccgggtttcgggggtacccggggtaaaccgggtaaaccggggttacccggtaaccgggttacccgtaccggtttccctaccgtacccggtaaccccgtttacccgaaccccggtaaggggtaacccccgtaccggttacccggtttccccggtttaccccccgtaccccgggtaccggtaacccccctaccccgttacccgtaaaccggtaacccgg

SEQ ID NO: 236725 - DNA, 537 bp, Homo sapiens
  misc_feature: GYAE6OF02HOEPR.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcgcacgtggtcaggcactgatttcacactgagaattagcgagggtggaggctggaggagtggttgggtattttattcttgctatgacaagctacacacgtggccgtactactttggaccgagggaccaggtccgtggacgataccgaaacgtaacgtcggtacggacttcggacctaccgtattccg

SEQ ID NO: 236726 - DNA, 702 bp, Homo sapiens
  misc_feature: GYAE6OF02IEAQM.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacacgccggcctccatcctcctgcaggtctggtacaaagtcctggtcgtacggtgagtacggaaactccttacttagtaacttggtatcgagctaaggacggaccaggccaatctaccgaacggtccgaccttaatcttaagttaacggtttaccgtaaccgggtacgtcgttccggggtacccaaggtaccagtacttacgacggtcggtactaacgtcgggtacgtacggacctaagttcgtacttaccacgtactaggtaacgtaacgttaacggccgtagggggtacgacgggtcgtacggaggtagttacggtttagggttactttttagttacgtgtactagtacgaactaacgtactaaccgtacgtacgggttccgtaaccgttaaccggtttagttccgggaaccgtaacggggtaaccctagggtcgttaagggaacgtacgtaaaccgtaaacggtcgttacggtcggtacctccggtaacctaccggtattaccgg

SEQ ID NO: 236727 - DNA, 787 bp, Homo sapiens
  misc_feature: GYAE6OF02F9EUC.3.35.D02.1.454.CMB.1.raw
tcagagacgcactccacgaccggtgctcgatttagcacacgatagttggggtttgggggatcaggactcctcagttcaccttctcacaatgaggctccctgctcagctcctggggctgctaatgctctgggtcccaggatccgaggtggggatggttgtggtgactcagtctcactctccctgccctcacccttgacacgccggcctccatcctcctgcaggtctggtacaaagtcctcgtgtacggtgagtacggaaactacctaacttagtaaattggtatacgacgacgaaggacggaccgacggacccaacgtccgtaccgaacggtaccgtaccgttaaacttacgttaacgttaaacgggttttaccgaaaccggggtaccgtccgggttaccgggggtaccccaacgtaccgtaacgtacgttaccgacggtaccgggactacgggtagggtacgaacggtactacgtagttacgtttaccaccgtaaccgtaggtaacgtaaagttacggtacggtacggggttaggacggtaccggtagggaacgggttacggtttaggtttaggggtttattttaacggtttacgtacgtacgtacggtacgtacggtaacgtaccggttaacaaccggttccgttacgggtaaccctttaacggttaacgtttaccggggaaccgtaccggggtaacctacggtacggtaacgggtaacgtaacccgtaaaccggtaaacgtaacggttacgggtacgtaccgtacggaccctaacgtcgttaccg

SEQ ID NO: 236728 - DNA, 647 bp, Homo sapiens
  misc_feature: GYAE6OF02FQMCL.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctgggtcccaggatccagtggggatgttgtggtgactcagtctccactctccctgcccgtcacccttggacagccggcctccatctcctgcaggtctggtcaaagcctcgtgtacggtgataggaaacacctacttgaattggtatcagcagaggccaggccaatctaccgaaggccgacctaagtctaagttaaggtttccgtaaccgggtacgcgtacggggtccccagactagacttacgaggcgcacgtgggtcaggcactgtactttacactactgaagtaattagacgtaggggtaggtaggtacgtaggtaggtagttagggtttagggttaattttacgttttcgttgtacgtagtacgtacgtaagtacctaaccgtacgtaacgtacgggtacccgttaacgtaccgttttacgggacccgtacggggacccaacggtacgtagggaacgtaagtaaccgtaaaccggtacgttaggtacgggtaccgttacggaccgtaccgtacgttaccg

SEQ ID NO: 236729 - DNA, 739 bp, Homo sapiens
  misc_feature: GYAE6OF02JVXZ2.3.35.D02.1.454.CMB.1.raw
tcagagacgcactccacgaccggtgctcgatttagcacacgatagttgggtttggggatcaggactcctcagttcaccttctcacaagtgaggctccctgctcgagctccgtgggctgctaatgctctggtccaggatccaggtgggatgtgtgtgactcagtctcactctcctcgccgtactaccgttgacacgccgtcctccattctcctgacgtacgttcctggtacaaacgtccgtcgtacggtacggtgtacgttacggaaacctaccgttaacgttaggtaaattcggttaactaccgaagtccgaagggtaccggaccaagggtacctaacgtccgtaacccggaaagggtccgtaaccttaaagtaccttaaaggttaacggttttaaccggtaacccggggacctccggtaccgggttacccaagtacgtaacggtacttaccggagaccgggtactaccggtggtaaccaggtaccaacgttgacgttactaaccgtagtacgtaagtaacgttacggacgtaagggtacgtacggacgtagggaaggttggttacggttaggttatttacgttacgacgtactagtacggtactaacggtacctacgtacggtaccgtcgtaccgttactacggtacgacggacggtacgtgtaccggtaggtaacgtaacgtaaccgtaacgttaaccgttcggtacggtccgtaacgtccgtaacgttcgttaacg

SEQ ID NO: 236730 - DNA, 683 bp, Homo sapiens
  misc_feature: GYAE6OF02F9C10.3.35.D02.1.454.CMB.1.raw
tcagagacgcactccacgaccggtgctcgatttagcacacgatagttggggtttgggccgagctgggttttcctggttgttattttacaaggtgtccagtgtgaggtgcagctggtgcagtctgggggagcttggtccagcctgggagggtccctgacgactctcctgtgtggtctctggattcaccttcagggacctacttcatggactgggtccgccaggcctaccgagggacggggctgggagtgggttcggccgtataagaacaagctagaagttacaccacagattacgccgacgtctgtcgaccaggccagtacttcaaccgactctacgaagtacgtatcggaattcgaaagcctaactcgtaacgtgtccttctgacaaattcgaacctacccgtagaaacgtaacccgaagggaaccaccgggtaccgttactaacgttactacgcgtacctacgaagtactttacaacttagttacgggacgtaccgtaaccggacttaacgtcgggaccaacggtacgaccgttacgtccgtacccgttctcccgtacgacgtccctacccgtaaccgaacgggtcccacgttccggtacccgttcccccggcgtacccggtcccctacggtcccttaccggacggtaccggtacccgacccggttacgaccgtacgacccg

SEQ ID NO: 236731 - DNA, 694 bp, Homo sapiens
  misc_feature: GYAE6OF02GICHL.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctgggtcccaggatccagtggggatgttgtggtgactcagtctccactcctccctcgcccgtcacccgttggacagccggcctccactctcctgcaggtctgtacaaacgcctcgtgtacggtgatacggaaactaccttacttgaattggtatcagcaggacgccacggaccatcctaccgacggccacctaatctaagttaacggtttaccgtaaacccgggcgtccggttcggggtacccaaggtaacgaggtaacttcgacggccggtacgacgtcgggtactacggacctacttacgtactttaccaacctacgtaggaaacgtaagtttacggaccggtaaggggtacgggagggtacgtacggggtaagggttacgttagggtttacgggttaatttttaacgttcgttacgtacgttacgtacgtaaccgtaacggtacctacgtaacctccggttaccggtaccttacgtttacgtcggtaccggaacggtacctaacgcggtaaggaacgttaccgtaaacgtaacgtacgttcggacgtagacgtcctacgtgttaccg

SEQ ID NO: 236732 - DNA, 726 bp, Homo sapiens
  misc_feature: GYAE6OF02INMB9.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccgagtggggatgttgtggtgactcagtctccactctccctgcccgtcacccttggacacgcccggccctccactcctcctgcaggtctggtacaaacgtccgtcgtaggtacggtgagtacggaaacctaaccgttacgttagtaagttggtacttacagacgaggaacggccgacggaccctaacgtcctaaccgaacggaccgtacctaaacgttaccttaagttaacggtttaccgtaaacccgggtacggtcgttccggggacccagaacgtagtacttacgacgcggactacgtgggtacgacggcaacgttgtactttccgaacgtcgtaggtaagtaagttaacggcgtaaggggtagggtaggcgtaaggacggtagttagggttacgggttaagtttttaacgttcgtacgtacgtacgtacgaacgtaacgtacctaacgaccgtacgtacggtacccgttaacgttacggtttacgggaccgtaacgggtaccgaacggtacggtaacggtaacgtaacgtaaccgaaacgtaacgttcggtacggtaccgtaccggacctaccgtagttacccg

SEQ ID NO: 236733 - DNA, 581 bp, Homo sapiens
  misc_feature: GYAE6OF02G1QV6.3.35.D02.1.454.CMB.1.raw
  modified_base (346)..(346): a, c, t, g, unknown or other
  misc_feature (346)..(346): n is a, c, g, or t
  modified_base (399)..(399): a, c, t, g, unknown or other
  misc_feature (399)..(399): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctggggggaggcttggtccagcctggagggtccctgagactctcctgtgtggtctctggattcaccttcagggaccacttcatggactggggtccgccgaggctccgagggagggctggagtgggttggccgtataagaaacaagctagaagttacaccacagattacgccgcgtctgtgacaggcagattcacatctacaagagatgattacaagcaactcagtntctctgacaaatcgaaccacctagaacgacgacgacacggtcctactattacngacgatacagtatacatagttgagtactacgactacgtacgggaccgaacggacgacgtcggtaccgtacccgtctcctacgaccgcctacccgaccgaaccggccctaggttccgtcccgtccccgtcggtcccgcccgtcggcctaccgacggaccgccgtaccgtccgacgacgtaccg

SEQ ID NO: 236734 - DNA, 627 bp, Homo sapiens
  misc_feature: GYAE6OF02F2VE7.3.35.D02.1.454.CMB.1.raw
  modified_base (381)..(381): a, c, t, g, unknown or other
  misc_feature (381)..(381): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggattgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctattaaggtttctaaccgggacgcgtggggtcccagacagattcgagcgcacgtggtcaggcactgatttcacncgtacgagtaattagacgagggtggacggcgtacgggaaggtagttgggttagggttacttttagtttccgtgtctagtacgacgtaacgtcttaaccacgtacggtacgggtacccgttaaccgtaccgtttttcgggaacccgtaacgggggaccctaacgggtccgggttaagggtaacggtaacttaaccggaaaacggtaaccgtggttacgggacgttacgggacctaccgtacttaccg

SEQ ID NO: 236735 - DNA, 705 bp, Homo sapiens
  misc_feature: GYAE6OF02F8OQ0.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtacaaagcctcgtgtacggtgagtacggaaacaccttacttagaattggtatcagcagaggccgaggccaatctaccgaaggccgacctaatctaagttaaggtttaccgtaaccgggacgtcggttcggggtaccccagacagtacttcagcggcacgtgggtcaggcacgtgtacttcgactacgtagtaagtaagttaggacgtaggggtacggtaggtcgtagggaggtaaggttgggttagggtttaaattttcgttttacgttcggtacgtacgttacgtaacgtaacgtaacgtacctaaccgtaccggttaccgggtacccggtttaaccgttacggtttttaaccgggacccgggttaacggggtaacccgtaacggtcggttaacgggaacgtaaaccggttaaaccgtaaaccggttaaccggttaggtaccggttaccgtacggtacccgtaccgttaccgtttacccg

SEQ ID NO: 236736 - DNA, 602 bp, Homo sapiens
  misc_feature: GYAE6OF02IR9N4.3.35.D02.1.454.CMB.1.raw
  modified_base (254)..(254): a, c, t, g, unknown or other
  misc_feature (254)..(254): n is a, c, g, or t
  modified_base (325)..(325): a, c, t, g, unknown or other
  misc_feature (325)..(325): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagtcctcgtgtacggtgatggaaacncctacttgaattggtatcagcagaggccaggccaatctcaaggcgcctaatctatagtttctaaccgggcncgtcgggtcccagacagattcagcgcacgtggtcaggcacgtgtactttcactacgtgaagtaattaggcgtagggtggaggcgtaggaggtagtggttagggtaattttagtttctaggtctagtcgtactaacggtacctaccgtaacgaccgtcgggtacccttacgtaccgttttcgggacccgtaacggggtacctaacggtcgtacggtaacgtacgtaaccgaaaccgtacgttcgtacggtaccgtacggaccgtaccgtacttaccgg

SEQ ID NO: 236737 - DNA, 582 bp, Homo sapiens
  misc_feature: GYAE6OF02JODJP.3.35.D02.1.454.CMB.1.raw
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
tcagagacgcactccacgaccggtgctcgatttagcacacgatagttgggtttgggggatcaggactcctcagttcaccttctcacaatgaggctccctgctcagctcctgggctgctaatgctctggtcccaggatccagtggggatgttgtggtgactcagtctccactctccctgcccgtcacccttggacagccggcctccatcctcctgcngtctggtnaaacgcctcgtgtacggtgatggaaacacctacttgaattggtatcagcagagcgagcaatctaccaaggcgacctaatctacgtaagtttccgtaacggtcgaccgtggggtcccagacgagaacttcagccggcacgtggtacgaggactacgtagtactttacgactacgtgaagtaagttacgagtaagggcgagtcgtagaggtatcggttgggtaactttagtttccgtgtacgtaagtcgacgtaagaccgttacaaccgtagtccggtacttacgtacgtttgaccgtaggaccctagacgtgtagtactaacgaacgtacgtacggtacgtgtacgcctactagtaccg

SEQ ID NO: 236738 - DNA, 621 bp, Homo sapiens
  misc_feature: GYAE6OF02JQLE5.3.35.D02.1.454.CMB.1.raw
  modified_base (204)..(204): a, c, t, g, unknown or other
  misc_feature (204)..(204): n is a, c, g, or t
  modified_base (210)..(210): a, c, t, g, unknown or other
  misc_feature (210)..(210): n is a, c, g, or t
  modified_base (238)..(238): a, c, t, g, unknown or other
  misc_feature (238)..(238): n is a, c, g, or t
  modified_base (240)..(240): a, c, t, g, unknown or other
  misc_feature (240)..(240): n is a, c, g, or t
  modified_base (364)..(364): a, c, t, g, unknown or other
  misc_feature (364)..(364): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccaggtggggatggttgtggtgctcagtctccactctccctgcccgtcacctgcagccgctaccntctccngcagtctgtacaacgctcggtgtacggnanagaaccacctattgaatggtatcagcagacgcgacgcactctccgagaccgtctaactcgtaacgttacggttactaaccgggcgtacggtcgggtaccagtacgagtactacgacggcgtacncgggtacggtcgaggtactacgtgactttcgacgtacctagtaacgtaagtacgacggtagggcggaggtacgtaggtaggacgtagggttaaggttacgtttacttcgttcgtacgtaaggtcgaactacggtacgtaacgtaccgtacggcggttaccgttacgttacggtttaccgacgggttacgaccgtaacgcggtaacggtactaaggtaccgaacgtagtcggtacgcgtacgactaccgtattaccgg

SEQ ID NO: 236739 - DNA, 775 bp, Homo sapiens
  misc_feature: GYAE6OF02ITWIG.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatcctcctgctaggtctggtacaaacgcctcgtgtacggtgatacggaaacacctacttagaattaggtactcagcaggacggccgacggccaactcctaccgacggccgtacgttaactactaacgttaacggttttacccgtaaccgggtaccggtcggttaccggggtacccaacggaactacggtaatttccgaaggtccggaaccgtacgttacgggggtactacgggactaacgttacgtaacgttttccaaccgtacgtaaggtaacggttaaagtttaaccgggacgggtaacgggggtcggggtacggtaccggttaagggaagggtttaccggtttagggttttaggggttaactttttacgttttacggtaccgttacgttacgtagtaacgtaacggtacttaaccgaccgttaacggtacgggttaccctttaggttaaccgttttcgggacccggtaacgggtaccgtaacggtacggtaggtaaacggtacgtaaaccggtaaaccgtacggttacggtacggtccgtaccggtaccgtacttaaccgttccg

SEQ ID NO: 236740 - DNA, 575 bp, Homo sapiens
  misc_feature: GYAE6OF02GBXLM.3.35.D02.1.454.CMB.1.raw
  modified_base (274)..(274): a, c, t, g, unknown or other
  misc_feature (274)..(274): n is a, c, g, or t
  modified_base (345)..(345): a, c, t, g, unknown or other
  misc_feature (345)..(345): n is a, c, g, or t
  modified_base (359)..(359): a, c, t, g, unknown or other
  misc_feature (359)..(359): n is a, c, g, or t
  modified_base (392)..(392): a, c, t, g, unknown or other
  misc_feature (392)..(392): n is a, c, g, or t
  modified_base (460)..(460): a, c, t, g, unknown or other
  misc_feature (460)..(460): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctgggggagcttggtccagcctggagggtccctgagactctcctgtgtggtctctggattcaccttcagggaccacttcagtggactgggtccgccaggctccgagggagggctggagtgggtgccgtataagaaacaagctagaagtcaccanagattacgccgcgtctgtgacaggcagtattcaccatctacaagagatcgattacaagcaatcagtctctntgacaaatcgaacnccagaacgacgagaccacggtcctatacttacncgcactacagtacttacaattagttggactactaccgaacttacgtacgggacctacgggcgtaccgnggttaccaccgtctcctccgcgcctaccaccgtaacggcctacgtccggtccctcccgtcgcccgtcccttcgccgtaccgacggtccaccgtacccgccggtacgacgtacccg

SEQ ID NO: 236741 - DNA, 679 bp, Homo sapiens
  misc_feature: GYAE6OF02HZ63M.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctcactctccctgcccgtcacccttggacagcccggcctccatctcctgcaggtctggtcaaagcctcgtgtacggtgatggaaacacctacttgaattggtatcagcaggacggccgaggcccaatctaccaagggccgacctaatctaagtaaggtttcgaaccgggacgtccgtggggtccccaagacagtattcaggcggctacgtgggtacagggcaacgttgtactttacactacgtagagtaattaggcgaggggttagggaggtacgtagggaggtaaggttggttagggttaagtttttagtttacgttacggtactacgttcggtactaacggtaccgtaaccgtaccgtaacccggtacgggtcccgttaacccgttaccggttttccgggacccggtacgggggtaacccgtaacggtacggttaagggaacgttaacgtaaccgtaaaaccggtaacgttcggtacggtaccgttacggacccgtaccgtacgttaccgg

SEQ ID NO: 236742 - DNA, 584 bp, Homo sapiens
  misc_feature: GYAE6OF02HYVVW.3.35.D02.1.454.CMB.1.raw
  modified_base (307)..(307): a, c, t, g, unknown or other
  misc_feature (307)..(307): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtacaaagcctcgtgtacggtgatggaaacacctacttagaattggtatcagcagaggccaggccaatctccaggcgacctaanctataaggtttcctaaccgggacgcgtggggtcccagacagacttcagcggcacgtggtacaggcatgattcacactgagtaatagacgtagggtggaggcgtaggacggtagttgggttagggttattttaacgtttcgtggtcagtggactaaggcctaacgactacgtcggtaccttacttacggtttaccggaccgcgggacgtacggacgtaaggtactaagtaaccaaacggtacgttacggtacggactacggacctaccgtagttaccg

SEQ ID NO: 236743 - DNA, 771 bp, Homo sapiens
  misc_feature: GYAE6OF02ISQUW.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctcgggtcccaggatccagtggggatgttgtggtgactcagtctccactctccctgcccgtcacccttggacacgccgccctccatcctcctgcctaggtctggtaccaaacgtcctcgtgtacggtgataggaaacctactacttagtaattggtactcagcagacgccacggaccaatcctacgaaggcacctaatcgtaagttaacgtttcgaaccggcgcgtcgggtccaagacagtacttacaggcgtacacgtcgggtacgacggacctacgttcgttaactttaccgaaccgtgttaagtaacgtaagttaacgaccggtaagggggttacggacggtacgtacgggtaagggtacggtttagggtttaggggtttaactttttaacgttttacgttacggtacttaacgtacggtaaccgtaaacggtaccttaaccgaaccgttaaccggttacgggttaaccccgttaaacgtttaacccggtttttaccggggaacccggtaaccggggtaacccgtaaacgggtttccggtaaacggggtaaacccgttaaaggtaaaacccggttaaaacccggttaaccggttacggttacgggtccgtaaacggtacccgttaacccggtaacgtttcccgg

SEQ ID NO: 236744 - DNA, 772 bp, Homo sapiens
  misc_feature: GYAE6OF02FTVYL.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtcctctactcctcctcgtcccgtcctaccgtcgacacggccggtcctcctactcctccgtgacgtcggtcgtgtacaacgtcctgtcgtaggtgagtacgaacctaccttagtagtagttcgtatcagcaggacgacctacggacctattcccaacgaacggtcctaaccttaatacgttaacgttaacggtttaccggaaaccgggtcgtacgggttccggggacctacggaaactacgtactaggacggtcggactacgggtgggtacgacggtcctacgtacgtttacttaccgaaccgttatacggtaaacgttaacgttaacgggaacgggttaacgggggtacgggtaacgggtacggtagggtaacggttacgggttagggtttaagggttttaattttacgtttacgtcggttaacttaaggtccgttaacgaactacgtaacaacgttacggttacggttaacccgttacttaccggtttacggaaccgggtaacggggtaacctacggtacgggttaaggaacggttaaccgtaaacggtaaaacgttacggtacgggttacggtaccgtaaccgtacctaaccgtagtttacccgg

SEQ ID NO: 236745 - DNA, 755 bp, Homo sapiens
  misc_feature: GYAE6OF02I14BY.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccaggtggggatgttgtggtgactcagtctccacctcctccctcgcccgtcacccttggaccagcccggtcctccactcctcctgcctaggttctggtaccaaagtcccttcgtggtacggtagagtacggaaacctaccttacttagtaagttggtatacgagacaggacggccgacggaccctaatccgtaccgaacggccgtactaactactaagttaacggttaccgtaaccgggacgtccgttacgggtcccaaggtactagtactacgacgacggctacggtacgggtcgacggcctacgttacgtactttaccacacgtaggtaacgtaacgttaggacggtagggggtacgtagggtacgtagggtagggtacgtttagggttagggtttaactttttagtttcggttagtaacgtagtacgtaactaagtaccgttaaccaacggttaccgtaccggttacccgttaaccgttacggttttcccgggaaccgggtaaccggggtaaccgtaacggtaccggtaacgggtaaccggtaacgtaaaccggtaaaccgttacggtacgggttacggtaaccgttcggaacccgttaccgttacgttaccg

SEQ ID NO: 236746 - DNA, 965 bp, Homo sapiens
  misc_feature: GYAE6OF02IZ7FT.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctcgcccgtcaccttggaccagcccggccctccatctcctgcgtacggtctggtacaacgcctcgtgtacggtgagtacggaacctaccttacttagtaagttaggtactcgagacacggacggaccgacggacctaaacttccgtacccgaaggtccggtaccttaagttaccgttaacggtttaaacgggttttacccggtaaaacccggggtaccggtacccgggtttaccgggggtacccccgtaacggtaaccgtaacggtaacgttttaccgaaccgggtacccgggtacccggtaaccgggtttcggggggttacccgtaacgggggtaccgttaaaccggtttacgggtttaactttttaaccccgaacccgtttaaaccggttacgggtaaaacgggttaaaacggttttaacggggtacccgggttaaacggggggggtttagggggtaacggggttaccgggttaggggtaacggggttaacgggttttgggggtttttaacggggtttaaacgttttttttaaggttttacccggtttacggtacgttaaacgggtttacggtaaccgtaaagttacccgttaaccgtaaccgtaaccgtttaccggggttaaccccgtttaaacccggttttaccgggttttttaaccgggacccggggttaaaccggggacccgttaaaccgggttacggttaacgggtaaacggtaaacgtaaccccgttaaacggtacgttacgggtacgtaccgtaccggtacccgtaccgtacgttaccg

SEQ ID NO: 236747 - DNA, 803 bp, Homo sapiens
  misc_feature: GYAE6OF02ITGLR.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactcctccctgcccgtcacccttggacacggccggcctccattcctcctcgcgacggttcgttggtacgaaacggtccgttcggtacggtcggtgagtacggaaaccaccttacgttagaagtttcggttattacgaacgtcaacggaggtaccgaacgggacccaacttacccgtaccgaaacggtaccggtaaccttaactaccgttaaacgttaaaccgggttttaaccgtaaacccgggaccggtaccgttcgggggttacccaacgtacgtacggtaacttacgacggtccgggaccttacgggttacggtacgtaacggccgtaaaccggttgtaaccgttttcccaaaccggtaccttaaggtaaacgttaaacggtttaaacggacggtacggggggtaggggacgggttaaccgtagggaacggttaggttagggtttacgggtttagtttttacgtttacgtacggtataacgtcgggtaaactaggtaacctacgtacgtaccggtaccggtaccgttaccgttaccgtttacgggaccgaacgggtaccgtaaggtcgtacggaagacctaaccgaaaccgtacgtaggtccggacgtaccggacctaccgttagtaccgg

SEQ ID NO: 236748 - DNA, 844 bp, Homo sapiens
  misc_feature: GYAE6OF02GM879.3.35.D02.1.454.CMB.1.raw
tcagagacgcactccacgaccggtgctcgatttagcacacgatagttgggtttgggggatcaggactcctcagttcaccttctcacaatgaggctccctgctcagctccgtggggctgctaatgctcgtcgggtcccaggatccgaggtggggatgttgtggtgactcagtctcactctccctgcccgtcaccgttgacacgccggcctcatcctctgctacggtctacggtacaaacgtccgttacggtagtaacggttagagttacggaaaacctaccgttaacttagtaaagttcggtaactacgacgtacgaaggacggaccgacggtacctaacgtaccgtaccgaaacggtccgtaaccttaaacgtacgtaaacgtttaacggtttaccgtaaaccgggtacgtaccgttacgggggtaccctaagaaccgtaacggtacttacgaacggaccggtacgacggttcgggtaactacgggaacctacgtacgttaactttaccgaacgtaacgtacggaagtaaacgtttacggacggtacggggtacggacgtaccggttaaggaaacggtacggttacgggtttaaggtttaaacgtttacggttttacgtacgtacgttaacgtaccggtaacgtaaccggtaaccgttaaccgtaaccgtaacggttacccgggttaaccgttaacccgtttaaccggtttaacgggacccgggttaaaccgggtaaccgtacgggtaaccggtacgggtaaaccgtaaccgtaaaccgttaaaacgtaaccggttcggtaaccggtaccggttaacgaacccgttaaccgtagtttaacccgg

SEQ ID NO: 236749 - DNA, 158 bp, Homo sapiens
  misc_feature: GYAE6OF02HTU4I.3.35.D02.1.454.CMB.1.raw
  modified_base (139)..(158): a, c, t, g, unknown or other
  misc_feature (139)..(158): n is a, c, g, or t
tcagagacgcactccacgaccggtgctcgatttagcacacgatagttgggtttgggctgaccaaggtcaccgtcctaggtcagcccaaggccaacccccactgtcactctgttcccaccctcctcgagtcgcgtctctnnnnnnnnnnnnnnnnnnnn

SEQ ID NO: 236750 - DNA, 676 bp, Homo sapiens
  misc_feature: GYAE6OF02IVKDF.3.35.D02.1.454.CMB.1.raw
  modified_base (352)..(352): a, c, t, g, unknown or other
  misc_feature (352)..(352): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgtggtctctggattcaccttcagggaccacttcatggactgggtccgccaggctccgagggagggctggagtggtgccgtataagaaacaagctagaagttacacacagatacgccgtcgtcgtgtgacaggacagattcaccatctacaagacgatagattacaagacaactcagtcgtacctntcgacaaatcgaaacctaccgtagaacgaccgaaggaacaccggtaccgttactaacgttactacgtaccgtactacgtagtaacttactaagttacgttagggtacgtacgtaacggtaacgtaccggtacggggcccgaacggtaaccggtaccgtaggtaccccccccccgtagttccctacctccgaccgtcccgtacccgaaccgtaaccggtaccctaccggtaccgttcccgttacccccgtccggtcccgtacccgtccgtcccgttacccgacgggtaccgacccgtacccggacccgtacggaccgtaacccgg

SEQ ID NO: 236751 - DNA, 802 bp, Homo sapiens
  misc_feature: GYAE6OF02HQH3K.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctcgtgggtcccaggatccgaggtggggattgttgtggtgactcagtctccactcctccctcgcccgtccaccgttggacacgccggcctccatcctcctgcgtacggtcgttggtacaaacgtccgttcggttacggtacgggtagagtaacggaaacctaccgttacgtttagtaagtttggtactacgacgtacgaaggaccggaccgacggacctaagtcccgtaccgaacggccgtacctaagttacgttaacgtttaacgggttttacccgtaaccggggtacgtccgggttaccgggtaccccgaaggtaactacggtacgttaccggacggaccggtacgtacggttacgggtaccacggtccgtaacgttacgttaacgtttaccgaacgtacgtaaggtaagttaacgttaacggacgggtaggggtacgggtacggtacgttagggtacggtaggtttacgggtttagggttacgtttttacgttaccgttagacgttagtacgtaacgtaaccgtaccgtaaccgtacgtcggttaccggttacccgttaaccgttacggtttaccggccggtaacgggtaccgtaaggacggttacggaacgttaaccgtaaccgtaaacgtacggtcggttaccggtcgttaccggaccgtaccgttacgttccg

SEQ ID NO: 236752 - DNA, 781 bp, Homo sapiens
  misc_feature: GYAE6OF02IKQHX.3.35.D02.1.454.CMB.1.raw
tcagagacgcactccacgaccggtgctcgatttagcacacgatagttgggtttgggggatcaggactcctcagttcacctttctcacaatgaggctccctgctcagctcctggggctgctaatgctctgggtcccaggatccaggtggggatgttgtggtgactcagtctccactcctccctcgcccgtcacccttggacacgcccggcctccatcctctgcacggtctggtacaaacgtccttcggtcgtacggtgagtacggaaactaccgttaacttagtaagtttggtactacgagacgaggacggaccgaacggacctaaacttccgtaaccgaacgggtacctaacccgtaagttaccgtttaaacgttaaacggttttacccggtaaaccggggtaccgtaccgggttaccggggtacccctaggaacgtacgtacgttacgacggtccggtaccgtacggttcgggtaccgaacgggtacctaacgttacgttactttaccaacgtacgttaggtaagtaacgttacggacgggtaaggggtagggacgtacggtaggtacgggtagttagggttagggtttatttttacgttcggtctacgtacgtcgtaacgtaacgtacctaaccgtacgtaccggttcggaacccgtttaacgttacggtttaccggaccgggttaaccgggacctaacggtacggtaacggtaaacgtacgtaaaacgtaaacggttacggtcggtacggtacctaccggacctaccgttattaccgg

SEQ ID NO: 236753 - DNA, 688 bp, Homo sapiens
  misc_feature: GYAE6OF02GSIFV.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctgggtcccaggatccagtggggatgttgtggtgactcagtctccactctccctgcccgtcacccttggacacgccggcctccatcctcctgcaggtctggtcaaacgcctcgtgtacggtgacgtggaaaccaccctacttagaagtttcggtatcgacgtcaggacggccaggcccaagtccgtaccaacggccgtacctaacttacgtaagttaaacggtttcccgtaaaccggggtaccggtccgttacgggggtccccacgacgagtacgtttacgacggccgggccacgttggggtacgagggcctaacgtcgtaacttttccaaccgtcgtagtaacgtaagttacgacgtaggggtggacggtctagggacgtagttggttaggttattttagtttcgtagtcgtagtcgtacgtaacgccttaacgacgtacgtcggtacccgttacgtacgtttcggaccggtacgggtaccgacggtacgtacggaacgtagtaacccgtaaaccggtacggttacggtacggtaccgtacggtaccgtacccgtagttcccg

SEQ ID NO: 236754 - DNA, 556 bp, Homo sapiens
  misc_feature: GYAE6OF02HG4YP.3.35.D02.1.454.CMB.1.raw
  modified_base (215)..(215): a, c, t, g, unknown or other
  misc_feature (215)..(215): n is a, c, g, or t
  modified_base (245)..(245): a, c, t, g, unknown or other
  misc_feature (245)..(245): n is a, c, g, or t
  modified_base (254)..(254): a, c, t, g, unknown or other
  misc_feature (254)..(254): n is a, c, g, or t
  modified_base (338)..(338): a, c, t, g, unknown or other
  misc_feature (338)..(338): n is a, c, g, or t
tcagagacgcactccacgaccggtgctcgatttagcacacgatagttgggtttgggggatcaggactcctcagttcaccttctcacaatgagctccctgctcagctcctgggctgctaatgctctgggtcccaggactccagtggggatgttgtggtgactcagtctccactcgtccctgcccgtcacccttggacagccggcctccatctcctncaggtctggtacaaagtcctcgtgtacggngatggaacncctatagaattggtatcagcagagtccaggccaatctccgaggcgcctatctatacggttcaaccgggcgcgtgggtccagacngatcagcgcacgtggtcaggcatgactttcacacgtgagtatagcgtagggtggaggtctggaggtagtgttagggtattttagttcgtgtctagtcggtactacggactacgactacgtcgtaccgtactacgtttcggaccgtagggacctaggtccgtaggtacgtactaacgtaacgtacgtacgtcggaccgtcggtactaccgtacttaccg

SEQ ID NO: 236755 - DNA, 966 bp, Homo sapiens
  misc_feature: GYAE6OF02JD6SU.3.35.D02.1.454.CMB.1.raw
tcagagacgcactccacgaccggtgctcgatttagcacacgatagttgggtttgggggatcaggactcctcagttcaccttctcacaatgagctccctgctcagctccgtgggctgctaatgctcgtggtcccaggactccagtgggatgttgtggtgactcgagtcctccacctcctccctcgccccgtacctacccgttaggacgaccgcccggtcctacctactcctccgtgacgcgggttaccgtaggtacaaaccgtccgtacggtacggttacggtaggtaacgtaacggtaaaacctacccgttaagtagtaacgttgtaactacgacgtaacgaggtacgaccggtacggtaacccaagtcccgtaccggaacggtcccgttaaactttaaagtttaacggtttaaaccggtttaaccggtaaaccggtccgttacgggtaccggtaacccgagtaacgtaaggttaacctacggacgtaccggtacggtaggtaccggtacggaacggtcgtaaacgttcgtttaaccgttaacccgtaacgttaaacgtaaaacgggtaaacctacggttaaacggacggggttaaacggggtacggtaaccgggttaggtaaccggggttaaaaggggtttacggttttaacgggggtttttaaacggggttttaaattccgggtaacggtacgttaaccggggttacgtaaacggtaaaaccgggtttaactaacccggtaacgggttaccccgtaccccggggtttaaacccggttacccggggttaccccggttaaacccgggaaacccgggtaaaccggttaacgggtaaaccgtaaacggaaaccccgttaaaaggttcccggggtaggtaaccggttaacccaaccggtacccggtttaaactccggttttaacccggtaccgttttacggttaaccccccgtttagttaaccccccgg

SEQ ID NO: 236756 - DNA, 658 bp, Homo sapiens
  misc_feature: GYAE6OF02JSLUV.3.35.D02.1.454.CMB.1.raw
  modified_base (204)..(204): a, c, t, g, unknown or other
  misc_feature (204)..(204): n is a, c, g, or t
  modified_base (480)..(480): a, c, t, g, unknown or other
  misc_feature (480)..(480): n is a, c, g, or t
  modified_base (654)..(654): a, c, t, g, unknown or other
  misc_feature (654)..(654): n is a, c, g, or t
tcagagacgcactccacgaccggtgctcgatttagcacacgatagttgggtttgggggatcaggactcctcagttcaccttctcacaatgaggctccctgctcagctcctggggctgctaatgctcgtgggtcccaggatccgaggtggggatggttggtggtgactcagtctccactctccctcgcccgtcacccgttggacncgcccggcctcatcgtcctgcaggtctggtacaacgtcctcgtgtacggtgagtacggaaaccaccttagttgaagttggtatacagacaggacggccaagaacctaactccgaccgtaaggccgtaccttaagtccttaaacggttaaacgggtttacccgtaaaccggggtacgtccggttaccgggggtacccctaaggaactaggtacttcgacggtcgacacggtgggtcagacctagtgtacttccacgtacgtagtacgtaagtacggnggtaagggtcggaggtgtaggaggtagttggttacggttattttacttgtagagtgagtacgtacgtacgtcgtacgtcggtacggtaccttacgtacggttacggaccggagggtaccaggtccgtaaggactacgtaacgaaacgtagttggcgaccgttacggctaacgtntcgg

SEQ ID NO: 236757 - DNA, 618 bp, Homo sapiens
  misc_feature: GYAE6OF02I5CR3.3.35.D02.1.454.CMB.1.raw
  modified_base (288)..(288): a, c, t, g, unknown or other
  misc_feature (288)..(288): n is a, c, g, or t
  modified_base (442)..(442): a, c, t, g, unknown or other
  misc_feature (442)..(442): n is a, c, g, or t
  modified_base (462)..(462): a, c, t, g, unknown or other
  misc_feature (462)..(462): n is a, c, g, or t
  modified_base (494)..(494): a, c, t, g, unknown or other
  misc_feature (494)..(494): n is a, c, g, or t
  modified_base (516)..(516): a, c, t, g, unknown or other
  misc_feature (516)..(516): n is a, c, g, or t
  modified_base (580)..(580): a, c, t, g, unknown or other
  misc_feature (580)..(580): n is a, c, g, or t
  modified_base (586)..(586): a, c, t, g, unknown or other
  misc_feature (586)..(586): n is a, c, g, or t
tcagagacgcactccacgaccggtgctcgatttagcacacgatagttgggtttgggggatcaggactcctcagttcaccttctcacaatgaggctccctgctcagctcctggggctgctaatgctcgtgggtccccaggatccaggtggggattggttgtgatgactcagtctccactcctccctcgcccgtcacccgttggacacgccggcctccatcctcctgcagtctagtcaaacgcctacgtatacagtgataggaaaccaccttactagtaattgtttcagnaggaggccaggaccaactcctaccgaaggccgtaccttaatttagttaacggtttcctaaccgggtacttcggtcggggtacccagtacgagtattaccgaggccgtacgtacggtcgggtcgacgcgtatagtactttacgactagtataaancgagcgaaggggtggacggngtagagtaggttggtttagggtttatcgtagntacgtagactaacgtacaccgngtccggcctccggtaccgtcggccggacggaaccaaggtacgaactacggtaaacgtcgtaggngtaccngtaccaccgtagtctaccgttcgtactacccg

SEQ ID NO: 236758 - DNA, 709 bp, Homo sapiens
  misc_feature: GYAE6OF02GDYVK.3.35.D02.1.454.CMB.1.raw
  modified_base (252)..(252): a, c, t, g, unknown or other
  misc_feature (252)..(252): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtcctccactctccctgcccgtcacccgttggacacgcccggcctaccatcctcctgctaggtctggtacaaagcctcgtgtacggtnagtaggaacacctactgaattggtatcagcagacggccaggacctaatctaccgaaggccgacctaacgttctaaagttaacggtttaccaaaccggggacgtaccggttcggggtacccaaggtaaccagtacttacgacggacggaccaacgttggggtacaaggtcaacgttagtaacgtttacccaaactacgtaggaacgtaaacgttacgacggaggggtaggtaggtacctagggtaacgggtagttacgggtttagggttaatttttaagtttcgacgtaccgtaagtcgaacgtaacgtaccgttacgaaccgtacgttcggtaacccgttaaacgttcccgttttacggaccggtaaccgggtaacgtaacggtccgtaaggaactaacgtaaacgtaaaccggttaacgtcgttacggacctacgacctaacggtacctttaccgg

SEQ ID NO: 236759 - DNA, 741 bp, Homo sapiens
  misc_feature: GYAE6OF02I8JUL.3.35.D02.1.454.CMB.1.raw
  modified_base (155)..(155): a, c, t, g, unknown or other
  misc_feature (155)..(155): n is a, c, g, or t
  modified_base (506)..(506): a, c, t, g, unknown or other
  misc_feature (506)..(506): n is a, c, g, or t
tcagagacgcactccacgaccggtgctcgatttagcacacgatagttgggtttgggggatcaggactcctcagttcaccttctcacaatgaggctcccctgctcagctcctgggctgctaatgctctgggtcccaggatccagtggggatgttgngggtgactcagtctccactcctccctgcccgtctacccgttggacacggcccggcctcactctcctgcgtagtcgtgtacaagcctcggtgtacggtgatacggaaaccaccgtacttagaattaggtactcgtacgcgaaggacggtaccgacggacccaatcctaccgacggccgacctaacgtactaacgttaacgggtttcgaacccgggaccgtccgggtaccggggtacccaacggtacgacggtactacggagtacgggcgtaccgttgggtaccacgggactaccgttcgtagtttaccaaccgtactggaacgtaacggtagtacgggagggttaggacggngtacggaacgggtgttaggggttaacggtttagtttttacgttaccggttaacgtcgtaagtacggtaacacggtacctacggacctaacggttacgggtaccgttaccgttaaccggtttacggtacccgggtaacgggtacccgtaaaggtaccggttacgggaaccgtacggttaacccgaaaaggtaacccgttacgtagggtcctaccggtaccacccgtagttacccgg

SEQ ID NO: 236760 - DNA, 925 bp, Homo sapiens
  misc_feature: GYAE6OF02H7K0E.3.35.D02.1.454.CMB.1.raw
tcagagacgcactccacgaccggtgctcgatttagcacacgatagttgggttttggggggatcaggactcctcagttcaccttctcacaatgaggctccctgctcagctcctggggctgctaatgctctgggtcccaggatccaggtggggatgttgtggtgactcagtctccactctccctcgcccgtctacccttggaccacggcccggcctccattcctcctgcgacgggttctcggtaccaaacgtcccttcggtaggttaccgggtgaacgtacggtaaaacctaccttacgttagtaagtttggtactacgagacgaacggacggccgaggtacccaatccgtaccgaagggccgtacctaagttacgttaagtttaaaccgggttttaccgaaaccggggtacggccggttaccggggtaccctaacggaacgtacgtaacgttaccggaacggccgggtactaaccgggttcggggtaaccgtaacgggtccttaacgttacgttaacgtttacccgaaccgtaacggtttaggaaagttaaacggtttacgggaccggggttaaaggggggtcggggtaaacggtcggtaacggggtaagggttaagggttttacggggttttaagggttaacgtttttttaggtttaccggttaacgttaaccggtcggtttaacggaaccgttaaccggttaaccttaacccggtaacgttaccgggttaaccgggttacccggtttaaacccggtttacgggtttttaacccgggggaccgggtaaaccgggggttaacccgtaacgggtaccggttaacggggttaaaccggttaacggtaaaaccccggtaaaccggttaaccggttcgggtaaccgggttccgtaaccgggtaaccctaacccgggttcgtttaacccgg

SEQ ID NO: 236761 - DNA, 678 bp, Homo sapiens
  misc_feature: GYAE6OF02F6TBK.3.35.D02.1.454.CMB.1.raw
tcagagacgcactccacgaccggtgctcgatttagcacacgatagttgggtttggggtgatcaggactcctcagttcaccttctcacaatgaggctccctgctcagctcctgggctgctaatgctctgggtcccaggatccagtggggatgttgtggtgactcagtctccactctccctgcccgtcacccttggacagcccggcctccatcctcctgcaggtctggtacaaagcctcggtgtacggtgagtaggaaaccacctacgttagaattggtaatcagcaggacggccaggcctaatcctacgaacggcgacctaatacttaagttaacggtttaccgtaaaccggggtacgtccgttacgggggtaccccaaggtaccgaagtacgttacgaggccggtacacggttgggtcacgggctaacgtggtactttccgaactacgtagtaacgtaaagttacggacgtagggggtaggacgggtccgtaggaaggtagttagggtttaggtatttttacggtttctgtacgtagtagtaccgaacggtctaacgtacctacgtacggttacccttacgttacgttttacgggaccgtacggggtaaccaggtccgtaaggacgtaacgtaaccgaaacggtacgttaggtacggtactacggaccgtaccttacg

SEQ ID NO: 236762 - DNA, 831 bp, Homo sapiens
  misc_feature: GYAE6OF02JPYPP.3.35.D02.1.454.CMB.1.raw
tcagagacgcactccacgaccggtgctcgatttagcacacgatagttgggtttgggggatcaggactcctcagttcaccttctcacaatgagctccctgctcagctcctggggctgctaatgctctgggtcccaggatccaggtggggattgttgtggtgactcagtctccactctccctgcccgtcacccttggacacgcccggcctccacttcctccgtgaccgtacggttccgtacggtacaaacgtccgtcggtcgtacggtgacgtacggaaaacctaccttacgttagtaagttggtaactacgacgacgaacggacggaccgaacggtaccctaaatcccgtaccggaacggtaccgtacccttaaagttaccgttaaaggtttaaacggtttaccgaaaaccggggtaccgtaccgggttaccgggtacccgaaacggtaacgtaacgtacgtttaccggaaggtacccgggtacctaacgggttacgggtaccgtaaacgggtacccgtaacgtttacgttaaccgttttacccaaaccgttaacggtaacggtaaacggttaaaacgttttacggggacgggttaaaccgggggtaaggggtaacggtacggttacgggaaggttaggtttacgggtttaggttacttttaacgttcgacgtatacggtacgtaacctaaacggtacctaacgaacggttacgtaccgggtaccttaaccggttacgttaccgggacggtaaccgggactaggccggtttaacggaactacgtaaaccggaacgttagacggtcgaaccgttacgaacttacgtacgtacg

SEQ ID NO: 236763 - DNA, 622 bp, Homo sapiens
  misc_feature: GYAE6OF02HHL6I.3.35.D02.1.454.CMB.1.raw
  modified_base (372)..(372): a, c, t, g, unknown or other
  misc_feature (372)..(372): n is a, c, g, or t
tcagagacgcactccacgaccggtgctcgatttagcacacgatagttgggtttgggggatcaggactcctcagttcaccttctcacaatgaggctccctgctcagctcctgggctgctaatgctctggtcccaggatccagtgggatgttgtggtgactcagtctccactctccctgcccgtcacccttggacacgccggcctccactctcctgcaggtctggtacaacgcctcgtgtacggtgatggaacactacttgaattggtatcagcagacgcacggaccaatctccaggccacctaatctagtaacggttaccgtaaccggacgtcgtcgggtcccagacagactcagcgacacgtggtcgcggcncgtagtcttacactactgaagtagtacggacggtagggtaggtacggtacgtaggtaacgggtagttcgggtttagggttaattttacgtttcgtgtactacgtacgacgtaacgtcctaccgactaccggttcggtacccgttaagttaccggtttcggaccggtaacgggaccgtacggtacgtacgggtacgtaacgtaacgaaaccggtacgttcggacggtactaccggaccttacgtacttccg

SEQ ID NO: 236764 - DNA, 759 bp, Homo sapiens
  misc_feature: GYAE6OF02J0LVX.3.35.D02.1.454.CMB.1.raw
tcagagacgcactccacgaccggtgctcgatttagcacacgatagttggggtttgggggagtcaggactcctcagttcaccttctcacaatgaggctccctgctcagctcctggggctgctaatgctctgggtcccaggatccaggtggggatggttgtggtgactcagtctccactctcctcgcccgtcacccttggaccgacggccggccctccacgtcctcctgcacggtctcggtacaaacggcctcggtgtacggtgactaggaaacctaccgttacgttagtagttggtatacgagacagtacggccaggtaccaagtccaccgaacggtcgtacctaacttacgtaacgttaacggtttaccgtaaacccggggaccggtacggtaccggggtaccccacgggtaaacgaacgtaacgttaccgacgggtaccggtacctacggggtacggtacgtaacggcgtaacgtacggttaaccgttaccgtaaccgtacgttagtaacgggtaaacgtaggtacgggtacggggtacggtagggttacggaggtaacggtcgtaagggttcggttaatttttcgtacgttcgatagtcgtaacgtaacgtcctaacgagtaccgtacgtaaccgttcgttacttccggggacgtaacgggaccgtaggttaccggaagggtactaagggttaaacccgaaacggttacggttacggtcggtaacccggtccgttaacgacccggtaatttcccggg

SEQ ID NO: 236765 - DNA, 708 bp, Homo sapiens
  misc_feature: GYAE6OF02IFM4E.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgccccgtcacccttggacaggccggcctccatcctcctgcaggtctagtaccaaagcctacgtatacagtgatacggaaacaccttattgaattggttcagcagagccgaggccaatcctccgaacggcgtacctaagtttataacggtttcgaaccgggtactcgtcggggtaccctaagacctagtacttcgacgcggtcgaaggttggacgtaggactaccgtgtacgttttaccaacgtacgttaggtaaaaccttcgaacggtaccggtaggggtagggaacgggtcgttaagggaagggttacgtttaggggttttcggggtttaaatttaaccggtcgtacgtacgtacgaccgtaaaggttaccacgttaaccgtccggtaccctaccggtaccggtttccgaccgtaaccgggaacccgtaagggtacggtaaacgtaaccggaaacggtacccggttagtaccgggtccttacgacccgacgttaacgttccgtacgttacttccgactttacccccgg

SEQ ID NO: 236766 - DNA, 630 bp, Homo sapiens
  misc_feature: GYAE6OF02F71Y0.3.35.D02.1.454.CMB.1.raw
  modified_base (282)..(282): a, c, t, g, unknown or other
  misc_feature (282)..(282): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctggggggaggcttggtccagcctggagggtccctgagactctcctgtgtggtctctggattcaccttcagggaccacttcatggactgggtccgccaggctccgagggaaggggctggagtgggttggaccgtataagaaacaaagctagaagtacaccanagattacgcgcgtctgtgacaggcagacttcacctatctacaagagatgattcaaagccaactcaagtgtctcttgacaaaagtcgaaacctaccccgtagaaacgacccgaaggaccaaccggccgttactaacttacgtacgacgaccgttacaacgtattacagttacgttggacgaccttacggaacttaccggtacgggaccgacgggtacaccggtcggtaccgaccgtccgtaccctacgaccggtcccaccgaaccgaacggacccacgtccggtcccttccccggtgcccgtcccgtcgcctaccgacggtaccgccgtacccgtccggagccgtaccg

SEQ ID NO: 236767 - DNA, 727 bp, Homo sapiens
  misc_feature: GYAE6OF02FPDCV.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctcgtcgggtcccaggatccaggtggggattgttgtggtgactcgagtctccactcctcccgtcgccccgtacctacccgttggacacggcccggcctccactcctcctgccgaggtcgtacggactaaacgtcctcggtggtacggtagagtacggaaacctaccttagttagtaagttcggtatcaacggcgaaggacggccacggaccaacttccgaccggaacggccgtacctaatcgttaaagtttacggtttacccgaaccgggcgtcggtacgggtacccagacagtactcgaggccgactagggtcggacgacggtctacgtagtacttacacctagtagaacgtaagtacggacgggtagggtaggacggtacgtagggtagtcgggttaggttaggtttacgtttacgtttcgagttaccgagttcgaactaaacggtctaacgtaacccgttacggtaaccggttccgttaacttaccgggtttccgggaacccggggtacggtaaccgtacgggtaccggtaaggtaacctaacggtaaaccgaacggtttacgcgggttacggcgttaccaccggtacttacgttacccgg

SEQ ID NO: 236768 - DNA, 881 bp, Homo sapiens
  misc_feature: GYAE6OF02ID4SY.3.35.D02.1.454.CMB.1.raw
  modified_base (825)..(825): a, c, t, g, unknown or other
  misc_feature (825)..(825): n is a, c, g, or t
tcagagacgcactccacgaccggtgctcgatttagcacacgatagttgggtttgggggatcaggactcctcagttcaccttctcacaatgaggctccctgctcagctcctgggctgctaatgctcgtcggtccaggatccgaggtggggatgttgtggtcgactacgagttcctccgtactccgtcccgtcgcccgtcctacccgttgggaccacggcccggtccctccacttccttccgttcgccgtaacgggttccgttaggtaaccgaaacgtccccgttccggttaggtacggtacgtaacggttaacggaaaaccgttacccttaaaccgtttaggtaaacgtttacgggtacttaaccgtacggaacgaacggtaacccggccgtaaccgggaccctaacgttaccctaaccccggaaacgggttccctaaccttttaaacgtaccggttttaaccgtttaaaccggggttttaacccgggaaccccggggttaagttcccgggttaacccgggggtaaccctaaggggttaaccgtacgttaaccgtttacggacggttcccggacgtaccggtttaacgggaccgtacggtccctaacgtttacggttaaacctttaccgaaccgtttacggtacgttaaagttaccgtttacggaaccgggtaggggttacggagggtacgttgggtaacggtttcggttagggtttaacgggtttatttttaaccgttggtttaccgtcgtaaaggtccgtaacgtaacgtacctacgtacgttaccgtaccggttacttacgttcggtacggacgagtacccgngtacggtagtacgtacgtacgtaacgtcgtacgtcgactcggacctagtgttaccg

SEQ ID NO: 236769 - DNA, 829 bp, Homo sapiens
  misc_feature: GYAE6OF02JC7AG.3.35.D02.1.454.CMB.1.raw
  modified_base (251)..(251): a, c, t, g, unknown or other
  misc_feature (251)..(251): n is a, c, g, or t
  modified_base (811)..(811): a, c, t, g, unknown or other
  misc_feature (811)..(811): n is a, c, g, or t
tcagagacgcactccacgaccggtgctcgatttagcacacgatagttgggtttggggatcaggactcctcagttcaccttctcacaatgaggctccctgctcagctcctgggctgctaatgctctcggtccaggactccaggtggggattggttgtcggtagtacttcgaagtcctaccacgttcctacccgtcgccccggttctaacccgttggaccacggtccccgggccctcgaacttccgttaccgngaccgtaggttcctacgggtacaaacggccttcggtacggtacggtagaacgttacggaaacctacctaacgttagtaagtagggttacacgtacacggtaacgcggtcctaaggaccctaagttcccgtaacgaacggtccgaccttaaacgttactaacgtttaaccgggtttaccaaacggggttacccgtacggttaccggggtacccggaacgtaaaccgtagggtaccttaacgggaaccggtccggtaaccgttacgggtttcggggaacctaaccgggtactaaccgggtttaacggtccttttaacccgaaccgttaaccgttagtaaccggttaaacccgtttaggggtaacgttaaccggggggtacgtttaacgggtaccgtagggggttaaccgttgggtttaacggggtttagttaacgttttacgtttacgttacgtacgttacgtagaacgtcgttaaaccgtccgtacgtaagtccgtaaccgtacttaccggttacgcggtaacggtcacggtgacgtactaacacgtaacgtagtcgtacncgtcgaccacttacgtcg

SEQ ID NO: 236770 - DNA, 792 bp, Homo sapiens
  misc_feature: GYAE6OF02IFJEC.3.35.D02.1.454.CMB.1.raw
  modified_base (199)..(199): a, c, t, g, unknown or other
  misc_feature (199)..(199): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccaggtggggatgttgtggtgactcagtctccactcctccctgcccgtcacccttggacncgccgcctccatcctcctgctaggtctggtacaaacgtccgtcgtgtacggtgagtacggaaacctaccttagttagtaaagtttggtactcgacgacgaaggaccggaccgaacggtaccctaaacgttccctaacccggaaacgggtcccgtaacccttaaaacgttccgtttaaaacgtttaaaccggggtttttaaccccggtaaaacccggggtacccggtacccggggtttacccgggggtaaccccccaagggtaaacccgtaaacggttacctttaccggaacggtcccggtaccgtaccggttcgggtaccgacggtactacgttacggttactttacgacgtacgtagtaagtagttacggcggtaggggtacgaggtcgtagggtaggtaggttggtttagggttatttttacgttcgtacgtcgtagtacggactaacgactacgacgtaccgtcgtaccgttacgttacggttaccggaccgtacgggtacccaaggtccgtaagggtaacgtaacgtaaccggtaaacgaccggtttacggtaccggtccgtaaccggtaccgtaccgttacgttaccg

SEQ ID NO: 236771 - DNA, 779 bp, Homo sapiens
  misc_feature: GYAE6OF02JWNYC.3.35.D02.1.454.CMB.1.raw
  modified_base (208)..(208): a, c, t, g, unknown or other
  misc_feature (208)..(208): n is a, c, g, or t
tcagagacgcactccacgaccggtgctcgatttagcacacgatagttgggtttgggggatcaggactcctcagttcaccttctcacaatgaggctccctgctcagctcgtgggctgctaatgctctgggtcccaggatccagtggggatggttgtggtgactcgtacgtctccacctcctccctcgtccccgtcctacccgttggacncgcccggccctccactcctcctgcgaggttcgtcggtacgaaacgtccgtcgtcggtacggtagagtacggaaacctaccttacttagagttgtatcgacgcgtaggacgccgaggacctaactcgtaccgacggctaccgtaatcgtaagttacgggttacctaaccgggacgtacggtccgggtccaagtacagtacgttcgaacggcgtccgtacggtacggttacgacggtactacgttactacgtaccgtacgtaaccgtacgtaagttaacggttaaccggacgggtaacggggtaaggggtaccggtaggtagggtagggttaacggtttagggtttaggtttaaacgtttttcggttacgtacgtacttcgttaccggtaacgtaaccggttaaccttaccggtaaccgttaaccggtccggttaacccgttaccgttaacgggtttaacccgggccgggtaaaccgggtacgtaaccgggtaggtaacgggtacgtaagtaaacccggtaacgttaacggttcggttcggaaccgttccggaaacgttccgtacgttttccg

SEQ ID NO: 236772 - DNA, 868 bp, Homo sapiens
  misc_feature: GYAE6OF02FZISR.3.35.D02.1.454.CMB.1.raw
  modified_base (259)..(259): a, c, t, g, unknown or other
  misc_feature (259)..(259): n is a, c, g, or t
  modified_base (434)..(434): a, c, t, g, unknown or other
  misc_feature (434)..(434): n is a, c, g, or t
tcagagacgcactccacgaccggtgctcgatttagcacacgatagttgggtttggggatcaggactcctcagttcaccttctcacaatgaggctccctgctcagctccgtgggctgctaatgctcgtgggtcccaggatccgaggtggggtatgttggtggtgactcagttcctccactcctccctcgcccgtcaccgttgacacgccgcctccatctcctgctaggtctaggtacaacgtccttgtacggtaggtganacggaaacctacctacttgtaagttggtatacgagtcgaggtacgaccgacggtacaacgttccaccggaaggcctaaccgtaacttacgttaacgtttaaccggtttaccgtaaccgggtcgtcggttaccgggtacccaagaaccgtagtacgttaccgacgggacgtaccgnggttacgggtacgacgtacgtacgttacgtacctttacgaacctcgtaagttaacgtaaggttacggtacgggttaaggggtacgggtacggtaccggtaagggtaaggttacggttaacgggttttacgggttttaaacctttttacgttttacggtaccgtttacgtaacggtttaacccggtaacgttaaacccggttaaccctaacccggttaccgttaacccggggttacccgttaaaccccggttttaagttaaccccggggttttaccggggaaccccgggttaacgggggttaacccgaaccgggttaaccgggtaacggttaaaccggtaaaccgttaaacccggtaaacgggtttaccgggttacgggtaacccgggttaaccgtacccgtaacccggtttaaccgttaccgtttaaccccggg

SEQ ID NO: 236773 - DNA, 843 bp, Homo sapiens
  misc_feature: GYAE6OF02F5ZN9.3.35.D02.1.454.CMB.1.raw
  modified_base (786)..(786): a, c, t, g, unknown or other
  misc_feature (786)..(786): n is a, c, g, or t
  modified_base (827)..(827): a, c, t, g, unknown or other
  misc_feature (827)..(827): n is a, c, g, or t
tcagagacgcactccacgaccggtgctcgatttagcacacgatagttgggtttgggggatcaggactcctcagttcaccttctcacaatgaggctccctgctcagctcctggggctgctaatgcttcgtcgggtcccaggactccgaggtggggatgttgtggtgactcagtcctccacctcctccctcgcccgtacacccgttggacacggcccggcctccattcctccgtcgacgtacggttcgttagggtaccaaacgtcccgttcggttacggtaaccgggtggaacgttaacggaaaaccctaccctttaacgttaggttaaacgtttcggttaactccgaacggcgaaggaccgggaccgaacgggaccctaaacttaccgtaacccggaacgggtacccgtaaccgttaacttaacgtttaaacgtttaaaccgggttttacccggtaaacccggggtaccggtacccgggttacggggtaaccccaacgggaccgtaacgtacgttacgacggggtccgtcgtaaccgggttcgggtacgtacgggacctaacgttagttaccctttacgaaccgtaacggttacgaacggttaaagttacgggaacggggtacgggggttaggggaccggtacgtaacggggtagggttacgtttagggggtttacgggtttaatttttacgtttccggtacgttaatacgacgtacgtaactaccgtacgaacggttaccggtacggttaccgttacggtaccggtttcgacccgggtaggtacgngtacgggacgtacgacgtaaactaacggtcgtggcgtacgngacccgtactagtccg

SEQ ID NO: 236774 - DNA, 903 bp, Homo sapiens
  misc_feature: GYAE6OF02HG9HJ.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctcgtgggtcccaggactccaggtggggatgttgtggtgacttcagtctccactctccctgacccgtcaccttggaccacggccggtccctccattcctccgtgctacgggttcctggtaaccgaaacgtccccgtggttacggtacggtacgaacgtaaccggaaaacctacccttaacgttaggtaaacgtttacggtaacgtactaacggacgaaggtacgggaccgtaacgggaccctaacgtttaccccgtaacccggaacgggtacccgtaacccttaaacggttaccttaaaggttttaaaccgggttttaccggtaaaacccggggtacggtaccggttaccgggggttaccccaacggtaacctaggttaaccttacgggaacggtacccggtacgtaacggttacggggttaaccacgggtactaacggttagttaaccgtttaaccgactaaccggttagtaacggtaaacgttaacggtaacgggtaacggggtacgggtaacgggtacggttaacgggtaacgggtaggttttagggtttagggtttaacgttttaacgtttacggttagtaccgttaaggtaccgtaacgtaacgtacccgttaaccgaaccgtaacggttaccgggttaacccgttacgtttaaccggtttacggtaaccgggtaccgggaaccgttacgtaacggtaacggtaacgtaacgtaaactaaccgggggggtaacttacgggtacgtacgtacggtacctaaccgtacgtttaaccg

SEQ ID NO: 236775 - DNA, 597 bp, Homo sapiens
  misc_feature: GYAE6OF02J1BX1.3.35.D02.1.454.CMB.1.raw
  modified_base (196)..(196): a, c, t, g, unknown or other
  misc_feature (196)..(196): n is a, c, g, or t
  modified_base (245)..(245): a, c, t, g, unknown or other
  misc_feature (245)..(245): n is a, c, g, or t
  modified_base (255)..(255): a, c, t, g, unknown or other
  misc_feature (255)..(255): n is a, c, g, or t
  modified_base (277)..(277): a, c, t, g, unknown or other
  misc_feature (277)..(277): n is a, c, g, or t
  modified_base (289)..(289): a, c, t, g, unknown or other
  misc_feature (289)..(289): n is a, c, g, or t
  modified_base (316)..(316): a, c, t, g, unknown or other
  misc_feature (316)..(316): n is a, c, g, or t
tcagagacgcactccacgaccggtgctcgatttagcacacgatagttgggtttgggggatcaggactcctcagttcaccttctcacaatgaggctccctgctcagctcctgggctgctaatgctctgggtcccaggatccagtggggatgttgtggtgactcagtctccactctccctgcccgtcacccttggacngcccggcctccatcctcctgcaggtctggtcaaagtcctgtgtacggtnatggaaaccnctacttgaattggatcagcagngcaggccaatcncagcactaatctatacgttcaccggcncgtcgggtccagacagattcgagcgacacgtgggtacaaggcctaacgtgtacgttccaactacgtcgaagtaacgttacgacggtaacgggtggaacggtcgtaggaacgggtagttggttagggttactttagtttctacggactagtcgtacgtacgtaccgttaccacgtcgtacgttaccgtaactacggtttcggaccgtaagggacctaggtcgtacggaagtactaaccgtaaacggtacttcggtacgtacctcggaccctacagttacccg

SEQ ID NO: 236776 - DNA, 655 bp, Homo sapiens
  misc_feature: GYAE6OF02FY1B9.3.35.D02.1.454.CMB.1.raw
  modified_base (235)..(235): a, c, t, g, unknown or other
  misc_feature (235)..(235): n is a, c, g, or t
  modified_base (397)..(397): a, c, t, g, unknown or other
  misc_feature (397)..(397): n is a, c, g, or t
tcagagacgcactccacgaccggtgctcgatttagcacacgatagttggggtttgggggatcaggactcctcagttcaccttctcacaatgaggctccctgctcagctcctggggctgctaatgctctgggtcccaggatccagtggggatgttgtggtgactcagtctccactcctccctgcccgtcacccttggacacgccggcctccatcctcctgcaggtctggtcaaacncctcgtgtacggtagatacggaaacacctacttgaattggtatcagccgaggacggccaggccaactccgtaccgaagccgacctaatcgtaagttaacggtttacctaacccggggacgtccgtcggggtacccagacagactcgacgcggacacgtggcnggacactgtacttacgacacgtagaagtaagtttacgggacgtaaggggtcgggaacggacgtgggtaacggtggttagttaggggttaacttttagtttcgtgtactagtacggaagtaacgtacctagaccgtacgtccggtaccgttaacgttacggttagaccgggaacggtaccgaggtaccggtaaggacgtaaccggtaaccgaaacggtacgttcgtacggtaccgtacgaccgtaacccgtgtttaccg

SEQ ID NO: 236777 - DNA, 675 bp, Homo sapiens
  misc_feature: GYAE6OF02HNV0S.3.35.D02.1.454.CMB.1.raw
  modified_base (155)..(155): a, c, t, g, unknown or other
  misc_feature (155)..(155): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccaggtgggatgttgngtgactcagtctccactctccctgcccgtcacccgttgacagccgcctacatctcctgcaggtctggtacaaacgtcctcgtagtacggtgatacggaaacaccgtaacttagaattggtatcagcagacgcaggaccaatactacgaacggcgacctaaatctaattaaacggtttcaaccgggaacgtcgtcgggtaccccaagtaccgaaggtaacttacgaaggcgacgtacgtagggcgacgcgtactaggaactttcgaacctagtacgaagtaaactttaaggaccgtaaggggtacgggtacggtacgtaggggtaacggtaggttaggttagggttaatttttacgtttcgtacgtactaaggttacgaacgtaaacgacgtaacctacgtaacgtacggtaccgttaaacgtcggttttaacgaacccggttaacggggaacctaacgtacggtacggaacgtaacgtaacgaaacgtacgtagtacggacgtggaaccctacgacttcg

SEQ ID NO: 236778 - DNA, 742 bp, Homo sapiens
  misc_feature: GYAE6OF02IQMXI.3.35.D02.1.454.CMB.1.raw
  modified_base (245)..(245): a, c, t, g, unknown or other
  misc_feature (245)..(245): n is a, c, g, or t
tcagagacgcactccacgaccggtgctcgatttagcacacgatagttggggtttgggggatcaggactcctcagttcaccttctcacaatgaggctccctgctcagctcctggggctgctaatgctctgggtcccaggatccagtggggatggttgtggtgactcagtctccactctccctgccctcaccttggacagccgcctcactctcctgcaggtctaggtacaacgcctcgtgtacggtnagtacggaaactacctacttagtaagttggtatcagcaggaggaccgaggaccaatccaccgaggccgtactaactacttaagttaacggtttacgtaacccgggtaccgtcggttcggggtacccaacgtacgaaggtactttacgaacggtccgggtaccgtacggttcggggtacgtacgggaccgtaacgtacggtacttttaccaccgtaacgtacggtaaagttaacggtttaacgggtaccggtaagggggtcggggtaacggtacggtagggttaacgggtaacggtttggggtttaacggttaatttttaacgtttcgtacgtcgtagtcggtactacggtaccgtaactaccggtcgtaccgggtacccgttacgttaaccggtttaccgggtaccggaaccgggtacgttaacggacgtcgggtaactaacgtaaccggtaaaccgacgttgggtacggtcctacggtacctaccgtagtttaccg

SEQ ID NO: 236779 - DNA, 559 bp, Homo sapiens
  misc_feature: GYAE6OF02GUHYZ.3.35.D02.1.454.CMB.1.raw
  modified_base (386)..(386): a, c, t, g, unknown or other
  misc_feature (386)..(386): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgtggtctctggattcaccttcagggaccacttcatggactgggtccgccaggctccagggaaggggctggagtgggttggccgtataagaaacaaagctagaagttacaccacagattacgccgcgtctgtgacaggcagattcaccatctcaagagatgattcaagcaactcagtgtctctgcaaatgaacaccctgaaagaccgagacacggccgtntattactgcgctacagattcatattggagctacgactacgtggggaccacgggacgaccgtggtccaccgtcctcctcacgcctccaccgaacgggccctagtccgtccgttcccccgtcggcccgtcccgtcgccctccgacggacgcccacccgtacccggacgacgaccg

SEQ ID NO: 236780 - DNA, 854 bp, Homo sapiens
  misc_feature: GYAE6OF02J048N.3.35.D02.1.454.CMB.1.raw
  modified_base (176)..(176): a, c, t, g, unknown or other
  misc_feature (176)..(176): n is a, c, g, or t
  modified_base (266)..(266): a, c, t, g, unknown or other
  misc_feature (266)..(266): n is a, c, g, or t
  modified_base (309)..(309): a, c, t, g, unknown or other
  misc_feature (309)..(309): n is a, c, g, or t
tcagagacgcactccacgaccggtgctcgatttagcacacgatagttgggtttgggggatcaggactcctcagttcaccttctcacaatgaggctccctgctcagcctccgtgggctgctaatgctcgtgggtcccaggtactccgaggtggggatggttgtggtgactgacgtcnccactcctccctgcccgtcacccttggacacggcccggtcctccgactcctacgtgacgtacgtctggtacaacgccgtcgtagtacggngacgtaggaacctacgtacttgtaagttggtactacgacgtanacggtacgaccgtacggacctaatcccgtaccggaaggtccacgttaatacgtaaggttaaccgggtttaaccgaccggggtacgttaccggtacggggtaaccccgtaaggaacgtaacgtagttaccgaacggtcggctaaccgggtggggtacctaacgggtcttaacgtacggttttaaccctaacggtaaccgacgttaaggaacggtaaacgtttcgggaaaccggttaggggtacggggttaaacggtccgggttaaagggttaacggggttacggttttagggggttaccggtttttaactttttaacgggttaccgtttacgggtacgttaaaggggtacccctaaagggttacccgtaaccgttaaaacccggttaccggtacggtttaacccggtaaaccccgtttacgttttaccggggtaaaccgtaaccggggaaccggttaacccgtaggtacggaacccggttgtaaaccgtaaccgtaacgtaccggttcgggtaacgtaccggtcgtaaaccgttcgtaacgttacg

SEQ ID NO: 236781 - DNA, 745 bp, Homo sapiens
  misc_feature: GYAE6OF02IVNLK.3.35.D02.1.454.CMB.1.raw
  modified_base (217)..(217): a, c, t, g, unknown or other
  misc_feature (217)..(217): n is a, c, g, or t
  modified_base (245)..(245): a, c, t, g, unknown or other
  misc_feature (245)..(245): n is a, c, g, or t
  modified_base (275)..(275): a, c, t, g, unknown or other
  misc_feature (275)..(275): n is a, c, g, or t
  modified_base (362)..(362): a, c, t, g, unknown or other
  misc_feature (362)..(362): n is a, c, g, or t
tcagagacgcactccacgaccggtgctcgatttagcacacgatagttgggtttgggggatcaggactcctcagttcaccttctcacaatgaggctccctgctcagtctcctgggctgctaatgctctgggtcccaggatccaggtggggatggttgtggtgactcagtctccactcctcctgcccgtcacccttggacacgccggctccactctccngcagtcaggtcaagtcctcgtgtacgtnatacgaacactactgtatacggtatcagtngaggccaggctaatcaccgaaggtcaccttaatactagttaacggtttaccgtaaccggtaagccggttcgggcccaagaccgagtnttacgacgggtccgcgtaccggtgggtcccgaggtaccgtacgtacggttatttacccgaccgtagtacgtaacgtaaggtttacggtaacggtagggggtacgggtacgggtacggtacggtaacgggttaggtttaacgggtttaggggttttaactttttacgttaaccgtttgtaacgttacggttacgtaccggttaaacggtacccttaaccggaaccgtttaaccgttccgggtacccgttacgtttacccggttttaccgggacgggttaaccggggaccgtaaggtaccggtggtaaaccgtaaggttaacccggaaccgttaaccgttaacgggttcggtaccggttaacggtcccgtaaccgtccgttaccg

SEQ ID NO: 236782 - DNA, 740 bp, Homo sapiens
  misc_feature: GYAE6OF02GQH7X.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctcgtgggtcccaggatccaggtggggatgttgtggtgactcagtctccactcctccctcgcccgtctacccgttggaccacggcccggtccctccatcctcctgctaggtctggtacaacgcctcgtgtacggtgatacggaaccaccttactagtaattggtatcagcgaggacggtccgacggaccaacgttaccgtaccggaacggccgtaaccttaacgttacttaaacggttaacggtttaccgtaaaccggggtacgtccggttacggggacccaggactaacgtacttaccgacggtaccgacgtacggtacgggacgtacggacctacgtacgtactttaccgaactacgtacgaagttaacgtacggtcgggtaagggggtaggacggtcggtaagggtaacgggttagttaggggttagggtttaacttttacgtttcgtagtacgtatacgaacgtacggtacgtaaccgtacgtaccggtccggtaccttacgttaccggttcggaaccgggtaacggtaccgtacggtccgtaacgggtaagtaaccgtaaccgtaaacggacgttacggtacggtaccgttaccgacgtacctagttaccgg

SEQ ID NO: 236783 - DNA, 845 bp, Homo sapiens
  misc_feature: GYAE6OF02FJOCU.3.35.D02.1.454.CMB.1.raw
tcagagacgcactccacgaccggtgctcgatttagcacacgatagttgggtttgggggatcaggactcctcagttcaccttctcacaatgaggctccctgctcagctccgtggggctgctaatgctctgggtccaggatccaggtggggatgttgtggtgactcagtctccactctccctgcccgtccaccttggacacgccggcctcctatcctccgtgctaggtctggtcaaacgcctcggtacgtacggtgagtacggaaacctaccgtacttagtaacgtttagggtacttcgagaccgaaggacggaccgacggacctaactccgttaccgaacgggtccgtaacccttaacttacgttaacgtttaacgggtttaccgtaaaccggggacggtcggtacggggtacccagaccaggtacttacggacggtacggctaacggtcggtacgacggtactacgttagttactttacgacctaacggtacggaaagtaagtttacggacggtaaaggggggtcgggaaacgggttcgtaagggtaaggggtttaagttgggtttaagggttaacgtttttacctttgggtactacgagtttacggaccgttaaacggtcttaaaccccgtactaccgggttaacggtaccccgttttaaacgttcccggggtttttaacgggaaccccgggttaaccgggggtaaacctaacggggttacccggttaaggggtaaacccggttaaccgggttaaaacccaaaaacccggggttaaccggttagggtttaccccggggtaccgttaaccgggtaaccccgttaaccggttcgttttaccccggg

SEQ ID NO: 236784 - DNA, 846 bp, Homo sapiens
  misc_feature: GYAE6OF02HNR6C.3.35.D02.1.454.CMB.1.raw
  modified_base (153)..(153): a, c, t, g, unknown or other
  misc_feature (153)..(153): n is a, c, g, or t
tcagagacgcactccacgaccggtgctcgatttagcacacgatagttgggtttgggggatcaggactcctcagttcaccttctcacaatgaggctccctgctcagctctgggctgctatgctctggtcccaggactccaggtggggatgttgnggtgactcagtctccacttcctccctcgcccgtcaccgttgactacgccggacctccactcctccgtgcgtacggttccgtacggtacgaaacgtccgttcggttacggtaaccggtgaacgttaaccggaaaacctacccgttaagttacggttaaaggtttcggtaagttaccgaggaccggtaaggaccggtaccggaaggtacccttaacgtaccgtaaccggaacgggtacccgttaaccgttaaacgttaccgttaaacgtttaaaccggggttttacccgtaaacccgggggaccgtccgggtttaccgggggtaacccctaaagggtaaccggtagtaaccgttaccggaaccggtaccgggacctaacggggttcggtacgaaaccggtctaacgttacgtacgttaccgaacgtaacgttcggtaaagttaacgttacgggtacgggtagggggttaacgggacgggttacgtacggggtaagggttagggttacgggtttgggttaacgttttttagttacggtcgtacgtagtacgtacgaacgttacgacctagtaccggtcgtaaccgttacttacgtaccgtaacggtaaccggacgtaacggtcggtaacggtaacgtaaccggtaacgtaaccggtaacgtcggtacggtacctacggtaaccacgtacgttaccg

SEQ ID NO: 236785 - DNA, 776 bp, Homo sapiens
  misc_feature: GYAE6OF02F3R13.3.35.D02.1.454.CMB.1.raw
  modified_base (754)..(754): a, c, t, g, unknown or other
  misc_feature (754)..(754): n is a, c, g, or t
tcagagacgcactccacgaccggtgctcgatttagcacacgatagttgggtttgggggatcaggactcctcagttcaccttctcacaatgaggctccctgctcagctcctgggctgctaatgctctgggtcccaggatccaggtggggatgttgtggtgactcagtcctcactcctccctcgcccgtctaccgttcggacacggcccggcctccatcctctgcaggtcgtggtacaaacgtcctggtcgtacggtgagtacggaaacctaccttacttaggaagtttggtatacgagtacgaggacggtccgacggacctaactccaccggaacgggccgaaccttaatacttaacggtttaaccggtttaccggtaaacccggggtaccgtccgggttaccggggtcccctaacggaaccgtaaggttacttacggacggtacgggtccgtaacgggttcgggtaaccgaacgggtaccaaccgtttacggttaactttaccgaacctaagtaacgtaacgttaaagttacgggacggtagggggttagggacggtacggttaagggacggggtttaagttacgggtttggggttaaaattttttcgtttacgtcgtaacccggttagtacggtaaccgtaacgttacctaacccgtaaccgtacggtaccggtacccgtttaaccgttcgttttccgggaccgtaacggggacctaagtcgtaagggacttaacgacgtaaacgagttacgnggaccgtcgactcctagtcccg

SEQ ID NO: 236786 - DNA, 861 bp, Homo sapiens
  misc_feature: GYAE6OF02H3VQX.3.35.D02.1.454.CMB.1.raw
tcagagacgcactccacgaccggtgctcgatttagcacacgatagttgggtttgggggatcaggactcctcagttcaccttctcacaatgaggctccctgctcagctccgtgggctgctaatgctcgtcgggtccaggactccgaggtggggatggtgtggtgactcagttctccactcctcctcgtcccgtcctacccgttcggaccacggtcccggcctaccgtacttccgtccgttgacgtacggttcgtacggttacgaaacgtccgttcggtacggttacggtgtaacgtacgtaaacgtaaccttacgttagtaaacgtttggtacttacgacggacgacgggaccggaccgaacggtaccgtacgtacctaaccggaacggccggttaacctaacttaccgttaaaggttaaccggttttaacccggtaaaccgggaccggtcggtaccgggttaccaacggactaagtacgtaccggacggtccgggtaacgtccgggttaagggtacgacgaccgttaacgttacgttacgttacgtaacgtacggttaagtaggttaactacggtacggaacggggtaggtacggtaaggtacgggaagtttacggggttacggttttaacggttattttttaaccgggtgtaaccgggttactaggtaaccgaacgtaaggtaaccctaccgtaaccggtaaccggttccggtaaaccgttttcgtttacgggtttacccgggaaaccggtttacgggaaccgtaacggtccggtttaaacggacgttaacctaaaccggggttaaacgttcgtaggggtttcccggaccgttccaaaccgttaccgttagtttaccggg

SEQ ID NO: 236787 - DNA, 805 bp, Homo sapiens
  misc_feature: GYAE6OF02GHGVD.3.35.D02.1.454.CMB.1.raw
  modified_base (274)..(274): a, c, t, g, unknown or other
  misc_feature (274)..(274): n is a, c, g, or t
tcagagacgcactccacgaccggtgctcgatttagcacacgatagttgggtttgggggatcaggactcctcagttcaccttctcacaatgaggctccctgctcagctcctgggctgctaatgctcgtcgggtcccaggactccaggtggggatgttgtggtagtactcagtcctccaccttcctcccgtcgcccgtacctacccgttggaccacggccggtcctccacgtcctcctgactacggtctcggtaacaacgtccgtcgtgtacggtnagtacggaaacctaccttacgttagtaagttggtactacgagcgaaggacggaccgaacgacctaacttacccgtaccgaacggacccgtaaccttaacgttacgttaaagtttaaccgggtttaccgaaacccgggtacgtcggtaccgggtacccaaggtacacgtactacgacggtccgacgtacggtggtacgacggactacgtagtacttaccgaacgtacgtacgtaagtaacgtacgggacggtaggggtacgggtaggacggtaagggtacgggttaggtttacgggttgggtttaacgtttttacgtttacgcggtaacgttacggtacggtaaccgtaaggtacccttaacggtaccgttaacgggttaccgttaacccgttaaacgttttaccggggttaccgggaaccgggtaaccggggtacctaacgggtacgttaaacgggtaacgtaaacccgttaaccgaaacggttacgtacgggtttcaacccggttcgtaacccgaccgtttccgttacgg

SEQ ID NO: 236788 - DNA, 719 bp, Homo sapiens
  misc_feature: GYAE6OF02HIIZC.3.35.D02.1.454.CMB.1.raw
  modified_base (287)..(287): a, c, t, g, unknown or other
  misc_feature (287)..(287): n is a, c, g, or t
  modified_base (395)..(395): a, c, t, g, unknown or other
  misc_feature (395)..(395): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgtggtctctggattccaccttcagggaccacttcatggactcggggtccgccaggctccgaggggaaggggctgggagttgggttcggccgtataagaaacaagctagaagttacaccanagattacgccgcgtctgtgacagggtcaagtatttccgaaccctattcctacgaaaggaagtattgaactttacaagacctaacctgagttcgtctcttagactaaancgaaaccaccctaggaaacgaccggaggaccgacgggtcccgtacttagttaccgtcggcgtctaacgacgtacttacgtattagtagggactaccttaacgaccgtacggttccggggaccgaacggtaccgtacgggttccggacccgtcccgttaccgtcccgtacgacccgtaccccgttcccgaaacccggtaaaccgggccccttacggtttaccccgtttccccggttacccccgtcgggtacccccttcccgtaccgtccccgtacccggtacggacccgtaccctaccccggttaccggacggtaccgaccccgg

SEQ ID NO: 236789 - DNA, 861 bp, Homo sapiens
  misc_feature: GYAE6OF02HNQEM.3.35.D02.1.454.CMB.1.raw
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccaggtggggatggttgtggtgactcagtctccactctccctgcccgtcacccttggacaggcccggccnccntctcctgcaggtctggtacaaagtcctcgtgtacggtgatacggaactacctacttagtaattggtatctagacgaggacggaccgtaacggcctaaacttccgtacccgaaacgggaccgtaccgttaaacgttactaaggttaacgggttttacccggtaaaccggggtaccgtaccggttcgggggtaaccccaacggtaaacgtaacgggtaacctttaccggaacggtaccgggacctaccgggttcggggttaccgaacgggtactaccgttacgggtaattttacccgaaacttacccggtaagtaacggttaaaacggtttacggtaaccgggtaggggggttacgggtacggggtacgttacgggtaaggggtaacgttgggggttacgggtttaaggttttttaacgttcgtttaggaccgttaacgtaccggtacgtaaccggttacgttaaccgtaacgttaaccggtaccgggttacccgtttaaaccgtttaccgggtttttacggaaccgggtaaacccgggggtaccctaacggggtacccggttaagggaaccggtaacgttaaaccggaaaaccggttaacgtaccggggttaacgcccgttacgggtaaccctacccgtagtttacccgg

SEQ ID NO: 236790 - DNA, 858 bp, Homo sapiens
  misc_feature: GYAE6OF02HV88Y.3.35.D02.1.454.CMB.1.raw
tcagagacgcactccacgaccggtgctcgatttagcacacgatagttgggtttgggggatcaggactcctcagttcaccttctcacaatgaggctccctgctcagctcctggggctgctaatgctctgggtcccaggactccagtggggatgttgtggtgactcagtctccactctccctcgcccgtcacccgttggacacggcccggccctccatcctccgtgcgacggttctggtacaacgcctacgttggtacggtgagtacggaaacctaccgttacttagtaattaggtactcgagacgaggtaccggccgaacggtaccaacgtacctacccggaaggcccgaccttaacttacttaacgtttaaacggtttaccggtaaccggggtaccggtaccggttccggggttacccaacggacaacgtacgttcgacgggccggacgtaccggtacgggtacgaccggacgtaccgttaacggttcctttaaccgaccgttaacgtacggtaaacgttaaaggttaacggtaacgggtaaggggtacggggtaacggtaccggttaaggggaacggttagggttttacgggtttagggggttttaaacttttttacgtttttacggtaggttacgtaacggtttaaccggaccgttaaaccggtaccctttaaacccggaccgtaccggttaaccgggttacccgtttaacccggttacggttttacccggaccgggtaaccgggttaccccgaacggggtaacccgttaacgggggaaactaacccggtaaaccgtaaccgggtaacgttccgggtaggttaccctacgggttaccctaccgttacgttacccgg

SEQ ID NO: 236791 - DNA, 805 bp, Homo sapiens
  misc_feature: GYAE6OF02G4DBL.3.35.D02.1.454.CMB.1.raw
tcagagacgcactccacgaccggtgctcgatttagcacacgatagttgggtttgggggagtcaggactcctcagttcaccttctcacaatgaggctccctgctcagctccgtgggctgctaatgctcgtgggtcccaggatccgaggtaggggtattggttggtgggtgacgtcagtcctccactcctccctcgtcccgtctacccgttaggaccacggcccggtcctacctatcctccgtggctagggtccttagggtacaaacgtccgtcgtaggtaacggtgaacgttaacggaaaccaccttacgttagtaagttaggtactcgacgacgaggacgaccgacggacctaacgtcctacgaacggaccgtaccttaaatcgttaaacgtaacggtttccggtaaccgggaacgtccgggtacggggtacccaggaacgaggtacttagaccgggaggtaccgtacgtacgggggtcaacggaccgtaacgttgttaaccttcgtaaacctacgttacgaaaggtttaaacgaacgggttacggaaagggggtacgggtaaagggccggtttagggaacggggttagtacgggtttagggttaggttttacgttttaggtactagggttaataccggaacggtaaccgtaacttaccggaaccttacggccggttaaccgtacccgttagtttaaccgggaccgggtaaccgggtaacgtaaccggacgttacgggtaacgttaacgtaaacgggaaacgtaccggtacggtacgtgacccgtaaccgggtactaccgttacg

SEQ ID NO: 236792 - DNA, 951 bp, Homo sapiens
  misc_feature: GYAE6OF02FWONL.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctcgctaatgctcgtcggtcccaggactccaggtgggatggttgtggtagtacctcacgttactccactcctcccctcggtcccgtccgaccgttcggaccacggacccggtccctaccgattccgtccgtcgacgtacggtctacggtacctaaacgtccgtcggttacgtacggtagacgtacggaacctaccgttacgttagtaacgttacggtactcgacgtacgaacggacggtaccgaacggtacctaaccgtaccgtaccggtaaccgggtcctaacccgttaacgttaccgtaacggtttaaccggggttaccgtaaacccgggggtccgtaccgggtttacggggtaacccctacgggtaacgtacggtaccgttaacggaccgggtccggaaccggttaccggtcgggtaaccgtaccggtaccgtaacgttacggttaaccttacccgtaccggttaacgtaaacgaacggtttaacgtaacgggtccgggttaaacgggggtagggtaaccggtcggtttaacggggaggttttacgggttacgggtttagggttaaccttttttaacgttcccggtaacggtttacgtaacgtttacccggtaaacggttaaaccggttccgtaaaacccggttccggttaaaccgggttcccgttaaaccgggtttacccttaaccggggttaccgaaacccggggtacgggttaaacccgacgggttaccgggttaacggtaaaccgggttaacccttaaacggtaaaacccgggttggtttaaccggaccggttaccccgtaaggtaacccgttaccgggtaacttttccgg

SEQ ID NO: 236793 - DNA, 658 bp, Homo sapiens
  misc_feature: GYAE6OF02G4PJC.3.35.D02.1.454.CMB.1.raw
  modified_base (212)..(212): a, c, t, g, unknown or other
  misc_feature (212)..(212): n is a, c, g, or t
  modified_base (242)..(242): a, c, t, g, unknown or other
  misc_feature (242)..(242): n is a, c, g, or t
  modified_base (252)..(252): a, c, t, g, unknown or other
  misc_feature (252)..(252): n is a, c, g, or t
tcagagacgcactccacgaccggtgctcgatttagcacacgatagttgggtttgggggatcaggactcctcagttcaccttctcacaatgaggctccctgctcagctcctggggctgctaatgcttctgggtcccaggatccagtggggatgttgtggtgactcagtctccactctccctgcccgtcacccttggacagccgctcatctccngcagtctggtacaacgcctcgtagtcggtnagtgaaaccncttactgaattggtatcagcaggcggtccaggcaatctaccgaggcgcctaaatcttaagtacggtttccgaacccgggtacgccgtcggggtcccagacgacgtaacttcacggccggctacgtcggggtacagggacctcgttaggtacttttcgaaccctaacgttacggaagtaagtttagccggtaaggggttgggaaggtcgttaggagggtaagttcggtttaggggttactttttagtttcttcggctagtgtacgaacgtccgttaacaccgttaacgtcggtaccgttccttacggttttcggccggtaacgggacccgtaacggtccgtagggtacggtaaccgtacgtaaaccggaacgtttcgtacgggtccttcggacccgtacacgttccg

SEQ ID NO: 236794 - DNA, 751 bp, Homo sapiens
  misc_feature: GYAE6OF02I9OXD.3.35.D02.1.454.CMB.1.raw
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctggagggtccctgagactctcctgtgtggtctctggattcaccttcagggaccacttcatggactgggtccgccaggctccgagggaagggctggaggtgggttggccgtaataacgaaacaagctaagaacgttacaaccaacgagtattaccgccgcgtctgtcgacaggcagtattacacccatctacaagagatgattcgaacgctaactcagttcgtcttactagactaaaagtgaaaaccctcccgtaagaacggaacccggtaaggaacccgaccgggtaccccgttacttaactttaccgtacggtaccggtacctaaacaggttacctttaccaagtttaacgttagggtaacgtaccgttaaccggaacgttaaccggtcgggggtaacccctaccggggtaaaccgacccggttacgggttacccgtaccccggttacctcccgtaccctaccgtccccgttaccccgaaacccggtaacccgggaccccgttaccggttcccggttcccctttaccccccggtcgggccccgtacccgtaccgtcccgtaccccggaacggtcggacccctacccggtacccggacgtaccgaccgg

SEQ ID NO: 236795 - DNA, 795 bp, Homo sapiens
  misc_feature: GYAE6OF02JF8EB.3.35.D02.1.454.CMB.1.raw
  modified_base (164)..(164): a, c, t, g, unknown or other
  misc_feature (164)..(164): n is a, c, g, or t
tcagagacgcactccacgaccggtgctcgatttagcacacgatagttgggtttgggggatcaggactcctcagttcaccttctcacaatgaggctccctgctcagctccgtgggctgactaatgctcgtggtcccaggactccgaggtggggatggttgtggtnactcagtctccactctcctcgcccgtctaccgttggacacgccgtcctaccatcctcgtcgacctaggttcgtacggtacaaacgtccttcggtggttaacgggtgtaacgttacggaaaaaccctacccttaacgtttaggtaagttttaggttactacgaacggacgaagggacggtacccgaacggaccctaaaacttcccgtaacccggaaacgggcccttaaccttaacgttaactttaaaaggtttaaaccggggttttacccggaaaccccggggtacggtaccggttaccggggtaccccaaggaaccggttagtacgttccggaacgggtacggtccgtacgggttcgggtaccgaaggtacccgtagttacgtactttacgaaccagttacggaagttaagtcggacggtaggggtaggaggcgtaggaggtagttggttaggtacttttgtagtcgctagcgtaactcgtacctaacctacggtacgtaccggggttaccttcggttacggtttaccggaaccggggttaacgggaaccgttaggtaccgggtaggtaaaccgtagttaaacccggaaattcgggtacggttacggcttaacgacttaaccgtcttaacg

SEQ ID NO: 236796 - DNA, 822 bp, Homo sapiens
  misc_feature: GYAE6OF02IX9HA.3.35.D02.1.454.CMB.1.raw
  modified_base (145)..(145): a, c, t, g, unknown or other
  misc_feature (145)..(145): n is a, c, g, or t
  modified_base (161)..(161): a, c, t, g, unknown or other
  misc_feature (161)..(161): n is a, c, g, or t
tcagagacgcactccacgaccggtgctcgatttagcacacgatagttgggtttgggggatcaggactcctcagttcaccttctcacaatggaggctccctgctcagctcctggggctgctaatgctctcgggtcccaggatccgnggtagggatgtttagngtagactcagtcctctactcctccctcgcccgtctacccgttggactacgcccggccttaccagttcctcctcggcgtaccggttacgtggtaaccaaacgtccctttaggtcggttaccgggtgagtttaaccggaaaacctaaccgttacttagtaacgttaggttacttcgagtccgaggtacggaccgacggacctaactacctaccggaacggtaccgtaccgttaactaacgttacggttaaacggtttcccggtaaaccgggtacggtaccggttacccggggtaccaacggtaacgacggtaacgtccgtaggtccgggaccgtaacgttccggggtacgaaacgtccggtaacttcggtaacctttacccgactttaacccggtagtaaccggtaaaggtttaccggaacgggtacggggggtaacgggtacggggtaacgtaaccgggtagggttaacgggttaccgggggttttaagggttaaacgtttttccggtttaacgggtgtaccggttagtaccgtaacgtacgtaccggtactaacgacgttacgtaccgttaacgtacgtttacggaccggtagtacccgtagtacggtgtaacgtacgtaactaacgtcgtagtaccgtcgtccgtactacgtcttaccgg

SEQ ID NO: 236797 - DNA, 809 bp, Homo sapiens
  misc_feature: GYAE6OF02F4GT4.3.35.D02.1.454.CMB.1.raw
  modified_base (799)..(799): a, c, t, g, unknown or other
  misc_feature (799)..(799): n is a, c, g, or t
tcagagacgcactccacgaccggtgctcgatttagcacacgatagttgggtttgggggatcaggactcctcagttcaccttctcacaatgagctccctgctcagctccgtggggctgctaatgctcgtcgggtccaggatccaggtgggatggttgtggtagactcagtcctccacttcctccctcgcccgtcaccgttggacctacggccgcctaccacttcctcgtgacgtacggtcgtaggtaaccaaacgtccgttcgtacgggtacggtacgaacgttacggaaacctaccgttagtagtaagttggtaacacgtaggacaggtacggacaacggacctaactcgtaccgaaggccgtaactaagtacgttaaggttaaacggttaccggaaccgggacggttcgtccgggtacccaaggacctaaggtacttacggacgcggacgtacgtacgggactacggcttaacggtaacgttactttaacgaacgtaagttaacgaaacgttaaacgtacggtaaacgggtaggggtacgggtaacggtacggttaacggggaaaggttggttaacgggtttaggttttaaacgtttcggttttaacgcggttaaacgtacgtttaacgggaaacctagtaaacccgttacgaacgttacgggtaccgttaaccgttacgttaaccggttacggaacccggtaacgggaacgtacgggtaccgttaaggaaccggttaaacaacccggttaaagtaaccggtaggtaccggtaccggtaacggtaaccctacccggtntttaccccgg

SEQ ID NO: 236798 - DNA, 811 bp, Homo sapiens
  misc_feature: GYAE6OF02G2PPO.3.35.D02.1.454.CMB.1.raw
  modified_base (755)..(755): a, c, t, g, unknown or other
  misc_feature (755)..(755): n is a, c, g, or t
  modified_base (806)..(806): a, c, t, g, unknown or other
  misc_feature (806)..(806): n is a, c, g, or t
tcagagacgcactccacgaccggtgctcgatttagcacacgatagttgggtttgggggatcaggactcctcagttcaccttctcacaatgaggctccctgctcagctccgtggggctgctaatgctcgtcgggtccaggatccaggtggggatgttgtggtgactcagtcctcactctcctcgcccgtcacccgttggacacggcccggcctccacgttcctcctcgacgtacggttcgtcggtaaccaaacgcccgttacggttacggtacgggtacgtaagttaaccggtaaaacctacccgttaacgttaggtaaagtttcgggtaacttaccgtaacggacgaacggtaacggacccgtaacggacccctaaacgttcccgttaaccgaaaccgggtccgtaacccgttaaacgttactttaacggtttaacggttttacccggaaaccgggtacggtaccgggttaccgggggtacccctaaggtaaaccgaacggttacgtttaccggacggttaccgggacgttaaccgggtgggtacccgacggtaccgtaacgttgttaaccgtttaccaacgtaacgttagaacgttaacgttacggacggttaaggggtccggaggtacgtaggaaggttagttttagggttaggtttaattttgtttcgaccgttatggtaccgaagtaacgaccgttactaccgtagaccgttaccgtaacgtttcgtaccggaccgtacgggactacggtnaacgggataaccggtacaaacgttgtacggtacgtaccaggtacacccgtnttcgg

SEQ ID NO: 236799 - DNA, 776 bp, Homo sapiens
  misc_feature: GYAE6OF02JA7GG.3.35.D02.1.454.CMB.1.raw
  modified_base (215)..(215): a, c, t, g, unknown or other
  misc_feature (215)..(215): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcaccttggacagccggcctccgatcgtccngcaggtcctggtacaaacggcctcgtggtacggtgatacggaaactaccttacgttagaaacgtttggtaacttcgaaggccgtaaggacggtacccgaagggtaccctaaattaccgtaccgaaagggtaccgtaaccttaaagttccttaagtttaaaccggttttccgtaaaccgggacgtccgttacggggtaccccaagtaaccgtagtaacgttccgaaggccggtactacggtcgggtacacgggctaaccgtagtactttaccgacgtaacgtagtaacgtaagttacgacgtacgggtaggacggtacgttaggaaggtagttagggttacggttaagttttacgtttacgttaggtaacttacggttacggtaacgtaaccggtaccttaaccgtaacgttaccgtacgggttacccgttaaaccgtttaccgtttaacgggacccggttaacggggaaccgtaacggttacgggtaacggaaacgtacgtaaaccgaaaacggttacgtaacggtcggtaccgtaccggtaacctaccgtacgtttaccg

SEQ ID NO: 236800 - DNA, 634 bp, Homo sapiens
  misc_feature: GYAE6OF02G97QJ.3.35.D02.1.454.CMB.1.raw
  modified_base (259)..(259): a, c, t, g, unknown or other
  misc_feature (259)..(259): n is a, c, g, or t
  modified_base (364)..(364): a, c, t, g, unknown or other
  misc_feature (364)..(364): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctgggggaggcttggtccagcctgggagggtccctgagactctcctgtggtggtctctggattcaccttcagggacccacttcatggactgggtccgccaggctccgagggaaggggctggaggtgggttggccgtaanaagaaacaaagctaagaagttacaccaacagattaccgccgcgtctgtcgacaggcaagattccaccatcctacaagacgtataggtattacgaacgacaacctnagtcgtcctacgtagaacaaatcgaaaccacccgtagaaacgaccgaagacacggccgtactaacgttactgccgtactacgaagtacttacattagtaggagtactaacgtactacggtcggaccgacggacgaccgtacgacgtaccgtactccgtactacgccctacccgaaccgaaccgggaccctacgttcccggttcctacccccgtcggacccgtcccgtacgtcctaccggacggacaccgacccgtaccggacgacgaccg

SEQ ID NO: 236801 - DNA, 783 bp, Homo sapiens
  misc_feature: GYAE6OF02JNB29.3.35.D02.1.454.CMB.1.raw
  modified_base (556)..(556): a, c, t, g, unknown or other
  misc_feature (556)..(556): n is a, c, g, or t
  modified_base (608)..(608): a, c, t, g, unknown or other
  misc_feature (608)..(608): n is a, c, g, or t
  modified_base (776)..(776): a, c, t, g, unknown or other
  misc_feature (776)..(776): n is a, c, g, or t
tcagagacgcactccacgaccggtgctcgatttagcacacgatagttgggtttgggggatcaggactcctcagttcaccttctcacaatgaggctccctgctcagctcctgggctgctaatgctcgtcgggtcccaggactccgaggtggggattgttgtggtgactcagtctccactcctcccgtgccccgtctacccgttggaccacggcccggtcctcctaactcctcctgcgtaggttcctggtacaacgtcccttacggtggttacggtgactacggaaacctccgttagtagtaagttcggtatcgacgtcaggacggtccagaccctaatctaccgaaggccgttaacctatccgttaacgttacggtttaccgaaccgggtacgtcggtaccgggtaccctaaaggtacgtacgtattacccggacggtccggaacttacggtcgggtaccgacgggtacctacggttccgtaatttacccgacgttaccggtagtaaacgtaaggtacgcggggtacgggaggtaccggagttacggaacgggtttntaggggtttacgttacgttttaaccgttggacgttacgttaagtacccggtntaaacccggtttcgaaccctaccgggtaaccgtttaccgggtaacccgtttaccgtacggtttaccgggaacgacccggggttacgcgttacgggtaccggtaaagtaacccggtaaccgttaaacgggcttccgggaacggtcccgtttaacgccgttaacccggtnttaccgg

SEQ ID NO: 236802 - DNA, 786 bp, Homo sapiens
  misc_feature: GYAE6OF02HB0X0.3.35.D02.1.454.CMB.1.raw
  modified_base (557)..(557): a, c, t, g, unknown or other
  misc_feature (557)..(557): n is a, c, g, or t
  modified_base (650)..(650): a, c, t, g, unknown or other
  misc_feature (650)..(650): n is a, c, g, or t
  modified_base (666)..(666): a, c, t, g, unknown or other
  misc_feature (666)..(666): n is a, c, g, or t
  modified_base (729)..(729): a, c, t, g, unknown or other
  misc_feature (729)..(729): n is a, c, g, or t
tcagagacgcactccacgaccggtgctcgatttagcacacgatagttggggtttggggggatcaggactcctcagttcaccttctcacaatgaggctccctgctcagctccgtggggctgctaatgctcgtcgggtcccaggactccgaggtggggagtgttgtgggtcgactcacgtcctcctacctcctccctcgccccgtaccgtacccgttcggaccgacggccccggtccctcctactccttccgtcgcgtacgggttccgttaggtaccaaacgtcccgtacggtaggtacggtacgaagtaacgtaaacctacttaacgtacgtagttacggtactacgagacgaaggccggtacctacggaacccgtaactacccgtaccggaaccgtaccgtaaccttagttaaccgttaacgttaaaccgggtttaccggaaacccggggtcgtaccgggtaccgggtaccgacgtaacgtagtaccgtacggaccggccggtacgtccggtaagggtccgtagtaacgtcttaacggttctaacgaacgtaaccgngttaaacggtacgtacgggtacggggtagggtacggtacgggttagtagggggtaaggttacggttagggttgggttacttttccgtggtacncgtagtacgacgttanactaacacgtacgtccggttaaccgtcttacggtccgaacgggtaacgacctaacgggtacgnaaccggtaacttaaccggaacgtcggtacgggtcacgtccggaacgtttcgattccg

SEQ ID NO: 236803 - DNA, 979 bp, Homo sapiens
  misc_feature: GYAE6OF02GQQ4G.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctgggtcccaggatccaggtgggatgttgtgtgactcagtctccactcctcccgtcgcccgtctacccgttaggacacgcccggcctcctacgttccttcctggaccaggttcgtacggtaccaaacgtccttacggttcggtacggtgaacgtacggaaaacctacccgttaacttaggtaaactttgggtaacttccgaaggtacgaaacggacggacccgaacgggaaccctaaacttcccgtaccggaaacgggtccgtaaccccgtaaagttaccgttaaacggttttaaacggggtttttaccccgtaaaacccggggggtacccgtaccgggttaccggggggttacccccgtaaacggtaacccgtaaaggttaaccgtttaccgggaaaccggggtcccgggaacccggtaacgggtttaccgggggtttaccaaacgggggtaaccccctaagttttcggttaaacccgtttttaaccgaaacccttaaccggttaaggtaaacggttaaaacggtttaccgggtaaccggtaaggggggttacggggtaacgggtacgggttaagggttaggggtaagtttaacgggggttttagggtttaacgtttttaaggttttaccgttcggtaaccgtttaggaacggtacgtaaaccggtacttaacccggtaaccgtaaccggttaccgggttacccgtttaacccgttacgggtttttacccggggaaccgggtaaccgggggtacccgaacggtaccggttacgggtaacgttaacgtaaccgtaaacggtaaccggttacgggttacggttaccgtacggtacccggtaactcgtttaacccgg

SEQ ID NO: 236804 - DNA, 759 bp, Homo sapiens
  misc_feature: GYAE6OF02JH01I.3.35.D02.1.454.CMB.1.raw
  modified_base (743)..(743): a, c, t, g, unknown or other
  misc_feature (743)..(743): n is a, c, g, or t
tcagagacgcactccacgaccggtgctcgatttagcacacgatagttgggtttgggggatcaggactcctcagttcaccttctcacaatgagctccctgctcagctcctgggctgctaatcgctcgtcggtcccaggactaccgaggtggggattggttggtacggtgaacctcaggttctccacctcctcccgtagccccgttactacccgttggacacgcccggcctaccacttcctcctggctaacggtcgttcgtaacaacgtccttcgtaggtcggtagattaccggaaaactacccttaagtttgaaagttcggttactcgaggtcgaggtacgacccgacggactaacgtccgtaaccgtacggacgtacccttaaattccgtaaacgtttaaccggttttaccgaacccggggtacgtaccgggttccgggtaccccaaagacctaaggtacctacggacgccggtacgtacggttcggacgacggtaactacgtagttaaccttaccgaagtaccgtagtaagttaaacgtaggagggtaggggtagtacgggtacagggtaacgttagttagggtttacgggttaattttttacggttcacgttcgtaggtacgtaacgaaccgtaaccttaccggagttaacccgtcgtaaccgtttcgttacggtaccggacgtaaacggccgaaggtacgtacggtaactaacgtaacgaacgtacgcggttgtacccgnttacaccggttctacg

SEQ ID NO: 236805 - DNA, 813 bp, Homo sapiens
  misc_feature: GYAE6OF02G2USD.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctctggtcccaggatccaggtgggatgttgtggtgactcagtctccactctccctgcccgtcaccttggacacgccggcctccatcctcctgcaggtctggtacaagccgtgtagtacggtgagtacggaaacctaccttactagtaagtttggtataccgagcgaagacggacccgaggcccaaagttcctaaccggaacgggaccgtaccgtaaacttccgttaaacgtttaaacgggtttacccgtaaaccggggtaccggtcggttaccggggtacccctaaggtaaccgtaacggtacgtttaccgaccgggccgggtaccgtaacggttacggggtacggaacgtccgtaacgttagtaaccgttttaccgaactaaccggttaagaacggttaaacgttaacgggtaacgggtacggggtaggggtacggtaggtacggtaagggttaacggttagggtttagggtttaacgtttttacgttttaccgttggtactagtccgtaacgtaacgtaccgtaactaccgttaaccgttcgggttaacccgttaccgttacccggttttacgggacccgggtaacggggtacccgtaacggtacggtaacgggtaaccggtaacgtaaccggtaaacccggtacgttacggtacgtaccgtaccggtacccgtaccgttacttaccgg

SEQ ID NO: 236806 - DNA, 867 bp, Homo sapiens
  misc_feature: GYAE6OF02FOL1F.3.35.D02.1.454.CMB.1.raw
tcagagacgcactccacgaccggtgctcgatttagcacacgatagttgggtttgggggatcaggactcctcagttcaccttctcacaatgaggctccctgctcagctccgtggggctgctaatgctctgggtcccaggatccgaggtggggatggttgtgggtgactctagtctccactctccctcgcccgtcacccttggacagccggcctccatcctcctgcgaggttctggtacaaacgtccgtcgtaggttacggtgtagtacggaaacctaccttaagttacgtaagttggtacttcgacgtacgaacggacggccaacggaccctaacgttaccgtaccgaacgggtcccgtaccttaaagtacgttaaacgttaaaccgggttttacccgtaaacccggggtccggtaccggttaccgggggtaccccctaaggaaccggtaattacgtttaacggacggtccgggtaccgtacgggttcggggtacaacgggtcctaacgttcgtaacgtttaccaaaccgttaccgtaaagtaaaccgtacggtaaacggtacgggtaggggtaacgggtacgggtacgtaggggtaagggttacggttttacggggttttacgggttttaacgttaacggttacgtaacggtttacgtaagggtaaccggtaacgttaaacccggtaccgttaccgggttcccgtaacccggttcccggtaaccgggtttaccccggaccggtaaacccgggtaaccggtacgggttaccgaaacgttaaccggtaaacgtacgggttacggtcggttaccgtttaaccgtacgttaccttacggttacccttacgttacccttacccgttacccgg

SEQ ID NO: 236807 - DNA, 788 bp, Homo sapiens
  misc_feature: GYAE6OF02JVN1W.3.35.D02.1.454.CMB.1.raw
tcagagacgcactccacgaccggtgctcgatttagcacacgatagttgggtttgggggatcaggactcctcagttcaccttctcacaatgaggctccctgctcagctcctgggctgctaatgctcgtgggtcccaggatccaggtggggattggttggtggtgactcagtcctccacttcctcctcgcccgtctacccgttgacacgccggcctccatcctcctgctaggtctggtacaacgtcctcggtgtacggtgagtacgaacctaccgtacttacgtagttcgtatcgagtcgaaggacgacgacgcctaactccacgaacgccgtacttatacttaacgttacggttaccggtaaccgggtacgtcggttacgggtaccccgaagtacggaacgttacgttacggacggtaccggaccgtacggttcggtacgcggaccgttaacgtggtacctttaccgaacgtacgtaggtaaagtaacgtacggtgggtaacgggtagggtacgtacggttaaggtagggttcggtttaagggttttacggggttaacttttttcggtttaccggtagttaccgttaaccggttaccgggttaaacgtaaccggttaccctaacggttaaccggttaaccggtcccgggtttaaaccgttacgggtttacccgtttaaccggggaaccgtaaccgggtaccgttagtaacccgggttaggtaaaccgtacgtaaacgtacggtaaccgttcggtaccggtccgtacgacccttacggaccgtttaccgg

SEQ ID NO: 236808 - DNA, 822 bp, Homo sapiens
  misc_feature: GYAE6OF02GW4DT.3.35.D02.1.454.CMB.1.raw
tcagagacgcactccacgaccggtgctcgatttagcacacgatagttgggtttgggggatcaggactcctcagttcaccttctcacaatgagctccctgctcagctcctggggctgctaatgctcgtgggtcccaggatccagtggggatgttgtggtgactcagtctccactcctccctcgcccgtccaccttggacacggccggccctccactcctcctgcaggtcgtggtacaaacgtcctcggttacggttacggtagtagtacggaaacctaccttacttagtaacgttaggttatcagacgaggacggccgacggaccaactaccaccgaacggccgtacctaactacgttaacgttaacggtttaccggtaaccgggtacggtcggttaccggggtacccgaacggtacaagtacgttacgacggccggtaccgtacggtacgggtacgacggtacgtacgttacgttaactttaccaacgtacgttacggaaagttaacgttacgggaacgggtacgggggtagggttaacggcgtaagggggtaagggttacgttcgggggttttaaggttttaactttttaaggttttccggagtaaccggttaagtaccggtaaaccgtaacgttaacccgttaaccgtaaacccgtccgggttacccgttacccgtttaacggttttaaccggttaaccggggacccgtaacggggtacctaaccggtcgggtaacggtaacgtaaccgttaaaacccggaaacggttccggttacggtacgggtcccgttaaccgaaccttaccggttactttacccgg

SEQ ID NO: 236809 - DNA, 549 bp, Homo sapiens
  misc_feature: GYAE6OF02GUNYC.3.35.D02.1.454.CMB.1.raw
  modified_base (286)..(286): a, c, t, g, unknown or other
  misc_feature (286)..(286): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (310)..(310): a, c, t, g, unknown or other
  misc_feature (310)..(310): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacacgccggcctccatctcctgcaggtctggtcaaagcctcgtgtacggtgatggaaacacctacttgattggtatcagcagagcagcatcncagcnctatnatagttcaacggcncgtgggccagacagatcagcgcacgtggcaggcactgtattcactactgaagaattaggcgtaggggtggaggtcgtaggaggtagttaggttgggttattttacgtttcgtgacgtagtgacgtaacgtactaccacgtacgtcgtaccgttactacgttcgggaccgtagggaccaagtcggaggtaacgacgtaacgaaacggtactcggtcggacgttcgacgtacctattaccg

SEQ ID NO: 236810 - DNA, 664 bp, Homo sapiens
  misc_feature: GYAE6OF02I28RR.3.35.D02.1.454.CMB.1.raw
  modified_base (155)..(155): a, c, t, g, unknown or other
  misc_feature (155)..(155): n is a, c, g, or t
  modified_base (212)..(212): a, c, t, g, unknown or other
  misc_feature (212)..(212): n is a, c, g, or t
  modified_base (242)..(242): a, c, t, g, unknown or other
  misc_feature (242)..(242): n is a, c, g, or t
  modified_base (251)..(251): a, c, t, g, unknown or other
  misc_feature (251)..(251): n is a, c, g, or t
tcagagacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgnggtgactcagtctccactctccctgcccgtcacccttggacagccggctcatctccngcaggtctggtcaaagcctcgtgtacggtnatcggaaanaccgttacttgaattggtagtcagcagaggaccaggccaagtctccaaaggccgtacctaatcctaagttaaggtttctaaaccgggacgcgtaggggtcccaaggacagattcagcggcaacgttcgggacaggacaacttggactttacgaactacgtagtaagaatttaggcgaaggggttaggacggtagtaggtaaggagttaggttagggttacttttaagttttccgtaggtctaacgtacggtacgaaacggtcctaaaccgtacgtaccgtacggacccgtttaacgttaaccgttttcgggaccgttaacggggaccctaaaacggtcgtaacgggacgtaacgtaacgtaaaaccggaacttaggtacgggtacctaaccggcccgttaccacgtttaccgg

SEQ ID NO: 236811 - DNA, 877 bp, Homo sapiens
  misc_feature: GYAE6OF02HE1FO.3.35.D02.1.454.CMB.1.raw
  modified_base (157)..(157): a, c, t, g, unknown or other
  misc_feature (157)..(157): n is a, c, g, or t
tcagagacgcactccacgaccggtgctcgatttagcacacgatagttggggtttgggggatcaggactcctcagttcaccttctcacaatgaggctccctgctcagctcgtggggctgctaatgctacgtcgggtccaggtactccgaggtggggtnttggttggtggtgactcgacgtcctccactcctcctacggtcccgtcctaccgttcggacgacggtcccggtcctcgaacttccgtcctgaccgtacggttcctacggtaaccgtaaacgtcccgttacgggttacggtaccggtagaacggttaaccggaaaaccctacccgttaagtttacggtaagtttggtaactcgaacggtacgaaacgggacggtacccaacgggtaccttaacgtacccggtacggaaccgggtacctaaccttaaaccgttacgttaaacggtttaaaccgggtttacccggtaaaccggggtactccgggttaccggtaacccgtaaacggaacggtactaaacgttaccggacggttaccggaacggttaccggtacgggtccgaaagggtaccttaaccgttacgtagtttacccaaacgggtttactaaggtaaacgttaacgttagggtaccgggtaaggggtacgggttacggtacggtaacggggtaggtaacgggttgggttaacgggttattttaacgttcggttacgtactacggtcgtaacgtaacgttaacctaccgtacgttaccggtaacgttaccggttaacttaccggttaccggaaccggtacgggactaagggtacgtaacgggaataacgtaaacgaaccggtagtacggtccggtacttacggaccgtacgtcgttaaccg

SEQ ID NO: 236812 - DNA, 810 bp, Homo sapiens
  misc_feature: GYAE6OF02JO7BR.3.35.D02.1.454.CMB.1.raw
  modified_base (241)..(241): a, c, t, g, unknown or other
  misc_feature (241)..(241): n is a, c, g, or t
  modified_base (258)..(258): a, c, t, g, unknown or other
  misc_feature (258)..(258): n is a, c, g, or t
  modified_base (644)..(644): a, c, t, g, unknown or other
  misc_feature (644)..(644): n is a, c, g, or t
tcagagacgcactccacgaccggtgctcgatttagcacacgatagttgggtttgggggatcaggattcctcagttcaccttctcacaatgaggctccctgctcagcctccgtggggctgctaatgctcgtcgggtcccgaaggatccgaggtgggggattggttggtgggttagactcgagttcctccacctcctcccgtcgcccgtcctacccgttagggaccacggcccggtcctaccntcctccgtgccgaggtntcggtacaacgtcccgtcggtgtacggtagacgtaacggaaacctaccttacgttagtaacgtttggtaacttacgacgtacgaaggacgggccaacggacctaacgtaccgtaccgaacggaccccgtaaccttaacgtaccgttaaacggttaaggtttaaccggtaaccgggtaccggtcgggttaccgggtaaccccggaagaaccgttaaggtactttacggacggcccggtacggtaacggtcgggtacggtaccgacgtactcggttaacttacgaactacggtaagtacgttaaacgtacggtgggtaacggggtggtacgggtgtaacgggtacgggttaggttggtttacgggttacttttacgtttacggtacgngtacggtagtacgtaacggtacctaaccgtaacgtaccggttaccggtccgtttaaccgttaccggttcccgggtaaggtaccggtaccgtacgtaccggtaggtaacgtaccgttaaacgtaacgttaacggtcgtacggtaccgtaccgtaacgactagtaccg

SEQ ID NO: 236813 - DNA, 829 bp, Homo sapiens
  misc_feature: GYAE6OF02FFMVC.3.35.D02.1.454.CMB.1.raw
  modified_base (168)..(168): a, c, t, g, unknown or other
  misc_feature (168)..(168): n is a, c, g, or t
tcagagacgcactccacgaccggtgctcgatttagcacacgatagttgggtttgggggatcaggactcctcagttcaccttctcacaatgaggactccctagctcagctcctgggctgctaatgctctcggtcccaggatccagtggggatgtgtggtgactcagtcncactcctcctgcccgtcacccttgacacgccggccttccatcctcctcgcaggtctggtcaaacgcctcgtgtcggtagataggaacctacctattagtaacgtttggttaactcgtacgcgaaggtacggaccgacggtaccaacgttaccgtaccgaacggccgtaacctaattaccgtaagtttaaccggttttaccggtaaacccgggtacggtaccggttaccgggggtaaccccaacggtaacctacggtaacttaacccgacgggccggtaccgtacggttacgggtaccgtaacggcgtaacccgttagttaacgtttacccaacgtaaccgtaaggtaaacgttaacgtaacggtaccgggtaaggggtacgggacggtacgtaacgggtaggtacggttacgggtttaagggtttaagttttaacgtttcggtacgttaacgtacgtaccggtaacgtaacccggtaaccttaacccgtaacgttaccggttacccgggtaacccgttaaccggtttaaaccggtttttaccgggaacccgggttaacggggtacccaacggggtaccttaacgggaaccgttaagtaaaccgtaacggtaaccggttacggtacggtacccgtacgtaccgtaccgttaccgttaaccgg

SEQ ID NO: 236814 - DNA, 728 bp, Homo sapiens
  misc_feature: GYAE6OF02IJCP5.3.35.D02.1.454.CMB.1.raw
  modified_base (133)..(133): a, c, t, g, unknown or other
  misc_feature (133)..(133): n is a, c, g, or t
  modified_base (160)..(160): a, c, t, g, unknown or other
  misc_feature (160)..(160): n is a, c, g, or t
  modified_base (192)..(192): a, c, t, g, unknown or other
  misc_feature (192)..(192): n is a, c, g, or t
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
  modified_base (240)..(240): a, c, t, g, unknown or other
  misc_feature (240)..(240): n is a, c, g, or t
tcagagacgcactccacgaccggtgctcgatttagcacacgatagttggtttgggggatcaggactcctcagttcaccttctcacaatgaggctccctgctcagctccgtgggctgctatgctcgtcggtccngatcaggtgggactgttgtgtgactcnctctcctactctcctcgccctctacctgaccngcccgtctcactctccngcncgtcgtcgtacacgtccgtcgtgtacgngagtaccgaactaccgttactagtagttcgtactacgagtacgcgtacgccgtaggacctaacgtccgtaaccgacgtccacctaacttacggtaagttacggttaccgaacggccgtcggtaccggtacacgacgtagtactacggacgtccgacgttcggtacggtcgtacgacgtactttacgtaccttccgtaacgtcgtaacggtacgtaacgggttacgacgggtaacggggtagggtaccggtacggttaggggaacggtttacggtttgggtttacggtttaacggttttacgttcgtaacggtacttacggtaaccggtaacgttaccgtacgtaacgtaccgttaccggttacggtacccgttacggtttaaccggttaccggtaacgggtaccggtaccggtaacgtacggtaacgtaccggtaaactaacgtaaccgtaacgtcggtacaccggtacgtaccgtcgtacgttaacg

SEQ ID NO: 236815 - DNA, 742 bp, Homo sapiens
  misc_feature: GYAE6OF02F3X1N.3.35.D02.1.454.CMB.1.raw
tcagagacgcactccacgaccggtgctcgatttagcacacgatagttgggtttgggggatcaggactcctcagttcaccttctcacaatgaggctccctgctcagctccgtggggctgctaatgctcgtgggtcccaggactccaggtggggattgttgtggtagactcagtctccactcctccctcgcccgtctacccgttggaccacggcccggtcctcctacttccttccgtcgtaccgtacggttccgtacggtaccaaacgtccgttcggttacgttacgggtagagtacggaacctacctagttagtattaggtatcgaggcacggacggaccacggacctaactccgtaccgacggtaccgtaccttaacgtaccgttaacgttaaccgggtttaccgtaaacccgggtcggtaccgggttaccggggtacccaacggaaccgtacgtacgttaccgaacgggccgtaccgtacggtagggtaccgtacggtactaacgttcgtaccttacgactacgtacgtaagtaacgttacggtagggacgggtacggtaggtagtacggaaggttcgttagggttacggttaattttacgttcgtgtacgtacgtacgttacaacgtctaaccgccgtagtccggtacttacgttcggttcgacgtacgacgtcggtacggtaagaacgttactaaccggtaacgtacgtcggtacggtctacgtaaccgtgtattaccg

SEQ ID NO: 236816 - DNA, 981 bp, Homo sapiens
  misc_feature: GYAE6OF02FQDVR.3.35.D02.1.454.CMB.1.raw
  modified_base (348)..(348): a, c, t, g, unknown or other
  misc_feature (348)..(348): n is a, c, g, or t
tcagagacgcactccacgaccggtgctcgatttagcacacgatagttgggtttgggggatcaggactcctcagttcaccttctcacaatgaggctccctgctcagctccgtggggctgctaatgctcgtcgggtcccagggatccaggtggggactagttggtggtgactctagtctccactctcccgtcgtcccgtacaccttggacgacgccggcctccatcctcctgcgtaggtctcggtacaacgtcgtacgtgtacgggtagactaaggaaaccctaaccttacgttaggtaactttagggtaactcgaacggacgaacggacgggaccacggtaacctaacnccgttaccgaacgccggtacctaagttactaagtttaacggttaccgtaaccgggtcgaccgggtcgggtacccgaagtacaacggtacttacgacggtcggtaccgtacgggttaccgggtacgtacgggtacctaaccgtttacgttaaccgttttaccgaaaacccgttaccggttaaggtaaacgggttaaacgtttacgggggtaacccgggggtttaaaagggggggtaccggggggtttaaaccggggtcgttaaaaccgggggggttaaagggtttaaggggtttttaacgggggtttttaacggggtttttaacgttttttaccgttttttacccgaagggttaacgtaaaccgttttccggggaaaaccctttaaaccgggttacccgttaaaccgtaacccgggtttaccggttaacccggggttttaaaccccggtttttaacctttttaacccgggggtttacccgggaaccgggggttaaaccggggggttacccgaacgggtttaaccgtaacgggggttaaacctaaaccgttaaaaccggtaaacggtttacccggggttacggtttcggaacccggttaaccggacccgttaccccgggtttaatttacccccgg

SEQ ID NO: 236817 - DNA, 938 bp, Homo sapiens
  misc_feature: GYAE6OF02IVHB6.3.35.D02.1.454.CMB.1.raw
  modified_base (114)..(114): a, c, t, g, unknown or other
  misc_feature (114)..(114): n is a, c, g, or t
  modified_base (170)..(170): a, c, t, g, unknown or other
  misc_feature (170)..(170): n is a, c, g, or t
  modified_base (674)..(674): a, c, t, g, unknown or other
  misc_feature (674)..(674): n is a, c, g, or t
  modified_base (870)..(870): a, c, t, g, unknown or other
  misc_feature (870)..(870): n is a, c, g, or t
tcagagacgcactccacgaccggtgctcgatttagcacacgatagttgggtttggggatcaggactccgtcagttcaccttctcgacaatgaggcctccctgctcagcgtccgnggggctgctaatgcttcgtacgggtcccaggatccgtaggtggggtattggttggnggtacgtacctccaggttccctaccctccttccttcccccgtcgtccccggttacctccgttacgggaccacggtccccggtcccttaccgacttccgtaccgtgtacccgtagggttccgttaggtaaccgtaaaccggtcccgttggtttaccgggtaacggtaacctaaggttaaccgggtaaaaccctccgtttagttaaccgttaaggtttggtaacccgtcggaccggtaccgaagggttaccggacccgtaacggaccctaaaccgtttccggaacccgacgggttaaccaccgttaaaaccttggtttaaaacgggtttaacccgggtttaacccgggttaaaccccggggcctttaaccccggggttccggggttaacccggtaaacgtacggttaaccggttacgttaccggaaaccggggtcgttacccgggaggggtaccggttaacgacggttacctacggtttacgttcccgttaacccgaacggttaanacgggttaaacgtaaacggtacggtaccgggttaaaggggcggttaaccggtaagttcggtaaagggttaccgttgggtttacggtttaactttagttaccgttacgacggtttactaccgagttaacgcccgttaacgcgtaccgtaacggtacgttaccgttacggtaccgggtacgaccgtacgtaaccggtnaacccgggttaataccggtaagtaccgtagttcggacccggttagtcccctagtacggttcttaaccg

SEQ ID NO: 236818 - DNA, 855 bp, Homo sapiens
  misc_feature: GYAE6OF02H2ISY.3.35.D02.1.454.CMB.1.raw
  modified_base (230)..(230): a, c, t, g, unknown or other
  misc_feature (230)..(230): n is a, c, g, or t
  modified_base (390)..(390): a, c, t, g, unknown or other
  misc_feature (390)..(390): n is a, c, g, or t
tcagagacgcactccacgaccggtgctcgatttagcacacgatagttgggtttgggccgagctgggttttcctggttgttattttacaaggtgtccagtgtgaggtgcagctggtgcagtctgggggagcgttggtccagccgtggaggtcccgtgagactctcctgtggtcggtctctggacttccacccttgacgggaaccctacttcagtggaccgttgggtacccnccgaggcctccgaggggagggctagggaggttgggtggaccgttaagtaaacgaaacgaaaggtcgtaaaggaaacgtttaccgaaccaacgaagtacttaaccggcgccgtaccgtgtagaaccgagggactaaggtaacttcccgaacctatacctanaacggagtactgtacttaacgaagcaaactcagtctctatgtaacaaatcgaacctaccgtagaaaccgaccgaagtaaccctaccgggccctaagttaacgttaccgtacgtaccgtacctaaccgtagtaacgttactaacgttaacgttacgggtaacgttacccgtaaaccggttaaccgtaacggttacgggggacccgtaaaccggggtacggtacccggttacgggtaacccggttaccccggttacccgttacccgttacccggacccggtttaacccacccccgggtaaaaccgaacccgggtaccccgttaacggttacccccgggtttaacccgtttcccccccgggttaacgggttcccccggtacccggtccccggtttaaccccgaccggttaccgggaacccgttcccggtaaaccccggttccccggtaaccgggacccgtaacccggg

SEQ ID NO: 236819 - DNA, 875 bp, Homo sapiens
  misc_feature: GYAE6OF02I4C7T.3.35.D02.1.454.CMB.1.raw
  modified_base (118)..(118): a, c, t, g, unknown or other
  misc_feature (118)..(118): n is a, c, g, or t
  modified_base (855)..(855): a, c, t, g, unknown or other
  misc_feature (855)..(855): n is a, c, g, or t
tcagagacgcactccacgaccggtgctcgatttagcacacgatagttgggtttgggggatcaggactcctcagttcaccttctcacaatgagctcctgctcagctctgggctgctaangctctgggtcccaggatccaggtggggattggttgtggtgactctagtcctccactccgtccctcgcccctacgtacccgttggaccacggccccgcctacctacttccctccgttcgaccgtacgggttccttacgggttaccaaaacgtcccttcggttacggttaaccggtcggtaacgtaccgggtaaaaacccttcccgttaacgttaggttaaagtttcggtaaattaccgacggtacgtaaggaccggtaccgaaccggtaccctaaacgttcccgaacccggaaacggtcccgtaaccccgtttaaagttccgtttaaaacggtttaaccgggttttacccgaaaaccccgggggttctcccggggttaccgggtaccccgtaagaccgttaaggtacctttcgggaccggtccggtaccgttaaccgggtttcgggaaccgtacgggtaaacctcgttaacggttaaactttcccggaacgtacggttaggtaaacggttaaacgttacggtaacgggtaacggggttagggaacggttaccgggtaacgggttagggtaaggttcggtttacggggtttaaacttttcgggtttccgttacggtacgttacgtacggacgtaaacgtcctaaccgaccgtacgtaccgtcgttaccgttaacgttccgggaaccgtacggtacctaggtacgtaggacgtactaaacgtaccgtaggtacgcggtancggtacctacgtacgttacg

SEQ ID NO: 236820 - DNA, 743 bp, Homo sapiens
  misc_feature: GYAE6OF02G4OIM.3.35.D02.1.454.CMB.1.raw
  modified_base (555)..(555): a, c, t, g, unknown or other
  misc_feature (555)..(555): n is a, c, g, or t
tcagagacgcactccacgaccggtgctcgatttagcacacgatagttgggtttgggggatcaggactcctcagttcaccttctcacaatgaggctccctgctcagctccgtggggcttgactaatcgctcgtcgggtcccaggatccgtaggtggggattggttggtacggtagtacctcgtacgttcctcctaccttccgtcccttccggaccccgttccgtacccggttcggaccgaccggtcccggaccttaccgtaccttcctccgtcgtacgtacggttcgtacgtaaccgaaccggtccgttcggtacgttacgggagtacggtaaccgtaaacctaccgttagttagttagtacgtacgtacgacggtacgacggcggaccgtacgactaccgccgtacgaccggtactaccgttacttaaggttacgttaccggtacggtacggtcggtccggtcgtacgactgacgtacgacggaccgtcgagttcggagacgagtactgtactactacgtactagtagtagacggtgacggcggtagtcggtagnggttaggtagtttacggtacgttagttcgtctgtacgtcgtacgtaacgtcgtaaccttccggacgttaccgttaccggttacgttacgttaccggtaacgcgggttaacccgtagttaccgtaggaaccgttaaccgaggaaccggttacggtacggcgttacgtcaccgtaacgttcgtcgttacg

SEQ ID NO: 236821 - DNA, 679 bp, Homo sapiens
  misc_feature: GYAE6OF02JDS0C.3.35.D02.1.454.CMB.1.raw
  modified_base (427)..(427): a, c, t, g, unknown or other
  misc_feature (427)..(427): n is a, c, g, or t
tcagagacgcactccacgaccggtgctcgatttagcacacgatagttgggtttgggggatcagggactcctcagttcaccttctcacaatgaggctccctgctcagctcctgggctgctaatgctctgggtcccaggatccaggtcggggatgttgtggtgactcagtctccactcctacccgtcgcccgtcacccgttggaccagcccggcctccaatcctcctgctagggtcctggtcaaagcctcgtcgtacggtgataggaaaccacctatgtacgttggtactcagtcaggtagcccaggaccaatccgccaaggccgtcctaaagtcttaagtaacggtttaccaaccgggtacgtccgtcggggtacccaggaccacgtacttacgacggcggtcgacgttcgggtcaggtacacgttanacgtttccaccgtactcggtaataacgttaaggtaccggtaggggtaggtacgggtacgtacgggagggtaagtggttaggttagtttaagtttcgtgtaccgtagtcgtacgtaagtacctacgtaccgacgtacgtaccgttaccgtaccgttttacggccgtacggtaccgtaacgtacggtcggtaacgtacgtaacgtaaccgtaaccgtacggttacggacgtaccgtaccgtaccgtagttaccg

SEQ ID NO: 236822 - DNA, 722 bp, Homo sapiens
  misc_feature: GYAE6OF02G2BE5.3.35.D02.1.454.CMB.1.raw
  modified_base (323)..(323): a, c, t, g, unknown or other
  misc_feature (323)..(323): n is a, c, g, or t
  modified_base (707)..(707): a, c, t, g, unknown or other
  misc_feature (707)..(707): n is a, c, g, or t
tcagagacgcactccacgaccggtgctcgatttagcacacgatagttgggtttgggggatcaggactcctcagttcaccttctcacaatgaggctccctgctcagctccgtggggctgactaatgctcgtcggtcccaggatcgaggtgggattgttggtggtgactgacgtctccactcctcctcgcccgtccaccgttcgacacggcccggcctccgaactcctacctgacgtacggttccttacggtacaaaccgtccgttaggttacggtaacgggtagagtaacggaaacctaccttacgttaagtaagttaggttanaccgtaggactaaggacggtaaccgaacggaacctaaactaccgtaccgaacggcctaacctaacttacgtaaacgtttaacggttaccgtaaaccgggcggtaccgggtacgggtaaccccaagtacgtaacgttactacggacgacgtaccgtacggttacggacgtaacgggactacggtacgtactttacgggactaacgtaggtaaagtaacggtaggtacggtaacggggtaggtacggtagtagggtacgtagttacgggttaggtttacgtttaattcggagtacgtagtacaacgttagacctagaccgtatcggtacttaacgtcgtacggacgaacgcgagtcgagaacaactaacgaactagtgacggtacncggaactctgtaccg

SEQ ID NO: 236823 - DNA, 779 bp, Homo sapiens
  misc_feature: GYAE6OF02JCROW.3.35.D02.1.454.CMB.1.raw
  modified_base (176)..(176): a, c, t, g, unknown or other
  misc_feature (176)..(176): n is a, c, g, or t
  modified_base (257)..(257): a, c, t, g, unknown or other
  misc_feature (257)..(257): n is a, c, g, or t
tcagagacgcactccacgaccggtgctcgatttagcacacgatagttgggtttgggggatcaggactcctcagttcaccttctcacaatgaggctccctgctcagctcctggggctgctaactgctgtggtcccaggatccaggtggggattgttgtggtgactcagtctcactcncctcgccgtcaccgttggacacgccgcctccatccgtcctgacgacggtctacggtccaaacgtcctcggtaggtacggtnacgttacggaaacctactacgtttagaacttggtaactcgagtacgacggacggtcgacggtacctaactaccgtacgtagtccgacctaattctaacggtttaacgggttttaccgaaaccgggctcgggttaccgggtaccctaaagtaccgtagtacgttaccggaacggtacccgggtacctacgttcggggtaactacgggtacctaacgttcgggtactttaccctaacgcgtaaccggtaacgtaacgtttaacggccggttaagggggtacgacggtacgtagggttaacggtacggttttggttaacgggtttaaccttttagttcgtaacgtacgtagtaccgagtaaacgtactaaccgtacgaacgtttccggaacgttaccggttacgttaccgggacgggtaaccgcggttaaacggtccgggaacggttaccggttaaactaaaaccggtaaccgtaggttaccggttacggacccggttcccaaccggttaccgttcggttaaccg

SEQ ID NO: 236824 - DNA, 860 bp, Homo sapiens
  misc_feature: GYAE6OF02IKY70.3.35.D02.1.454.CMB.1.raw
  modified_base (122)..(122): a, c, t, g, unknown or other
  misc_feature (122)..(122): n is a, c, g, or t
  modified_base (164)..(164): a, c, t, g, unknown or other
  misc_feature (164)..(164): n is a, c, g, or t
tcagagacgcactccacgaccggtgctcgatttagcacacgatagttgggtttgggggatcaggactcctcagttcaccttctcacaatgaggctccctgctcagctcctggggctgctaangctctgggtcccaggatccagtggggatggttgtggtgactnagtcctccactcctccctcgcccgtcctaccttgacacgccggccctccacgtcctcctcgcgaggttccgtggtacaaacgtcccttggttaggttaaccggtgagtacggaaaacctaccgttaacttagtaacgttttaggtatcacggacaggacgacccgaggacccaacgtccgtacccgtaacgggcccgtaccttaacttaccttaacggtttaaacgggttttacccgtaaacccgggggacgtccgggtttaccgggggaacccctaaggaaccgtaagtacgtttaccgacgggtacccggtacgtaacccgggttttggggtacccgaagggtaccctaaccggtttacggttaacgtttttaacccaacgtaccggtaggttaaacggaaagtttacgggacggtaaggggtacgggtacggtaggtaaggaagggttagttagggtttacggttattttttaacgtttgacgttacgtacgtaggtactaaaccgtactaccgtaccggtacgttaccgggttaaccctttaaccggtttagtttacccggggaaccgtaacccggggtaaccgaacggtccggtaagggtaaaccgttaacggtaacccggttaaaacggtaaaccggtttcgggtaaccgtaccgggttaccgtaacccgacccttacggttttaacccg

SEQ ID NO: 236825 - DNA, 780 bp, Homo sapiens
  misc_feature: GYAE6OF02FKPVQ.3.35.D02.1.454.CMB.1.raw
  modified_base (619)..(619): a, c, t, g, unknown or other
  misc_feature (619)..(619): n is a, c, g, or t
tcagagacgcactccacgaccggtgctcgatttagcacacgatagttgggtttgggggatcaggactcctcagttcaccttctcacaatgaggctccctgctcagctctggggctgctatgcttcgtcgggtcccaggatcctaggtggggtatggttggtggtgactcagtcctcctacctcctcccgtcgccccgtcctacccgttggacaccggcccggccctcctacttcctcctcgcgtacggtcgtcggtacaaacgccttacggtcggtacgggtagacgtaccggaaacctaaccgttacgttaagtagttacggttaactccgagtacggacgacgggaccggtaccggtaaccctaacgtacccgtaccggaaccgggtaccgtaaccgttaacgttaccgttaacggttttaacggtttaacccgggtaaccgggtacggtcccggttacgggttacccgacggtacgaagttccgtacgacggccgtacgtacggtacgggtcgacgtcacgttggtacttaccacgtagtacggtaataagtcggtaggagggtagggtcgctagggtggttacgtggtttagttagtttaccgttgtgtaccgtnacggtacacgtacctcgaacgtttccgtcgggttaccttacggttacgttacgggacccgggtaaggacccgtagtaccgggtaaggtaacctaaccggttaacggtaaacccgggtagtacgggtttccgaccggtactacccggtacttcggttaaccg

SEQ ID NO: 236826 - DNA, 907 bp, Homo sapiens
  misc_feature: GYAE6OF02I37AH.3.35.D02.1.454.CMB.1.raw
tcagagacgcactccacgaccggtgctcgatttagcacacgatagttgggtttgggggatcaggactcctcagttcaccttctcacaatgaggctccctgctcagctccgtggggctgctaatgctcgtgggtccaggatccaggtgggatgttgtggtgactcagtctccactcctccctcgcccgtcacccgttggacacggccggcctccacttcctccgtgcgacggttcgtacggtaccaacgtccgtcggtcggttacggtgaagtaacggaaacctaccgttacgttagtaagttggtaatccgtagacgtagggacggaccgaacgggaccctaaacgttcccgtacccggtaaaccgggtccctaaccgttaaacttaaccggttaaacgtttaaaccgggttttacccggtaaaacccggggtacgtcccgggttacgggggtaccccaacggacgtaacgtacgttacggacggtccggacgtaccggtgggtccgaacggtcctaacgttcggtacgtttaccaacgtacgtagtaaggttaagttaacgggtcgggacggggtaggggtacggtaggtacggggtacgggttagggtttacggggttttacgggtttaagtttacggtacggtagtacgttacggtaacgggttaaaccggtaacgtaccgtacccgggtttaccggtacccggttaccggggttaaccgggttcccggggtaaacccggaaacccggggttaaccggggtaaaccgggttacgggttaaaaacccggtaaccggtaaaaccggttaaccggggttacggtaaccgggtacggtaacccggtaaccgttaaccggttacctttccgggtttaaccggttttcccgttaccggttttacccccgg

SEQ ID NO: 236827 - DNA, 531 bp, Homo sapiens
  misc_feature: GYAE6OF01C702T.45.15.B04.1.454.CMB.1.raw
  modified_base (374)..(374): a, c, t, g, unknown or other
  misc_feature (374)..(374): n is a, c, g, or t
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagttgttttaccggccccaatagtaagaactacttagcttggtaccagcagaagccagggcagcctcctagcctgctcttttacgtggcctcgtacccgggagtccggggtccctgaccgattcagtggcaggcgggtctggggcagtntttcactctcaccatcagcagcctgcagcctagaagatgtcgtctagtttactactgtcagacaattattatgagtacttcctctctaccgtttcgggcgggacggaccgtaagggttgcgtaagtacgaaacgacgtcggtagctcgcctcgtacg

SEQ ID NO: 236828 - DNA, 529 bp, Homo sapiens
  misc_feature: GYAE6OF01DR441.45.15.B04.1.454.CMB.1.raw
  modified_base (306)..(306): a, c, t, g, unknown or other
  misc_feature (306)..(306): n is a, c, g, or t
  modified_base (368)..(368): a, c, t, g, unknown or other
  misc_feature (368)..(368): n is a, c, g, or t
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctggcgagagggccaccatcaactgcaggtccagccagagtgtttttacggccccaatagtaagaactacttagcttggtaccagcagaagccagggcagcctctagcctgctctttacnggcctcgtacccgggagtcccgggtcctggaccgattcagtggcaggcgggtctggggcagntttcactctcaccatcagcagcctgcngcctagacgntgtcgctagtttacctactgtcagctaattattatgagtacttccctctcgtaccgttttcggacgggtagggaccgtaagggtttgacgtatacgaaacgtactggtacgctcgccacgtacg

SEQ ID NO: 236829 - DNA, 468 bp, Homo sapiens
  misc_feature: GYAE6OF01ATWWU.45.15.B04.1.454.CMB.1.raw
  modified_base (461)..(468): a, c, t, g, unknown or other
  misc_feature (461)..(468): n is a, c, g, or t
tcagacgcgatcgacacgaccggtgctcgatttagacagtatatatccgcgggcgccagatgcccgggaaaggcctggaaatcgtgggcatcatctatcctggtgactctgataccagatacagtccgtccttccaaggccaggtcaccatctcagtcgacaagtccatcaacaccgcctacctgcagtggaccagcctgaaggcctccgacagcgccatttattactgtgcgagaagtcgccagccatattgtggtcctgcctgctattgggccttctggttcggccctttggggccagggaactctggtcaccgtctcctcagcctccaccaagggcccatcggtcttccccctggcaccctcctccaagagcacctctgggggcacagcggccctgggctgccctggtcaaggactacttcctcgatcgcgtctgagcgggctggcaaggcgcatagnnnnnnnn

SEQ ID NO: 236830 - DNA, 550 bp, Homo sapiens
  misc_feature: GYAE6OF01EJCBV.45.15.B04.1.454.CMB.1.raw
  modified_base (215)..(215): a, c, t, g, unknown or other
  misc_feature (215)..(215): n is a, c, g, or t
  modified_base (467)..(467): a, c, t, g, unknown or other
  misc_feature (467)..(467): n is a, c, g, or t
tcagacgcgatcgacacgaccggtgctcgatttagacagtatatatccgcgggggagtctccctcactgcccagctgggatctcagggcttcattttctgtcctccaccatcatggggtcaaccgccatcatcgccctcctcctggctgttctccaaggagtctgtgccgaggtgcagctggtgcagtctggagcagaggtgagaaagcccgggnagtctctgatactctcctgtaaggattctggatacaactttaacgaccactggatcgcctgggtgcgccagagtcggacccggggaaaaggccgtaggaaatcggtgggcagtcatctatcctggtcgactctgataccagactacagttcccgtccttacgaaggccaggtccacctatcctacagtcgacaacgtccataccaacaccacctacctgcagtcggaccagccgtagaacgccctacgaacncgcgtacctagttactacgtgtgacgtaagtaacgtcgccgacgtcccaagttacgttcggtacggttcctggtcccttacgg

SEQ ID NO: 236831 - DNA, 581 bp, Homo sapiens
  misc_feature: GYAE6OF01DCGRW.45.15.B04.1.454.CMB.1.raw
tcagacgcgatcgacacgaccggtgctcgatttagacagtatatatccgtcggggacaacaggcaggcaggggcagcaagatggtgttgcagacccaggtcttcatttctctgttgctctggatctctggtgccgtacggggacatcgtgatgacccagtctccagactccctgactgtgtctcgtgggcgagacgggccaccatcaactgcagtccagccagtagttgtttttaccggcccaatagtaagaactacttagtcttggtaccagcaagagccgaggcagcctcctagcctgcttctttactcggcctcgtacccgggagtcccggggtccctgaccgattcagtggcgaggcgggtctggggcaggtatttcactcctacaccatcgacgcacgccctgacacgacctagaagtagtcgtacgactaagtttacctacgtcgtacaagacaaattattaacgaggtatacttcctacgtactaccggtttccgggaggtacgggaccgtaaggttcgacgtaataacgaaaacggtacgtaggacggtctacgaccaacctacgtcgttacg

SEQ ID NO: 236832 - DNA, 531 bp, Homo sapiens
  misc_feature: GYAE6OF01CIZ38.45.15.B04.1.454.CMB.1.raw
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagttgtttttacggccccaatagtaagaactacttagcttggtaccagcagaagccagggcagcctcctagcctgctcttttactgggcctcgtacccgggagtcccggggtccctgaccgattcagtggcagcgggtctggggcagatttcactctcacatcagcagcctgcagcctagaagatgtcgctagtttactactgtcagctaatattagtgtatacttcctctctacgtttcggcggtagggacccgtaagggttgacgtataccaaaacgtacgtggtacggctacgccacctaacg

SEQ ID NO: 236833 - DNA, 547 bp, Homo sapiens
  misc_feature: GYAE6OF01BE9JH.45.15.B04.1.454.CMB.1.raw
  modified_base (345)..(345): a, c, t, g, unknown or other
  misc_feature (345)..(345): n is a, c, g, or t
  modified_base (397)..(397): a, c, t, g, unknown or other
  misc_feature (397)..(397): n is a, c, g, or t
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagtgtttttacggccccaatagtaagaactacttagcttggtaccagcagaagccagggcagcctctagcctgcttcttttactgggcctcgtacccgggagtcccgggtccctgaccgnttcgagtggcaggcgggtcgtggggcagtactttcactctcaccatcacgcngcctgcagcctagaagtatgtcgactacgtttactactgtcagctaatattatgatacttcctcgttctaccgtttcgggacgggtaacgggtaccgtaaggttcgacgtaactaccgaaacgtacgtgtggacctcggacctaccgtac

SEQ ID NO: 236834 - DNA, 512 bp, Homo sapiens
  misc_feature: GYAE6OF01BNQ2G.45.15.B04.1.454.CMB.1.raw
  modified_base (338)..(338): a, c, t, g, unknown or other
  misc_feature (338)..(338): n is a, c, g, or t
  modified_base (385)..(385): a, c, t, g, unknown or other
  misc_feature (385)..(385): n is a, c, g, or t
  modified_base (407)..(407): a, c, t, g, unknown or other
  misc_feature (407)..(407): n is a, c, g, or t
tcagacgcgatcgacacgaccggtgctcgatttagacagtatatatccgcgggggagtctccctcactgcccagctgggatctcagggcttcattttctgtcctccaccatcatggggtcaaccgccatcatcgccctcctcctggctgttctccaaggagtctgtgccgaggtgcagctggtgcagtctggagcagaggtgagaaagcccgggcagtctctgatactctcctgtaaggattctggatacaactttaacgaccactggatcgcctgggtgcgccagactcggcccggggaaaggcctaggaaatcggtgggcatcatctatcctggtnactctgataccagatacagtccgtccttcaaggccaggtcaccatcncagtcgacaagtccatccaacnccgcctactgcagtcgaccagcctagaacgccctccgacagccgcctatttactacgtgtcgcgagtacgtcgcccagccaattcgttggtcgtcctgccgttcg

SEQ ID NO: 236835 - DNA, 547 bp, Homo sapiens
  misc_feature: GYAE6OF01BX8OR.45.15.B04.1.454.CMB.1.raw
  modified_base (309)..(309): a, c, t, g, unknown or other
  misc_feature (309)..(309): n is a, c, g, or t
  modified_base (422)..(422): a, c, t, g, unknown or other
  misc_feature (422)..(422): n is a, c, g, or t
  modified_base (538)..(538): a, c, t, g, unknown or other
  misc_feature (538)..(538): n is a, c, g, or t
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagtgtttttacggccccaatagtaagaactacttagcttggtaccagcagaagccagggcagcctcctagcctgctcttttacngggcctctacccgggagtccggggtccctgaccgattcagtggcagcgggtctgggggcagatttcactctcaccatcagcagcctgcagcctgaagatgtcgctagtttacnctgtcagctaatattactgagtacttcctctctacgtttcgggcggtaacgggtaccgtaaggtttagcggtaactaccgaaaacccgtaacgttcggtacggtcctacggtcccncgttaaccg

SEQ ID NO: 236836 - DNA, 654 bp, Homo sapiens
  misc_feature: GYAE6OF01C0PQ7.45.15.B04.1.454.CMB.1.raw
  modified_base (425)..(425): a, c, t, g, unknown or other
  misc_feature (425)..(425): n is a, c, g, or t
tcagacgcgatcgacacgaccggtgctcgatttagacagtatatatccgcggggacaacaggcaggcaggggcagcaagatggtgttgcagacccaggtcttcatttctctgttgctctggatctctggtgcctacggggacatcgtgatgacccagtctccagacctccctgactgtgtctcgtgggcgagagggccaccatcaactgcaggtccagccagagttgtttttaccggcccaatagtaagaactacttagcttggtaccagcagaagccgagggcagcctcctagcctgcttctttactgggcctcgtacccgggagtcccgggtcctggaccattcgaggtggcaggcgggtcgtggggctagtatttccacgtcctcacctatcgagccacgcctcgcacggccctaggaagtntcggtcgtacgtaacgtttacacgttgtacaaggtactaaagttacttaagtcggtaaagttacctttcccgttaccgttaccgttaccggttttccgggaaccggggttaaacggggtaaccccgttaaaaggggttccggaaccggtaaattaaacccggtaaaacggtaacgttacgggttacgggtaccgttacggaaccctaacccgtagttccgtttacccgg

SEQ ID NO: 236837 - DNA, 802 bp, Homo sapiens
  misc_feature: GYAE6OF01C8V9T.45.15.B04.1.454.CMB.1.raw
tcagacgcgatcgacacgaccggtgctcgatttagacagtatatatccggtcgggggggagctaacaacaggcaggcaggggcagcaagatggtgtgcagacccgaggtctcattctctgttgctctggatctctggtcgccgtacgggacatcgtgatcgacccgtagtcctaccagacctccctgacctgtcgtcctcgtcggcgagacggccacatcaacgtgacacgtcagccagtacgttcgtttaccgacctaagtagtaaacgtactacgttacgtcgttacggtaacctagtacgaagtacgtccgaggacacgaccctacgtacgccttctaccttctttacgtcgtcctaccggtacccgggtacgtcccgggtcctacgtaaccgtacgttacgtacggtcggtaccggtcggtcgggtacggtcgggtacctaggtacctttcgacgttcgtaccgacctataccgacgtcctaaccgtccgtacgaccgtacgtacccgtaaaggaaactccgggttagttacccgtaacgtttaacggttttacccgtaacggttcggtaaccttaaggtaaccctttaaagttttaaacggtttaaccgttagggtaaacccttttaccggtttaaacccgtccgttaaaccggtttacccgggtttaccgggggaaaccggggttaacggtaaaccgggttttaacggggtacccgtaacggtaaaaccggtaaccggttaaaacggttacgggtaccgttaacggggtacctaaaccggtcgtaacccgtttaac

SEQ ID NO: 236838 - DNA, 627 bp, Homo sapiens
  misc_feature: GYAE6OF01C2OCX.45.15.B04.1.454.CMB.1.raw
  modified_base (171)..(171): a, c, t, g, unknown or other
  misc_feature (171)..(171): n is a, c, g, or t
  modified_base (320)..(320): a, c, t, g, unknown or other
  misc_feature (320)..(320): n is a, c, g, or t
  modified_base (405)..(405): a, c, t, g, unknown or other
  misc_feature (405)..(405): n is a, c, g, or t
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccgganactccctgactgtgtctctgggcgagagggccaccatcaactgcaggtccagccagagttcgttttacggcccctaatagtaagtaactaacttagcttggtaaccagacagaacgccagggcacgcctcctagcctgcttctttacgnggtcctcgtacccgggagtcccgggtcctgaccgattcgagtggacaggtcgggtctcggggctagtactttcactcgtcacctntaccgacgcacgtcctgaccgtacgacctagaagactcgtacgtactacgtttactacgtcgtacagtactaattacttaagtcgtaagtactttcctacttaccgttaacgtttccgggaccgggtacgggtaaccgtaacggggttacgaccggtaaacttaacccggtaaaacggtaccgttacgggtacggtaccgtacggtccctaaccgttaaccg

SEQ ID NO: 236839 - DNA, 690 bp, Homo sapiens
  misc_feature: GYAE6OF01A9CH4.45.15.B04.1.454.CMB.1.raw
  modified_base (371)..(371): a, c, t, g, unknown or other
  misc_feature (371)..(371): n is a, c, g, or t
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagtttgtttttaccggaccctaagtagtaagaacttacttagtcttaggtaccagcagaacgccgagggcacgcctcgtacgcctgtccttacgttttacgcgggtccttccgtacccgggtcggtcccgggtccctaggaccgtntcgaggtcgcgacggcgggtcgtggggctacggtatttccgaaccttccgtactaccgtataccgacgcgacgtcctacggacgacgggtactaaggtaacggtagttcggttacggacgtttaagttttacttcggcgttgtaccgaaggtaacttaatttaagttttattaacgtttcctttacccgtaccgttaccgtttttccgggacccgttaacgggtaaaccctaaaagggttcggtaacttaacggtaaacccgtaaaaccggttagttacggttcccggtacgtaccggaacccttacgtacgtttaccg

SEQ ID NO: 236840 - DNA, 694 bp, Homo sapiens
  misc_feature: GYAE6OF01E3F9Q.45.15.B04.1.454.CMB.1.raw
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctcgtgggcgaggagggccaccatcaactgcaggtccagccagtagttgtttttaccggcccaatagtaagaactactagtcttaggtaccagcagaacgccgagggcacgcctccgtacgcctgctttcttttacgtcgggtcctccgtaccccggggtaggtcccggggtccctcggaccgtattcgtaggtcggcgacggtcggggtcgtggggcgtacggtactttccacttcctaccaacctactacgacgccacgtccctgaccacggtacccgtaggaaacgtacgtcggttaccggtacgttaacgttttacctacgttcgtaccgaagtacctaaatttactttagtacgtacgttaacctttccgtaccgttacgtaccggtttccggggaccgggtaaccgggtaacccgtaagggtttacggaaccgttaacgtaacccgtaaaaacgggttaaccgttcgggttacgggtaccttaccggacccgtaacccgttacg

SEQ ID NO: 236841 - DNA, 573 bp, Homo sapiens
  misc_feature: GYAE6OF01DQTD0.45.15.B04.1.454.CMB.1.raw
  modified_base (344)..(344): a, c, t, g, unknown or other
  misc_feature (344)..(344): n is a, c, g, or t
  modified_base (409)..(409): a, c, t, g, unknown or other
  misc_feature (409)..(409): n is a, c, g, or t
  modified_base (563)..(563): a, c, t, g, unknown or other
  misc_feature (563)..(563): n is a, c, g, or t
tcagacgcgatcgacacgaccggtgctcgatttagacagtatatatccgcggggacaacaggcaggcaggggcagcaagatggtgttgcagacccaggtcttcatttctctgttgctctggatctctggtgcctacggggacatcgtgatgacccagtctccagactccctgactgtgtctcgtgggcgagagggccaccatcaactgcaggtccagccagagttcgtttttacgcccaatagtaagaactacttagcttggtaccagcagaagccagggcagcctcctagcctgtcttctttacgcgggcctcgtacccgggacgtcccgggtcctgaccgtnttcgagtggcaggcgggtctggggcagtattcactctcacatcagcacgctgcagcctagaagtntcgtcgctagtttacctacgtcgtacagacctaattattagtacgtaagttactttcccgttactacgttacggtttccggacgggtaacgggaaccttaagggtcgacgtaattacggaaaacgtacgttggtaacgtcttacgacctaacgngttcttacgg

SEQ ID NO: 236842 - DNA, 576 bp, Homo sapiens
  misc_feature: GYAE6OF01EUBSG.45.15.B04.1.454.CMB.1.raw
  modified_base (385)..(385): a, c, t, g, unknown or other
  misc_feature (385)..(385): n is a, c, g, or t
  modified_base (415)..(415): a, c, t, g, unknown or other
  misc_feature (415)..(415): n is a, c, g, or t
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagtagttttttaccggcccaatagtaagaactactagcttgtaccagacagaagccgaggcagcctctagcctgctctttacgcggtcctcgtacccgggagtcccgggtccctcgaccgtattcgagtggcgagccgggtcgtgggcagtatttccactcnctaccatcagcacgcctgcagcctagaagntcgtacctctacgtttactactgtacagactaattattagtgtaagtacttccctcgtaccgtacgtttaccgggaccggtaacgggaacccgtaagggttcgacgtaacgtaaccgaaaacgtacgttaggtaccggtactagaccctaccgtgttaccg

SEQ ID NO: 236843 - DNA, 594 bp, Homo sapiens
  misc_feature: GYAE6OF01CRSNK.45.15.B04.1.454.CMB.1.raw
  modified_base (315)..(315): a, c, t, g, unknown or other
  misc_feature (315)..(315): n is a, c, g, or t
  modified_base (352)..(352): a, c, t, g, unknown or other
  misc_feature (352)..(352): n is a, c, g, or t
tcagacgcgatcgacacgaccggtgctcgatttagacagtatatatccgcgggggagctacaacaggcaggcaggggcagcaagatggtgttgcagacccaggtcttcatttctctgttgctctggatctctggtgccgtacggggacatcgtgatgacccagtctccagactccctgactgtgtctctggggcgaggacgggccaccatcaactgcaggtccagccagagttgtttttacggccccaatagtaagtaactacttagcttggtaccagcagaagccgagggcagcctcctagcctgctctttacngggtcctcgtacccgggacgtccgggtcctcgacgtntcgagtggcaggcgggtgtcgggctagctttcacgttctacacatcagctagcctgcagacctagagtactcgtaccgagtacgtttacctactagtaccaagtactaagttagttaagtggaacgttactttccctaccttaccgttaccgtttacggggaccgggtacgggaacccgtaaagggttcgaacgtaacgtaccgtaaaacgaccggttggacggtactacggcctacgtacg

SEQ ID NO: 236844 - DNA, 678 bp, Homo sapiens
  misc_feature: GYAE6OF01C8R37.45.15.B04.1.454.CMB.1.raw
  modified_base (215)..(215): a, c, t, g, unknown or other
  misc_feature (215)..(215): n is a, c, g, or t
tcagacgcgatcgacacgaccggtgctcgatttagacagtatatatccgcgggggagtctccctcactgcccagctgggatctcagggcttcattttctgtccctccaccatcatggggtcaacgccatcatcgccctctcctggctgttctccaaggagtctgtgccgaggtgcagctggtgcagtctggagcagaggtgagaaacgcccgggnagtctctgattactctctaggtaaggattcgtggaataactaactttaacgacactggactcgccgtgggtcgcgaccagagtcggacccgggaaaaggccgttaggaaaacgttcggtagggacatactagttctaacgtccgttaggtacgtacctcgtagaactaaccaggtaactaccgtacgtttccccgttacccgttaaccggaacgggtcccgaacggttacccaacctaacgttccgtaccgtaacggttacccgaaaccgtaacgttaccctaacgtaacccaaacccgacccgtaccctaccgcgtaccgaggtaccgaccgaaccgtccgtaacggaaccggtccctacccgaagccgtaccgtaccttaatttactacgtcgttagacggtaacgacggtccgaccgagtaccctaattcggttaggtaccgtccgttcgtccgttacgg

SEQ ID NO: 236845 - DNA, 517 bp, Homo sapiens
  misc_feature: GYAE6OF01BAGS3.45.15.B04.1.454.CMB.1.raw
  modified_base (356)..(356): a, c, t, g, unknown or other
  misc_feature (356)..(356): n is a, c, g, or t
  modified_base (382)..(382): a, c, t, g, unknown or other
  misc_feature (382)..(382): n is a, c, g, or t
  modified_base (405)..(405): a, c, t, g, unknown or other
  misc_feature (405)..(405): n is a, c, g, or t
  modified_base (414)..(414): a, c, t, g, unknown or other
  misc_feature (414)..(414): n is a, c, g, or t
  modified_base (448)..(448): a, c, t, g, unknown or other
  misc_feature (448)..(448): n is a, c, g, or t
  modified_base (468)..(468): a, c, t, g, unknown or other
  misc_feature (468)..(468): n is a, c, g, or t
tcagacgcgatcgacacgaccggtgctcgatttagacagtatatatccgcgggggagtctccctcactgcccagctgggatctcagggcttcattttctgtcctccaccatcatggggtcaaccgccatcatcgccctcctcctggctgttctccaaggagtctgtgccgaggtgcagctggtgcagtctggagcagaggtgagaaagcccgggcagtctctgatactctcctgtaaggattctaggatacaactttaacgaccactggatcgctgggtgcgccagatcggacccgggaaagccgtaggaatcggtggcagtcatctatcctggtcgactctgactaccagatacngtccgtctcgaagccaggtcacatcncagtcacaacgtcatcaacaccncctacgtcncagtcgaaccagcctacggacgcccgtaccgacncgccgactatttactactgngacgagtaagtccgaccagacctaacttgttcggtgtccctgtcctcgg

SEQ ID NO: 236846 - DNA, 679 bp, Homo sapiens
  misc_feature: GYAE6OF01DQHB6.45.15.B04.1.454.CMB.1.raw
  modified_base (418)..(418): a, c, t, g, unknown or other
  misc_feature (418)..(418): n is a, c, g, or t
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctcgtgggcgaggagggccaccatcaactgcaggtccagccagtagttgttttaccggccccaatagtaagaactacttagcttggtaccagcagaagcagggcagcctcctagcctgtctcttttacgcgggtcctcgtacccgggaggtcccgggtccgtcgaccgtattcgagtcggacgaggtccgggtacgtcggggctacggtacttttccacgttcctccgaacctntaccacgcaacgtcccgtacgccgtaacggcccttaggaacgtactacggttccgacgtttaacgttttacccgttaacttcggttacctacggaacttaacgttaacgtttaagtcggtaaagttcctttacccgtcgttaccgttaccggtttacggggaccgggtaaacggggtacccgtaaagggtttcggaccggttaaacgtaaccgtaaaaccggtaaccgttcggtacgggtaccttcgggctaacccgtacg

SEQ ID NO: 236847 - DNA, 611 bp, Homo sapiens
  misc_feature: GYAE6OF01CDXJQ.45.15.B04.1.454.CMB.1.raw
  modified_base (255)..(255): a, c, t, g, unknown or other
  misc_feature (255)..(255): n is a, c, g, or t
  modified_base (556)..(556): a, c, t, g, unknown or other
  misc_feature (556)..(556): n is a, c, g, or t
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagacctccctgactgtgtctcgtgggcgagagggccaccatcaactgcaggtccagccagtagttcgttttaccggcccaatagtaanaactacttagcttggtaccagcagaacgccgagggcacgcctcctagcctgtcttctttacgcggcctcgtacccgggacgtcccggggtcctcgaccgtatcgagcggcaggcgggtcgtgggctaggtcttcactctaccacatccgagtccacggtccctcgcaacgtcctaggaaggtactggtcctacgttacgtttacacgtgtaccaagtactaaattagttagtcgaacttacctttccctacgttaccgttaccggttcggaccggggtacgggtaacccgtaaggggttanaaccggtaagtacccgaaaaaccggtcttcgggcgtaccgacgtcctaacgtccg

SEQ ID NO: 236848 - DNA, 835 bp, Homo sapiens
  misc_feature: GYAE6OF01DYOPE.45.15.B04.1.454.CMB.1.raw
  modified_base (164)..(164): a, c, t, g, unknown or other
  misc_feature (164)..(164): n is a, c, g, or t
tcagacgcgatcgacacgaccggtgctcgatttagacagtatatagtccggcgggggagtactccctcactgcccagctgggatctcagggcttcattttctgtcctccaccatcatggggtcaaccgccatcatcgccctcctccgtggctgttcaccaaggngtctgtcgccggaggtgcgagtcgttggtcgctaggtccgtggacgcgaggacggtacggaacggaaaccggcccggggctaacggttcctacgtaggtacttaccgtccgttaccgttaggtaacggtactttcgtaggtaacttaaccgtaaccgtttaaaccgaccgtacgtacggtaactccggccggttgggtacgcccggaccgtaacggtaccggttaccgggaacccggggtaaacggtacccggtaagggtaaacggttccgggtacgggactacgttaccgaaccgttaccgtaaccgttcgtacggttacgtaactcgtaggtaactaacgtacgtaacgtccgtaccgttccgtaccgttacgaacgtccgacggtcactcgtgacgacgtacgaactacgtacctaacgtaccgaacccgaccgtaccctaaccgtacggaccggtacggtacggacccgacggtaccggtaacggtaaccggcccgtacccggaaccggtaccgtaacccgttaccctttaacgtttaaccgggttactaccgggtaagtaacccggtacggttaaacccggtcccgtaaccgttaaccggtaaccggtttacgttacgggttcgggttaacccggttcccggttaaccgtcccgggttaaaccggg

SEQ ID NO: 236849 - DNA, 773 bp, Homo sapiens
  misc_feature: GYAE6OF01A6OT9.45.15.B04.1.454.CMB.1.raw
tcagacgcgatcgacacgaccggtgctcgatttagacagtatatatccgcggggacaacaggcaggcaggggcagcaagatggtgttgcagacccaggtcttcatttctctgttgctctggatctctggtgccgtacggggacatcgtgatgacccagtctccagacctccctgactgtgtctctgggcgaggacgggccaccactacaacgtgcacggtccacgccgaagtagttacggttttttaccggcccctaaagtaagtaaacgaacttacttagtacgttacggtaccagacaagaacgccgaggcacgccctaccgtacgccgttcgtcttacgtttacgcggtccctccggtaacccgggtacggttcccgggtcccctacggtaccgattacgacggtcggtaccgacggtccggggtcgtacggggaccgtaagtacgtttcgacctccgtacctaccgacgtccgacgtaccgtacggcccttgggcccctagtaccccgttaaggaaacggtcgttaccggtacccggttacgtttaaacgttttaccgtaacccgttgtaccgaacgtaaccttaaattttaaggttaacgttacggaaccgtttacctttcccgtaccttacccggtttacgggttaaccccgggaaggggtaccggtaaccggttaacgggttacgtcccggtaaataaccccgggtaaaacgtacggttgggacccggttcgtaccggtaaccctaacccgtcgtttcggttaccg

SEQ ID NO: 236850 - DNA, 853 bp, Homo sapiens
  misc_feature: GYAE6OF01DLV2P.45.15.B04.1.454.CMB.1.raw
  modified_base (161)..(161): a, c, t, g, unknown or other
  misc_feature (161)..(161): n is a, c, g, or t
  modified_base (221)..(221): a, c, t, g, unknown or other
  misc_feature (221)..(221): n is a, c, g, or t
tcagacgcgatcgacacgaccggtgctcgatttagacagtatatatccgcgggggagtctccctcactgcccagctgggatctcagggcttcattttctgtcctccaccatcagtggggtcaaccgccatcatcgccctcctcctggctgttctccaaggngtctgtgccgaggtgcagctggtgcagtctggagcgaggaggtgaagaaacggcccgggnagtctctagactaccgttctacgtaggtaaggtacttcgtaggtaacttaacctaaaccgttttaaccgaacccgtacgtagggtactccggtccggtgggtcgccgaccaggtacggtccgggacccggggtaaacgccggtaagggtaaacgttcgggtagggacctaacgtactacttccgttaacgttccggttagggttaccgtaaccgttccgttaacggaacttaaacccgtaacggtaacgttaacccgtaccgggtttacccccgtttaccccgtttaacccggaaaccgggtccccggtaaccggttaccctaacccgttaacgttcccgtaccggttaaccggttaacccgaaaccgtaaaccggttacccctaaccgttaaacccgaaccccaacccccgttcccgtaaacccgtcggtaaccgtaaccgggtaaccggaacccgaaccgggtaccccgttaacgggaacccgggtacccccgtaaccggaacccgtaccggtacccgttacctttaaagtttttaaccgtcgtacgggtacgtaacggaaccggtacgtcccgtaccgacgtacccttaagttacgtttcggtacccggttcccttaggtccgttacgg

SEQ ID NO: 236851 - DNA, 710 bp, Homo sapiens
  misc_feature: GYAE6OF01D7T28.45.15.B04.1.454.CMB.1.raw
  modified_base (672)..(672): a, c, t, g, unknown or other
  misc_feature (672)..(672): n is a, c, g, or t
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacgggacatcgtgatcgacccagtctccagacctccctgactgtcgtctcgtgggcgaggacgggccaaccgactacaacgtcgacgtacggtccacgaccgaaggtacggtttacggttttttacccggacccctaaagtaacggtaaacgtaacttaacgttacgtccgttacggtacccaagacaacggaacgaccgacgggaccacggtaccctccgtacgtcctcgtcctttacgttttaccgtccggtaccgttacccggtaacccggggtaccggttccccggggtaccccgttcggtaacccgtacgtttacgacggttcggaccgtacgggtcggggtcggtccgggggactacgtttacgtttcctaccttccgtaccgtacctatacccgaacgtacgtaccgcgtcgccccccgtagccgtagaacgtacgtcgtacgtacttacgttacctactcgacagtactaagttatagtagtacgtacttcgtctacgtgtaccgggacggacggtacgtaggtnacggtacaacgaagtacgtacgtacgatacgctactcg

SEQ ID NO: 236852 - DNA, 672 bp, Homo sapiens
  misc_feature: GYAE6OF01B349F.45.15.B04.1.454.CMB.1.raw
  modified_base (664)..(664): a, c, t, g, unknown or other
  misc_feature (664)..(664): n is a, c, g, or t
tcagacgcgatcgacacgaccggtgctcgatttagacagtatatatccgcgggggagctacaacaggcaggcaggggcagcaagatggtgttgcagacccaggtcttcatttctctgttgctctggatctctggtgccgtacggggacatcgtgatcgacccagtctccagactccctgactgtgtctcgtgggcgaggacgggccaccatcaactgcacggtccagccagtagttcgttttaccggaccctaagtacgtaactaacgttacttacgtcgttcggtaaccagacgaagaacgccgagggcacgtcctccgtacgcctcgtccttcgttttacgcggtcctaccggtacccgggtcggttcccgggtcctcggtaccgtacttcgacggtcggacgtacgggcgggtcggtggggactacggttacttccgacgttcacctacacttcgaacggcacggtcccgtgaccgtacggtacccgtaggaaacgttcgtacggtcgtacgtttaacgtttactctggtaacacgacttaattacgttagtagtaacgttctttcccgtacgttaccgttacggttacgggccggaacgggtaaccggttagggtacgacgtaacgaaacgtaaacgtacgttcggtcgactaccgtacncgttaccg

SEQ ID NO: 236853 - DNA, 853 bp, Homo sapiens
  misc_feature: GYAE6OF01B1E9I.45.15.B04.1.454.CMB.1.raw
tcagacgcgatcgacacgaccggtgctcgatttagacagtatatatccgcggggacaacaggcaggcaggggcagcaagatggtgttgcagacccaggtcttcatttctctgttgctctggatctctggtgccgtacggggacatcgtgatcgaccagtctccagacctcccgtggctgtcgtctcgtgggcgaggacgggccaccataccaacgtgacacgtccacgccaggtagttgtttagacagctaccaaacaataacgaaccttacgtacgtacgtttacggaccaacgacgaaacgtaaaccgacgggttacaccggtacccttaccgtaacgtccgtacgtaccttacgttaacgtttacggtacggtacctacgtaccccggttaaccccggggtaaccggttccccggggtaccctacggtacccgtacgtccggtaggtacggacgtacgggtccgggtacgtacggggtaactacggttactttacccgaccgttaccgtaccgtacccttaacgaccgtaaccggtaccgtaacccgggtcccgtacgggtaaccgggtacgggttaaccgtaagggtaaacggtttcgggtttacggtacgggttaaccggttttaaggttttaccggtccgtttaccggtacggttaacgtaccggttaaacttttaaatttaaacggtttttaactttaaccgtttacccctttacccggttacccggttaacggtttacccccgggtaccggttaaaccgggaaacccgttaaaggtaccgggttaaacttaaccggaaacccgttaacgtaacggttcggtaacgtcctaacggtacccttaacg

SEQ ID NO: 236854 - DNA, 697 bp, Homo sapiens
  misc_feature: GYAE6OF01DA26F.45.15.B04.1.454.CMB.1.raw
  modified_base (636)..(636): a, c, t, g, unknown or other
  misc_feature (636)..(636): n is a, c, g, or t
tcagacgcgatcgacacgaccggtgctcgatttagacagtatatatccgcgggggagctacaacaggcaggcaggggcagcaagatggtgttgcagacacaggtcttcatttctctgttgctctggatctctggtgccgtacggggacatcgtgatgacccagtctccagactccctgactgtgtctcgtgggcgaggacgggccaccatcaactgcacggtccagccaaggtagttacggtttttaccggaccctaaataacgtaaagtaacttacttaggtcttacggtaccagacaagaacgaccgagggtcacgcctcctacgcctgccttcgttttacgcgggtcctccgtacccgggacgtcccgggtccctgtaccgtacttcgaggtcggcgacggtcggtcgtggggcagtcttcgactcgactaccatacagtccgagtcccgtagctacgtacctaggtaacgtacgtcggtacccgtacgttaacggttttaaccacggttcgtaccgtaaagtaccttaaatttaacgtttaacggtagggttaacttaccgtttaccccgtacttaacccgttacgggttacccggggaaggggtaaacccgggtaaccggttaacgggttnaacccgggtaaaataccccgtaaaaacggtcggttaggtccgggacctagtccctaaaccg

SEQ ID NO: 236855 - DNA, 780 bp, Homo sapiens
  misc_feature: GYAE6OF01ALSQ3.45.15.B04.1.454.CMB.1.raw
  modified_base (747)..(747): a, c, t, g, unknown or other
  misc_feature (747)..(747): n is a, c, g, or t
  modified_base (770)..(770): a, c, t, g, unknown or other
  misc_feature (770)..(770): n is a, c, g, or t
tcagacgcgatcgacacgaccggtgctcgatttagacagtatatatccgcgggggagtcgtccctcactgcccacgctgggatctcaggcttcattttctgtcctccaccatcatgggtcaaccgcatcatcgcctcctcctgctgttactcgagacgtctgtgtccgaggtgcagctggtgccgaggtcctggagcgaggaggtgaaggaaaacggcccgggtcacggttcctacgttacggacttaacctccgttcccgttaggtaaaacgggttcttacgtacgggtaacttaaaccgttaaaccgttttaaaccggaacccgtaccttaggggtaactccggtacccgttaggggtcggaacccggccttaaaggcgttacgggaaccccggggaaacggtcccggttaagggtaaaacgtcccggggttaggaaccgtacgttacggacgttaccttaaccggtcccgttaggggtaactaaccgtcgtacgtaaacgtaacccgtagaaaccgttaaccggtcgtttaccccgggccctttaacccggaaacgggtacccgtaccgggtttacaacccccgttagtaccttaccggtaacgtacgtaaccccgaaaggtaccccattaccccgaacgtacccgtcccgtaacgtcgatacgggtacgaaccgtgtacccaacggtacggccctaaccgacgtacgcccggtattaagttactgacgtgaacgcgtacgtcncccgagcctaggttatcggtacncgttgtcgcg

SEQ ID NO: 236856 - DNA, 847 bp, Homo sapiens
  misc_feature: GYAE6OF01AZIHC.45.15.B04.1.454.CMB.1.raw
  modified_base (641)..(641): a, c, t, g, unknown or other
  misc_feature (641)..(641): n is a, c, g, or t
tcagacgcgatcgacacgaccggtgctcgatttagacagtatatatccgcgggggagctacaacaggcaggcaggggcagcaagatggtgttgcagacccaggtcttcatttctctgttgctctggatctctggtcgccgtacgggacatcgtgagtcgaccagtctccagacctcctgactgtcgtctcgtcgggcgaggacggaccaccataccaacgtcgacgacggtaccgacgtccgaaggttacggtttacgtttttaaccgacctaataacgtaacgtaacttacgtacgtacgttacggtaacacgtacgaagacgacgacggacaccgtccgtaccgtacgtcctcgtaccgtttcgtttacggtccgggtacctccgggtaccgggtaccgggtccccgggttaccctacggtacccgttagtaccggtacggtacggaccggtacgggtccgggtacgggtaccgggtacttacggttaaccgtttccgtaaacgttccctaaccaaccgttacgtaccgtaaccgtacggtaaccgtcccggtaccgtacccgaaggtacccgttaagggaacgttaccggttacggttacccggtaaactttaccgggtttaaactttacccggggtnttaacccgtaaacgttaacctaagttaacgtttacggtaaccgtacgttttaccctacccgttaacgtaccccggtttacgggttaacggggaaccgggttaacggttacccggttaacggtacgaccggttaaaacgtaaccccggttaaaaggttcggttaacccgttccggaacggttttcccgaaccgttaacgttacccgg

SEQ ID NO: 236857 - DNA, 832 bp, Homo sapiens
  misc_feature: GYAE6OF01C4BSG.45.15.B04.1.454.CMB.1.raw
  modified_base (226)..(226): a, c, t, g, unknown or other
  misc_feature (226)..(226): n is a, c, g, or t
tcagacgcgatcgacacgaccggtgctcgatttagacagtatatatccgcgggggagctacaacaggcaggcaggggcagcaagatggtgttgcagacccaggtcttcatttctctgttgctctggatctctggtgccgtacgggacatcgtgatcgacccagtctccagacctccctgactgtgtctcgtgggcgaggcgggccacactacaagtccccccccgngacggtccacgccgagttacggttttacggtttttacccggacccctaaagttaacgtaaacggtaaccttacgttaggtcctttacgggtaaccaggaccaaggaacgccgaagggcacggtcccctcctaacgcctacgtctttacgttttacggtcgggacccttaccggtaccccggggtacggtcccgggtccctacggtacgtacgttccgaggtcggacgacgggtcggtcggtgggcctaggtactttacacgtcctaccgacctactacgacgactacgtcccgtacgtcgacgtccgtaaagaaccgtgttaccggttacgaccgtttaaacgttttaccgtaccgttcggttaccgtaaacgtaccttaaatttacgtttaacgtaacgggtaactttcccttttaccccgttacgttcccggtttaacccggggttttaacccgggccggggtttaaaccggggtaaacccggtttaacgggggttaacgttaccccgggtaaaacctttaaaaccccggggtaaaacgttcccggggtttaacgggttacccggacccggttaaccgtaccccgtaaccgttttaaacccggg

SEQ ID NO: 236858 - DNA, 614 bp, Homo sapiens
  misc_feature: GYAE6OF01DOF58.45.15.B04.1.454.CMB.1.raw
  modified_base (339)..(339): a, c, t, g, unknown or other
  misc_feature (339)..(339): n is a, c, g, or t
  modified_base (478)..(478): a, c, t, g, unknown or other
  misc_feature (478)..(478): n is a, c, g, or t
tcagacgcgatcgacacgaccggtgctcgatttagacagtatatatccgcggggacaacaggcaggcaggggcagcaagatggtgttgcagacccaggtcttcatttctctgttgctctggatctctggtgcctacgggacatcgtgatgacccagtctccagactccctgactgtgtctcgtgggcgagacggccaccgatcaacgtgcgagtccagccagtaggttgttttagacagctaccaaataataaacgaacttacgtagtcgttaggtaaccaggacaaacgaaacctaggtacacgtaccctaccgtaagctcgacctactactttacgnggactacgtaccgtacccggaagtcccgggtacctggaccgtatcgaggtcgcaggcggtgtcggatagtacttaccactctaccacactcgacgcacgcctagcgacgacgtgaagtatcggtgtattacgtttactntacgtacaacgtactaatttactagttgaagttcgttacctccgttacgtaccggtttcgggaccgggtaacgggtaacgtaacggttggaccgtaacgtaaccgtaaaccgtaagtgtacggccgttcgaacccg

SEQ ID NO: 236859 - DNA, 783 bp, Homo sapiens
  misc_feature: GYAE6OF01C2M3K.45.15.B04.1.454.CMB.1.raw
  modified_base (409)..(409): a, c, t, g, unknown or other
  misc_feature (409)..(409): n is a, c, g, or t
  modified_base (445)..(445): a, c, t, g, unknown or other
  misc_feature (445)..(445): n is a, c, g, or t
  modified_base (507)..(507): a, c, t, g, unknown or other
  misc_feature (507)..(507): n is a, c, g, or t
tcagacgcgatcgacacgaccggtgctcgatttagacagtatatatccgcgggggagtctccctcactgcccagctgggatctcagggtcttctattttctgtccctccaccatcagtggggtccaaccgccatcatccgcccctcctccgtggcttcgttcctaccgaaggtacgtctggtcggccggaggtgccaggtcgtggtgctaggtcgtagggacacgaggagggagaacggaaacgggcccgggatacgttcctctagtacttacctcgtaccgttaggtaagttacgttggtacgtaacttaaccttaaaccgtttaaccgacctggtggtacctcggtcggttgggcacgtaccgaagccggacgggaacccgggaagtccggtaagtaacggttcggnggacacgtctactctacgtcggtggtactacagtancctaacgagtacgacgttccgtcccgttaccgtaacgaccggtacctacggtacctaccgtnttaccgccgtaacgaaccgtaacaacgttaccaacgtaacccaacccgttacccacctacgtcgggaactacggtaccgaaccgacggttacccgaacggggaccctacccgggtaccgaacggtacccgttacctaacgtttaaccgttttacggacccgttccgggtaaacggttacgggaaacccggtaccgtacccgtcggaaaccgtttaacccggttagttttaccgggttccggttccgggtttaaccctggggtacccgtttttacgg

SEQ ID NO: 236860 - DNA, 760 bp, Homo sapiens
  misc_feature: GYAE6OF01CT6IA.45.15.B04.1.454.CMB.1.raw
  modified_base (189)..(189): a, c, t, g, unknown or other
  misc_feature (189)..(189): n is a, c, g, or t
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
tcagacgcgatcgacacgaccggtgctcgatttagacagtatatatccgcgggggagtctccctcactgcccagctgggatctcagggcttcatttttctgtcctccaccatcatggggtcaaccgcatcatcgccctcctcctggctgttctcaaggagtctgtgccgaggtgcagctggtgcagtcnggngcaggaggtgagaaacggcccgggnagtctcgtgatactctccgtagtagtnttntgactataactttaacaccacgtgatcgcgtggtgcgcagactcggacccgggaaaggccgtaggaaacgtcgggtgggactacgtctaacttaccgttaacgttcccgtgggttacgtaccgttcgttacgaacgtttaacccgaaagttaactaaccggtaaccggttacccccgtttacccgttaaccccgaaacggggtacccctaacgggtccctaaacccgtaacttccctaccgaacggttacccgaaacctaacggttaacccaaacttaccccgaaaccgtaacccccgtaaccccgttaccgtacggtacccgtacggtaccgggaaaccccgtaacgggacccgtacgggaaccccgtacccgtacccgggacgacccgaacccggttcctttaaagtttacccgttaggttcggacggtaaccggtaggaacccgttaccggaccgaccgtaccgtttaaggtacgttttcgggtacggttccgttccggtccttaccggg

SEQ ID NO: 236861 - DNA, 696 bp, Homo sapiens
  misc_feature: GYAE6OF01CXKOJ.45.15.B04.1.454.CMB.1.raw
  modified_base (427)..(427): a, c, t, g, unknown or other
  misc_feature (427)..(427): n is a, c, g, or t
  modified_base (444)..(444): a, c, t, g, unknown or other
  misc_feature (444)..(444): n is a, c, g, or t
  modified_base (459)..(459): a, c, t, g, unknown or other
  misc_feature (459)..(459): n is a, c, g, or t
tcagacgcgatcgacacgaccggtgctcgatttagacagtatatatccgcgggggagctacaacaggcaggcaggggcagcaagatggtgttgcagacccaggtcttcactttctcttgttcgctctggatctcgtggtcgccgtacgggacagtcgtgatcgaccctacgtcgtccacgcctccgtgacgtgtcgtcgtcgtgggacgaggacggaccacacgtacaacgtcgacgacggccagtaccgaggttagtttcggttttaaccggaccctaagtaacgtaacgtaacttacgttagcttacggtacagacgagaacgcgacggcacgtcctactacgcctgtcttacgtttcgcggtcctaccggtaccgggtcggtcccggtcctacgacgtctcgaggtcgcgtacggcggttcggngggtactacgtcttacnccgtacctacacgtntacgacgtccgtagccctaggacccctagtaccgtaaagtaccgttacggttccgaaccggttaacttccggtttaaccgcgtttaccggaactaacggtaacttaaggtttatacgtcgtaaccttaccgttcctagtttaccggtaacggttacgggaccgggtacgtaaccgttagggtcgaaaccgtcgtaaaccggaagtcggttacgtcgactacggcctaaacgtttcgg

SEQ ID NO: 236862 - DNA, 719 bp, Homo sapiens
  misc_feature: GYAE6OF01EPO6C.45.15.B04.1.454.CMB.1.raw
  modified_base (136)..(136): a, c, t, g, unknown or other
  misc_feature (136)..(136): n is a, c, g, or t
  modified_base (478)..(478): a, c, t, g, unknown or other
  misc_feature (478)..(478): n is a, c, g, or t
  modified_base (493)..(493): a, c, t, g, unknown or other
  misc_feature (493)..(493): n is a, c, g, or t
  modified_base (553)..(553): a, c, t, g, unknown or other
  misc_feature (553)..(553): n is a, c, g, or t
tcagacgcgatcgacacgaccggtgctcgatttagacagtatatatccgcgggggagctacaacaggcaggcaggggcagcaagatggtgttgcagacccaggtcttcatttctctgttgctctggatctctggtnccgtacgggacatcgtgatcgacccagtcctaccacgtacctccctgacgttgtcgtctcgtgggacgaggaccgggaccacctataccaacgtcgacgacggtccacggccaggttacggtttaccgtttttaccggacccctaaagttaacggtaaacgtaacttacgttacgtcgttacggtaaccacgacgaacgaacgtcgacggcacgtccctccgtacgtccgtcgtacgtttcctttaccggcggtcccttacgggtacccgggtcgtcccgggtcctacgacgttcttcgagtcggcgcggtcgggtcgtcggggactacgttacgtcctacncgtacgactactcgngtaccgacgtctcgactacgtcgaaggtaactggtacgtaccggtacttaacggtttacncgtttacacgtaactacgtaatttacggttacagttaacctttcctcgttacccgttacgttacggttacccgggggaacggtaaccgggttacgttaacggggtcaaaccggttaactaaacccgtacgtaggttccggacggtccaaccggtctaacgttaccg

SEQ ID NO: 236863 - DNA, 402 bp, Homo sapiens
  misc_feature: GYAE6OF01DJCD1.45.15.B04.1.454.CMB.1.raw
  modified_base (190)..(190): a, c, t, g, unknown or other
  misc_feature (190)..(190): n is a, c, g, or t
  modified_base (216)..(216): a, c, t, g, unknown or other
  misc_feature (216)..(216): n is a, c, g, or t
  modified_base (327)..(402): a, c, t, g, unknown or other
  misc_feature (327)..(402): n is a, c, g, or t
tcagacgcgatcgacacgaccggtgctcgatttagacagtatatatccgcgggggacaacaggcaggcaggggcagcaagatggtgttgcagacccaggtcttcatttctctgttgctctggatctctggtgcctacggggacatcgtgatcgacccctagtcaccgagacctccctgactgtgtctcgngggcgaggacgggcccacatacaacncggactacgaccgagccctaagtcggttttacggtttttacccggaccccctaaaagttaacgtaaacgtaaacttaacctttaggtaccgtttcgggaaccaacggaaannnnnnnnnnnnnnnnnnnnnnnnnnnnnnnnnnnnnnnnnnnnnnnnnnnnnnnnnnnnnnnnnnnnnnnnnnnn

SEQ ID NO: 236864 - DNA, 716 bp, Homo sapiens
  misc_feature: GYAE6OF01BBFM5.45.15.B04.1.454.CMB.1.raw
  modified_base (195)..(195): a, c, t, g, unknown or other
  misc_feature (195)..(195): n is a, c, g, or t
  modified_base (246)..(246): a, c, t, g, unknown or other
  misc_feature (246)..(246): n is a, c, g, or t
  modified_base (364)..(364): a, c, t, g, unknown or other
  misc_feature (364)..(364): n is a, c, g, or t
  modified_base (449)..(449): a, c, t, g, unknown or other
  misc_feature (449)..(449): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
tcagacgcgatcgacacgaccggtgctcgatttagacagtatatatccgcgggggagtctccctcactgcccagctgggatctcagggcttctatttttctgtcctccaccatcagtggggtcaaccgcatcatccgccctcctcctggcttgttctaccaaggagtctgtcggccgaggtgcagtcgtgggtcncaggtcgtggagcgaagggtagggtaggaaaggaaaccgggccccggggtntacggtttcctcgttagtacttaccttccgtccgttaagggtaaaggtctttcgaggtaacttaaccgttaaaccgtttaaccgacctaaggttcggacctccggtacggtggggtcnccgaccgtagcggtccgggaaccggaaacggtgtaggtaacgtcgggtacggctactagtactctacgtccgttggactctgtanacgactagtacgtacgcgtacccgtctaacggagcgtacgtaccactntaccgngtacgtaccaacgtactactacaccaaccgtaccctaccgtacgtacgacgtacgggtccgaacgaccggtccgtacgggacccgtccggtaccgtaaccgagtacccggttacttaccggtttactacggttacggacgaccgttaacgaccgtaccggcctaaaccgggctttaaagtcggttccgttcggttaccgccgtgggtttaccg

SEQ ID NO: 236865 - DNA, 805 bp, Homo sapiens
  misc_feature: GYAE6OF01CFAVU.45.15.B04.1.454.CMB.1.raw
  modified_base (190)..(190): a, c, t, g, unknown or other
  misc_feature (190)..(190): n is a, c, g, or t
  modified_base (628)..(628): a, c, t, g, unknown or other
  misc_feature (628)..(628): n is a, c, g, or t
tcagacgcgatcgacacgaccggtgctcgatttagacagtatatatccgcgggggagctacaacaggcaggcaggggcagcaagatggtgttgcagacccaggtcttcatttctctgttgctctggatctctggtgccgtacggggacagtcgtgatgacccagtctcagactccctggctgtgtctcgnggcgagacggccaccgatcaactcgacacgtccagccgagtagttgtttacgacgtacgctaaccaaactaataacgtaacctagttacgtcgttacgtacagtacgaagtaaaccgacggtacacggtaccctacgtaacggtctacggtaccttactaaacgttttaccgcggaacttaaccgtaccccgggttaaaacccggtaccggttccccggggtacccgtacggaaaccgttacgttaccggacgtaccgggtacggtaaccggtcgggtacggtaaacccgaaggttaaccgttccttacccggttaaccaccccgtaccggtaaacctttacccgaaccggtttaaacgcccggttaaacggtccccggttaaaagccggtaaaccgggtttacgaaaggtaaacgtacggttccgggttaaccgttnttttaaacgggtcgtttaccgaagttaccccgtagggaaaccttagtttaaactttattaaccgtttacgttccctttaccgtacgggttcccgttaaccggtaccggaaacggtaaacggttacgacgtaaacctacccggaaacgttaaacgtccccgtttaagcgtactaaccg

SEQ ID NO: 236866 - DNA, 683 bp, Homo sapiens
  misc_feature: GYAE6OF01B1MV6.45.15.B04.1.454.CMB.1.raw
tcagacgcgatcgacacgaccggtgctcgatttagacagtatatatccgcgggggagctacaacaggcaggcagggcagcaagatggtgttgcagacccaggtcttcatttctctgttgctctggatctctggtcgccgtacgggacatcgtgatcgacccacgtctccacgacctccctgactgtcgtctcgtggcgagacggccacatacacgtgacacggtccgagaccgtagtacgtttacgtttttaccggaccctaagtagtaacgtaacttacttacgtcgttacggtaccagacgaagacgaccgaggaccacgtccctacgtacgccttacgtccttacgttttaccggccggtccttaccggtacccgggacgggttcccggtccgtacggtaccgtacgttcgaggtacgcgtacggacgggtcgagggtacagttacgtttaccgacgtcaccgtactactacgcgacgtacgtcctcgcctacgtcgtagtaacgtcgttcgtacgcgtttaactttaccgacgttagactacgtaaactaattactaacgtgtacttaccttccgttacgttaccgtaccggtttacgggaccggttaaggaaccggttaggtacctacggtaaactaaaccgtacgtacggtacggtcgaccgtcgtaacctacgtcg

SEQ ID NO: 236867 - DNA, 874 bp, Homo sapiens
  misc_feature: GYAE6OF01BOPU6.45.15.B04.1.454.CMB.1.raw
  modified_base (129)..(129): a, c, t, g, unknown or other
  misc_feature (129)..(129): n is a, c, g, or t
  modified_base (728)..(728): a, c, t, g, unknown or other
  misc_feature (728)..(728): n is a, c, g, or t
tcagacgcgatcgacacgaccggtgctcgatttagacagtatatatccgcgggggagctacaacaggcaggcaggggcagcaagatggtgttgcagacccaggtcttcattttctctgttgctcgtggntctcgttggtcgccgtacggggactattcgtgatcgaccctacgtctccacgtacctcccgtgactgtcgttcgtcggtcgggacggacggaccggacccaaccacgtacaaccgtggaccgtacggacccgaacgtaccgttaacggtttttaaccggtttttttaaccccggaacccgttaaagttaaaacggtaaacgttaaccttaacgtttacggttaccgttacggtaaccaggtaaccgtaacggaaccgacggacgggtacctaaccggtcccttaccgtaccgtccgtttacgttccgttttaccgttttaccggtccggttaccccgttacccgggttaccccggggttaacccgggttccccgggtacccttaaccggtacccggttacgttacggtacggtcggtaacgggtaccggggtccggttgggtacgggttacgttacgttacgtttaccctaccgttacccgttacccaagtaccgttacgaccggtacccggtaccgtccgtcgaacccggtacgtaccggtaagtaccgtagtttcccgaacgtttcgttaacgtttaccgtagtcgtactacgtaanacgttttacgtagtaccggttacttccgttacctaccgttacgttcccgggtagggaccggttaaacggtaccgttggaacccgttagaacgtaaccggtaacgttcgtaacgggttccacgttaccaaccgttccgttacggtcg

SEQ ID NO: 236868 - DNA, 773 bp, Homo sapiens
  misc_feature: GYAE6OF01A52HQ.45.15.B04.1.454.CMB.1.raw
  modified_base (128)..(128): a, c, t, g, unknown or other
  misc_feature (128)..(128): n is a, c, g, or t
  modified_base (752)..(752): a, c, t, g, unknown or other
  misc_feature (752)..(752): n is a, c, g, or t
tcagacgcgatcgacacgaccggtgctcgatttagacagtatatatccgcgggggagctacaacaggcaggcagggcagcagatggtgttgcagacccaggtcttacatttctctgttcgtctctggnttcgttcctgggtcgtccgttaccgggggacacgttccgtagtacgtcgtaaccacgttcctccgaacgtaccgtccctcgtacgtcgttgtccttggtcggtacggacggaaccggacccctaatacctaccgtaacgttacgcgtaccggtaccgagtaccggttaacgtttaccggttttttaccggaccccgtaattaacgtaacgttaaccgttacgtagttacggttaccgtaaccagtaacgacgaacgtccgaacggtacgcctacctccgtacgtccgtcgtaccttcgttaaccgtcgacccgttacgttaccgggtacgtcccggtacctagccgttagtccggtcgttacggccttaggggtcgtgggtcgtaacgtacgttccttacgcctttcggaacctcgttcacgtacgctacgagccgtacgctacgacgtacgtctacgtcctacgttacttacttaccggtataacgtacgtaccttagtactacgttcgtactttaccgtcgttaacgtccgttaacggtacgggtaccgttaaaggtaccgtacggtacggttacgaccggttaaacgaaaccgtttagggtcttaacccgggtccgtaaancccgggttataccgttacggg

SEQ ID NO: 236869 - DNA, 531 bp, Homo sapiens
  misc_feature: GYAE6OF02ICYFF.45.15.B04.1.454.CMB.1.raw
tcagacgcgatcgacacgaccggtgctcgatttagacagtatatatccgcgggggagctacaacaggcaggcaggggcagcaagatggtgttgcagacccaggtcttcatttctctgttgctctggatttctggtgcctacggggacatcgtgatgacccagtctccagactccctgactgtgtctctgggcgagagggccaccatcaactgcaggtccagccagagtgtttttacggccccaatagtaagaactacttagcttggtaccagcagagccagggcagcctcctagcctgctcttttactgggcctctacccgggagtccgggtccctgaccgattcagtggcagcggtctgggcagatttcactctcaccatcagcagcctgcagcctgaagatgtcgcagtttacactgtcagcaatattatgagtacttcctctctactttcgggcggtagggacccaagggtttcgacggtataccgtaaacgtaacttcggtacggccttggacctacccgattcccg

SEQ ID NO: 236870 - DNA, 495 bp, Homo sapiens
  misc_feature: GYAE6OF02GVH81.45.15.B04.1.454.CMB.1.raw
tcagacgcgatcgacacgaccggtgctcgatttagacagtatatatccgcggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagtgtttttacggccccaatagtaagaactacttagcttggtaccagcagaagccagggcagcctcctagcctgctcttttactgggcctctacccgggagtccgggtccctgaccgattcagtggcagcgggtctggggcagatttcactctcacatcagcagcctgcagcctgaagatgtcgcagtttactactgtcagcaatattatgagattcctctcactttcggcgtagggaccaaggttgcgatcaaagactgtgctgcactac

SEQ ID NO: 236871 - DNA, 540 bp, Homo sapiens
  misc_feature: GYAE6OF02H4NXM.45.15.B04.1.454.CMB.1.raw
  modified_base (318)..(318): a, c, t, g, unknown or other
  misc_feature (318)..(318): n is a, c, g, or t
tcagacgcgatcgacacgaccggtgctcgatttagacagtatatatccgcggggacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagtgtttttacggccccaatagtaagaactacttagcttggtaccagcagaagccagggcagcctctagcctgctctttactgggcctctacccgggngtccggggtccctgaccgattcagtggcagcgggtctggggcagattcactctcaccatcagcagcctgtagcctagaagatgtcgctagtttactactgtcagcaattattatgagtatttcctcttctacgtttcggcggaacgggacctagggttcgacgtaacttaccgaaaacggtactggtacggcgttacgacctacccgtattccgtgttaccc

SEQ ID NO: 236872 - DNA, 548 bp, Homo sapiens
  misc_feature: GYAE6OF02JW86S.45.15.B04.1.454.CMB.1.raw
  modified_base (308)..(308): a, c, t, g, unknown or other
  misc_feature (308)..(308): n is a, c, g, or t
  modified_base (361)..(361): a, c, t, g, unknown or other
  misc_feature (361)..(361): n is a, c, g, or t
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagtgtttttacggccccaatagtaagaactacttagcttggtaccagcagaagccagggcagcctcctagcctgctctttacngggcctcgtacccggagtccggggtcctgaccgattcagtcggcagcgggtcnggggtcagtattcactctcacatcagcagcctgctacgcctgaacgatggtcgtctagtttacctctcgtccagtacctaattattaatgaagtcttacctctacgttctttcggacgggtaggtaccgtaaggttcgacgtacgtacgaaacgtaacgttcggtaggtcctacgtccgtaccgtac

SEQ ID NO: 236873 - DNA, 668 bp, Homo sapiens
  misc_feature: GYAE6OF02JL9JJ.45.15.B04.1.454.CMB.1.raw
  modified_base (254)..(255): a, c, t, g, unknown or other
  misc_feature (254)..(255): n is a, c, g, or t
  modified_base (259)..(259): a, c, t, g, unknown or other
  misc_feature (259)..(259): n is a, c, g, or t
  modified_base (584)..(584): a, c, t, g, unknown or other
  misc_feature (584)..(584): n is a, c, g, or t
tcagacgcgatcgacacgaccggtgctcgatttagacagtatatatccgcggggagtctccctcactgcccagctgggatctcagggcttctatttctgtcctccaccatcagtgggtcaaccgccatcatcgccctcctcctggctgttctccaaggagtctgtgccgaggtgcagcgtggtgcgagtcgtggagcgaggaggtagaaggaaacggcccgggcgacgtctcgtagatactctcctgtaagtanngtcngtagtaacgttaaccgttaaccgtaaccgtaaccgtacgtacgtaccgtacggtcggtcggtccgacgacgacgacggaaccggaaccggaacggtaacggtaacggtaacggtacggtacggtacgtacgtacgtactacttacgtacgtacgtacgtacgtacgtacgtaacgtacgtaacgtacgtaccgtaccgtacccgtaccgtaccgtaaccggtaccgtaccgtaccgtacctacgtacgtacgtacgtaacgtaaccgtaacgtacctaacctaaccgaacccgtacccgtaccgtactacgtacgacgacgaccncgacgacgaccgaccgaccgacgaccgccgtacctacgttacttacgtacgtacgtacgtacgtacgtaccgtaccgacgtacg

SEQ ID NO: 236874 - DNA, 508 bp, Homo sapiens
  misc_feature: GYAE6OF02F8ZIL.45.15.B04.1.454.CMB.1.raw
  modified_base (435)..(435): a, c, t, g, unknown or other
  misc_feature (435)..(435): n is a, c, g, or t
tcagacgcgatcgacacgaccggtgctcgatttagacagtatatatccgcggggacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagtgtttttacggccccaatagtaagaactacttagcttggtaccagcagaagccagggcagcctcctagcctgctctttactgggcctctaccccggggatccggggtccctgacccgattcagtggcagcgggtctggggcagatttcactctcaccatcagcagcctgcagccctgaagatgtccgcagtttactactgtcagcaatattangatattcctctcactttcggacgagggacctaaggttgcgataccaaacgactgtggctgccacctatcttcg

SEQ ID NO: 236875 - DNA, 635 bp, Homo sapiens
  misc_feature: GYAE6OF02FF7EA.45.15.B04.1.454.CMB.1.raw
  modified_base (297)..(297): a, c, t, g, unknown or other
  misc_feature (297)..(297): n is a, c, g, or t
tcagacgcgatcgacacgaccggtgctcgatttagacagtatatatccgcggggagctacaacaggcaggcagggcagcaagatggtgttgcagacccaggtcttcatttctctgttgctctgatctctggtgcctacgggacatcgtgatgacccagtctccagactccctgactgtgtctctggcgagaggccaccatcaactgcaggtccagccagtagttcgtttttaccggccctaatagtaacgactacttagcttaggaccagcagaagccgagggcacgtccctcctancctgtcttctttacgtcgggtccctacgtacccgggtacgtcccgggtccctgaccgtattcgagtcggcaggtcgggtcgtggggctacggtacttttccgactcctacaccatcacgcacgccctcgacacgtccctaagaacgtagttcggttacgaccttaacggtttaccacgttcggtacaacggtactaaagtttacttaacgttagtaacgtttaccttcccgttacgttccgttaccggtttaccgggacgggaacgggtaccctaagggttcgaaccgtaacgtaaccgaaacgttcgtcggtacggtcctacggtacctaccgttac

SEQ ID NO: 236876 - DNA, 528 bp, Homo sapiens
  misc_feature: GYAE6OF02JJ4BD.45.15.B04.1.454.CMB.1.raw
  modified_base (307)..(307): a, c, t, g, unknown or other
  misc_feature (307)..(307): n is a, c, g, or t
  modified_base (395)..(395): a, c, t, g, unknown or other
  misc_feature (395)..(395): n is a, c, g, or t
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagtgtttttacggccccaatagtaagaactacttagcttggtaccagcagaagccaggcagcctctagcctgctcttttacngggcctctacccgggagtcccgggtcctgaccgattcagtggcagcgggtctggggcagactttcactctcaccatcagcagcctgcngcctgaagntgtcnctagtttacactgtacagcaatagttactggtactactttcgtctcgtacgtttcggacggtacggaccgtagggttcacgtataccgtaaacgacttcggtacgctacgaccactacg

SEQ ID NO: 236877 - DNA, 603 bp, Homo sapiens
  misc_feature: GYAE6OF02IQWMU.45.15.B04.1.454.CMB.1.raw
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagtagttgtttttaccggccccaatagtaagaactacttagcttggtaccagcagaagccagggcacgccctcctagcctgcttcttttacgtcgggtccctccgtaccccggggacggttcccggggtccctcggaccgtacttcaggtcggcgacggtcgggtcgtggggcagtactttcactctccaccatccgagcacgccctgccacgcctagaacgtagtcggttccgacttacgtttacctaccgttgtacgagtactaaattattagtaggtatacgtttccctcttacctacgtttccgggacggaacgggtaaccgtaagggttcgacggtactaccgaaacgtacgtcggtacgctacgacctacctac

SEQ ID NO: 236878 - DNA, 592 bp, Homo sapiens
  misc_feature: GYAE6OF02GYUCU.45.15.B04.1.454.CMB.1.raw
tcagacgcgatcgacacgaccggtgctcgatttagacagtatatatccgcgggggacaacaggcaggcaggggcagcaagatggtgttgcagacccaggtcttcatttctctgttgctctggatctctggtgcctacgggacatcgtgatgacccagtctccagactccctgactgtgtctcgtgggcgagagggccaccgatcaactgcgaggtccagccagagttcgtttttaccgcccaatagtaagaactacttagcttggtacctagacagaacgccagggcacgcctcctacgcctgtccttctttacgcgggcctcgtaccgggacgtcccgggtcctagccgtattcgaggtcggcgaggcgggtcgtgggcagtactttcactcaccacatcgacgcacgtcctgcacgtccgtagaacgactaggtcgtacgttagttttaccacttgtacacgactaacttattagtacgagttaccttacctcgtaccgttacgtttccgggacggtaaggaccgtaaggtccgacgtaacctacaacggtaacgtggtacggcctacggaccgactacgttcgttaccg

SEQ ID NO: 236879 - DNA, 565 bp, Homo sapiens
  misc_feature: GYAE6OF02J0N4O.45.15.B04.1.454.CMB.1.raw
  modified_base (306)..(306): a, c, t, g, unknown or other
  misc_feature (306)..(306): n is a, c, g, or t
  modified_base (361)..(361): a, c, t, g, unknown or other
  misc_feature (361)..(361): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
  modified_base (442)..(442): a, c, t, g, unknown or other
  misc_feature (442)..(442): n is a, c, g, or t
tcagacgcgatcgacacgaccggtgctcgatttagacagtatatatccgcggggacaacaggcaggcaggggcagcaagatggtgttgcagacccaggtcttcaatttctctgttgctctggatctctggtgcctacggggacatcgtgatgacccagtctccagactccctggctgtgtctctgggcgagaggccgaccagtcaactgcagtccagccagagtgtttagcagctccaacaataagaactacttagcttggtaccagcagaaaccaggtcacgcctcctaagctgctcagtttacnggacatccgtaccggaactcccgggtacctgaccgtatcgagtggcaggcggtcngggacagtattcactcncaccntcagcacgcctgcagctagaagntgnggctagtttntgctnaccgtagacctaaagttnttacttagttaccttccgttacctacgtttccggacccttaggggaacctaaacgggttgtaaacttacgtaaccgtaaaacgtaccgttgggtaccgttcggtaaccggtccttaaacccgg

SEQ ID NO: 236880 - DNA, 716 bp, Homo sapiens
  misc_feature: GYAE6OF02I5SAO.45.15.B04.1.454.CMB.1.raw
  modified_base (324)..(324): a, c, t, g, unknown or other
  misc_feature (324)..(324): n is a, c, g, or t
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttagacagctaccaacaataagaactacttagcttggtaccagacaagaaacccgtggtaccagccctacgtaagcctgtctctatttacgnggtactatccgtaacccgggaacgttcccggggtaccctcggtaccgtattccgaggttcggacgacgggccgggttacgtacggggacctagttacgtttacaaccgtttccttaacccaccgtacgtacggaacgtccgtaaccgtccgtaggaccgtacgggtacttaggaagtcgtcggttacggtacgttagggtttacttcggtacttcggtaaccctaggtaacttaaacggtttactttaaattacgttaacccgtttcccgtaccggttacccgttttacccggggaaccccggtttaggtaaaccccggtaaagggttacccggtaaattaaccgtaaacccggaaacggttaaccgtttcgggaccgttaccgtaacccgg

SEQ ID NO: 236881 - DNA, 594 bp, Homo sapiens
  misc_feature: GYAE6OF02HZDY3.45.15.B04.1.454.CMB.1.raw
  modified_base (307)..(307): a, c, t, g, unknown or other
  misc_feature (307)..(307): n is a, c, g, or t
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagtgtttttacggccccaatagtaagaactacttagcttggtaccagcagaagccaggcagcctctagcctgctcttttacnggcctctacccgggagtccgggtccctgaccgattcagtggcagcgggtctggggcagagtttcactctcaccatcagcagcctgcagccctagaagattcgtcgtactagttttacctaacgttgtaccaagacctaaattaacgtttaataggtaagtactttccccttactccgtaaccgttttccgggaccgggtaaggggtaacccgtaaaggggttcgaccggtaacttacccgaaaaaccgtaacgttgggtaccggacttacggaccctaacccgtacg

SEQ ID NO: 236882 - DNA, 570 bp, Homo sapiens
  misc_feature: GYAE6OF02HUJFM.45.15.B04.1.454.CMB.1.raw
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagtgtttttacggccccaatagtaagaactacttagcttggtaccagcagaagccagggcagcctcctagcctgctcttttacnggcctntacccgggagtccgggtccctgaccgtatcagtggcagcgggtctggggcaggatttcactctcaccatcagcagcctgcagtcctgaagtatgtcgcagtttacacttgcagcaaattattaactggaatactttccctacttacctacgttttccgggacggtaacggggtacccgaaaagggtttccggaccgtaattaccgaaaaaccgtacgttacgggtacggtaccgttaggacccgaacccttaacg

SEQ ID NO: 236883 - DNA, 568 bp, Homo sapiens
  misc_feature: GYAE6OF02HLLDZ.45.15.B04.1.454.CMB.1.raw
  modified_base (423)..(423): a, c, t, g, unknown or other
  misc_feature (423)..(423): n is a, c, g, or t
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagttgttttacggccctaatagtaagaactacttagcttggtaccagacagaagcagggcagcctctagcctgcttcttttacgcggcctccgtacccgggacgtcccgggtccctggaccgtattcgaggtcggcaggtcgggtcgtggggcagtacttcactctacacactcacgcacgcctgcacgctagaagtntcgtcgcgttagtttacctacgtcgtctaagactaatagttagtgtaagttacttccgtcttacgtacgtttcgggacggtacggtaccgtaaggtgacgtaacgtacgaaacggtacgttcggtagtccgtacgacctactacg

SEQ ID NO: 236884 - DNA, 523 bp, Homo sapiens
  misc_feature: GYAE6OF02FGS26.45.15.B04.1.454.CMB.1.raw
  modified_base (306)..(306): a, c, t, g, unknown or other
  misc_feature (306)..(306): n is a, c, g, or t
  modified_base (413)..(413): a, c, t, g, unknown or other
  misc_feature (413)..(413): n is a, c, g, or t
tcagacgcgatcgacacgaccggtgctcgatttagacagtatatatccgcggggacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagttgttttttacggccccaatagtaagaactacttagcttggtaccagcagaagccagggcagcctcctagcctgctcttttacnggcctcgtacccgggagtccggggtccctgaccgattcagtcggcaggcgggtcgtggggcaggtactttcactctcacctatcagcagcctgcacgcctagaagtntgtcgctagttactactgtcagacaattatagtagactcttcctctctacgttcggcgtaggacaggtgacgtatacaaacgtacgtgtcgtctacgcctacattcttcg

SEQ ID NO: 236885 - DNA, 543 bp, Homo sapiens
  misc_feature: GYAE6OF02F03LK.45.15.B04.1.454.CMB.1.raw
  modified_base (381)..(381): a, c, t, g, unknown or other
  misc_feature (381)..(381): n is a, c, g, or t
  modified_base (417)..(417): a, c, t, g, unknown or other
  misc_feature (417)..(417): n is a, c, g, or t
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagttgtttttaccggccccaatagtaagaactacttagcttggtaccagcagaagccagggcagcctcctagcctgcttcttttacgtgggcctcgtacccggggacgtccggggtccctgaccgtattcaggtggcaggcgggtctggggcagtntttcactctcaccatcagcagcctgcagcctgaagntcggtcgctagtttactactgtcagactaattattatgatcttcctctctacgtttcggcgggacggtaccgtaaggttcgacgtaataccgaaacgtacgtaggtcggtctagtacccacttacg

SEQ ID NO: 236886 - DNA, 578 bp, Homo sapiens
  misc_feature: GYAE6OF02IGCB5.45.15.B04.1.454.CMB.1.raw
  modified_base (309)..(309): a, c, t, g, unknown or other
  misc_feature (309)..(309): n is a, c, g, or t
  modified_base (406)..(406): a, c, t, g, unknown or other
  misc_feature (406)..(406): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
tcagacgcgatcgacacgaccggtgctcgatttagacagtatatatccgcggggacaacaggcaggcaggggcagcaagatggtgttgcagacccaggtcttcatttctctgttgctctggatctctggtgcctacggggacatcgtgatgacccagtctccagactccctgactgtgtctcgtgggcgagagggccaccatcaactgcaagtccagccagagttgtttagacagctaccaacaataagaactacttagcttggtacagcagaaaccaggtcagcctacctaagcctagctcatttacngggcatctaacccgggtaatcccggggttcctgaccgtattcagtggcaggcgggtcgtgggaccagtacttcactctcaccatcagcagcctgacnggctagaagntggngtctagtttatgcttgtcagtactaagttattattaacttacttaccgtaccgtaccttttccgggacccgtttacgggaacccgttaaaacggtcggtaacttaacgttaacctaaacggtaacggttcggttaggaccttaccggaccttaacccg

SEQ ID NO: 236887 - DNA, 602 bp, Homo sapiens
  misc_feature: GYAE6OF02IQS8J.45.15.B04.1.454.CMB.1.raw
tcagacgcgatcgacacgaccggtgctcgatttagacagtatatatccgcggggacaacaggcaggcaggggcagcaagatggtgttgcagacccaggtcttcatttctctgttgctctggatctctggtgcctacggggacatcgtgatgacccagtctccagactccctgactgtgtctctgggcgagagggccacatcaactgcaggtccagccagtagttgttttaccgcccaatagtaagaactactagcttggtaccagcagaacgccgaggcagcctctagcctgtctctttacgcggtcctccgtaccgggacgtcccggggtcctgaccgattcgagtggcgaggtcgggtcgtcggggactaggtactttcactctacgacctacgtcagccacgtccctgcacgcctaggaacgatcgtcgtacgttaacgtttacttacgtacgtacagtactaaattacttagtagtaacgttactttcctacgttaccgttacggtttccgggaccgggtaacgggtaccgtaaggtttacggactaacgtaacgaaacgtacgtggtcgtacttcgacctaaccgtcgtcgttaccg

SEQ ID NO: 236888 - DNA, 557 bp, Homo sapiens
  misc_feature: GYAE6OF02HXE0D.45.15.B04.1.454.CMB.1.raw
  modified_base (369)..(369): a, c, t, g, unknown or other
  misc_feature (369)..(369): n is a, c, g, or t
  modified_base (401)..(401): a, c, t, g, unknown or other
  misc_feature (401)..(401): n is a, c, g, or t
  modified_base (410)..(410): a, c, t, g, unknown or other
  misc_feature (410)..(410): n is a, c, g, or t
  modified_base (447)..(447): a, c, t, g, unknown or other
  misc_feature (447)..(447): n is a, c, g, or t
  modified_base (488)..(488): a, c, t, g, unknown or other
  misc_feature (488)..(488): n is a, c, g, or t
tcagacgcgatcgacacgaccggtgctcgatttagacagtatatatccgcgggggagtctccctcactgcccagctgggatctcagggcttcattttctgtcctccaccatcatggggtcaaccgccatcatcgccctcctcctggctgttctccaaggagtctgtgccgaggtgcagctggtgcagtctggagcagaggtgagaaagcccgggcaggtctctgatactctcctgtaaggattctggatacaaacttttaacgaccactggatcgcctggtgcgccagagtcggacccggggaaaggccctaggaaactcggtggggactatcatcgtatcctggtcgacttctgactaccagactacncgtccgtccttccgaaggccaggtcaccatcnctagtcganaagtccatcgaacaccgtcctactgacagtcggaccngaccgtgaacggccctccgactagccgactatttagttacngttggacgtaaggaacgttccgaccgaagccccaagttacgttcggtaggttcccgttggcccttacgg

SEQ ID NO: 236889 - DNA, 684 bp, Homo sapiens
  misc_feature: GYAE6OF02FJMJN.45.15.B04.1.454.CMB.1.raw
  modified_base (238)..(238): a, c, t, g, unknown or other
  misc_feature (238)..(238): n is a, c, g, or t
tcagacgcgatcgacacgaccggtgctcgatttagacagtatataatccgcggggacgggaaccaggacaggcaggggcagcaaggatggtcgttgcaggaccccagggtcttcatttctctgttcgctctcggactctctggtgcctacggggacgactcggtcgatgacccacgtctccagactccctgacctgtgtctcgtcggcgaggaggccaccgggggatcaacctcgccnggtccacgccgacgagtgtttttacggccctaagtagtaacgtaactacttagcttggtaccacgacacgacgccgaggacaccgacctcctagccttgctcgtttactcgggacctccgtacccgggacggtccggggttccctcggaccgacttcgacgtggcacggacgggtcgtcggggcaacggtacttctacctcaccaccactccacgccacgcctcgcacggccgtaagacgagttcgtcgtacgttagtttacctacgttcgtactacggtactaagtacttaagtgtaacgtacgtttacccttcgtaccggtttacggttaccgggggaacgggtaacgggtaccggtaacgggttcggtaaccgtaacgtaacccgtaaaaccggtaagtcggtaccggtacccgtcgaccctaacccttcgtacccgttcccg

SEQ ID NO: 236890 - DNA, 700 bp, Homo sapiens
  misc_feature: GYAE6OF02G1ZHJ.45.15.B04.1.454.CMB.1.raw
tcagacgcgatcgacacgaccggtgctcgatttagacagtatatatccgcggggacaacaggcaggcaggggcagcaagatggtgttgcagacccaggtcttcatttctctgttgctctggatctctggtgcctacggggacatcgtgatgacccagtctccagactccctgactgtgtctcgtgggcgagagggccaccatcaactgcaggtccagccagtagttgtttttaccggccccaatagtaagaactacttagcttggtaccagcagaagccagggcagcctcctagcctgccttacgttttacgtcgggtccttccgtacccggggtacggtcccggggtccctggacccgtacttccgaggttcggccgagggtccggggtcgtcgggggactaggtacgttttccgactttcctaccacccgtataccgacgaccgacggtccctggacctacggtcctagggaacgtagtcggtcgacgttaacgttttacctacgttcggttactaacggtacctaaagtttaattaacgtaggtaacgttacctttcccttacctttaccgttacggtttaccgggaccggggtaacgggtacccgtaaggggttccggaaccggtaactaaccgtaaaaaccggtaacgttcggtacggtaccgtacggtaccctaaccgtacgttccggttaccg

SEQ ID NO: 236891 - DNA, 653 bp, Homo sapiens
  misc_feature: GYAE6OF02JDLP2.45.15.B04.1.454.CMB.1.raw
tcagacgcgatcgacacgaccggtgctcgatttagacagtatatatccgcggggacaacaggcaggcaggggcagcaagatggtgttgcagacccaggtcttcatttctctgttgctctggatctctggtgcctacggggacatcgtgatgacccagtctccagactccctgactgtgtctctggcgagagggccaccatcaactgcacggtccagccagtagttcgtttttaccggcccaatagtaagaactacttagcttggtaccagcagaagccgagggcacgcctcctagtcctgtcttcgttttacgtcgggcctccgtacccggggtacggtcccggggtcccgtgtacccgtattcgacggtggtaccgacggtcggggtacggtcggggcaacggtactttcgaccttacgtacccgaacctactccgtagcctacgcccctagaccgtacggtcccttaaggaacgtagttcgtaccgacgttaacgtttacctacgttcgacctacgactaaagttattaagtcgtaagtaccttcttcctacgttaccgtttacggggacggtaaggtaccgttaggtacggtacaacgtaccgaaaacgtcgttagggtcgtactaccgcctaacctcgtacgtttacgg

SEQ ID NO: 236892 - DNA, 599 bp, Homo sapiens
  misc_feature: GYAE6OF02HT37V.45.15.B04.1.454.CMB.1.raw
  modified_base (593)..(593): a, c, t, g, unknown or other
  misc_feature (593)..(593): n is a, c, g, or t
tcagacgcgatcgacacgaccggtgctcgatttagacagtatatatccgccgggggagctacaacaggcaggcaggggcagcaagatgtgttgcagacccaggtcttcatttctctgttgctctggatctctggtgccgtaggggacatcgtgatgacccagtctccagactccctggctgtgtctctgggcgagagggccacatcaactgacagtccagccagagtgttttagacagctaccaacaataacgaactacttagccttaggtaccaggcaagaaaccaggtacacgccgtactaaagctagctatatttacgtggctactaccgtaacccgggaattcccgggggtacctcggaaccgtattcgaagggttcgcgacggtacggggtctggggaccaggtactttcgaactcgtacacctatacgagccaagtccgagacgaggacttaggaagacgtgtacgtactaggttttacagtccttagactacgactaagttattataattactccttacggtctttaccggcccttacgggtaactaacggttcgaattacgtacgtaaaccgacgtttgacggtntaccgg

SEQ ID NO: 236893 - DNA, 570 bp, Homo sapiens
  misc_feature: GYAE6OF02GDTT9.45.15.B04.1.454.CMB.1.raw
  modified_base (328)..(328): a, c, t, g, unknown or other
  misc_feature (328)..(328): n is a, c, g, or t
  modified_base (470)..(470): a, c, t, g, unknown or other
  misc_feature (470)..(470): n is a, c, g, or t
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagttgtttttacgccccaatagtaagaactacttagcttggtaccagcagaagccagggcacgcctcagcctgcttctttacgtggtccctcgtaccccgggngtcccgggtccctcgtaccgacttcgagtggcacggcgggtctgggacagtactttcactctcacctatcacgcgagccctaggccgaggtcgtgaaacgtgtcggtggacttgtttagttcgcgttgtacagacttaattnttaagttacttactccttccgttacgtttccggacctacgggaacctaaggtcggtaattacgtaacaacgtatcggtacgtctagtccaccgtattccg

SEQ ID NO: 236894 - DNA, 509 bp, Homo sapiens
  misc_feature: GYAE6OF02HDIYM.45.15.B04.1.454.CMB.1.raw
  modified_base (401)..(401): a, c, t, g, unknown or other
  misc_feature (401)..(401): n is a, c, g, or t
  modified_base (429)..(429): a, c, t, g, unknown or other
  misc_feature (429)..(429): n is a, c, g, or t
tcagacgcgatcgacacgaccggtgctcgatttagacagtatatatccgcggggacaacaggcaggcaggggcagcaagatggtgttgcagacccaggtcttcatttctctgttgctctggatctctggtgcctacggggacatcgtgatgacccagtctccagactccctgactgtgtctctgggtgagagggccaccatcaactgcaggtccagccagtagttgtttttaccggccccaatagtaagaactacttagcttggtaccagcagaaaccaggtcagcctcctaagctgctcattactgggcatctaccgggaatccgggtcctgaccgatcagtgcagcggtctgggactagtattcactctccaccatcagcagcctgcaggctagaagtntggtgctagtttatgctgtcagctaatnttatattacttcctcgtacttcgcctgggacctaagtacgatactacgaacgacgtggtacgtcacgcaactactctacg

SEQ ID NO: 236895 - DNA, 645 bp, Homo sapiens
  misc_feature: GYAE6OF02JZQM0.45.15.B04.1.454.CMB.1.raw
  modified_base (181)..(181): a, c, t, g, unknown or other
  misc_feature (181)..(181): n is a, c, g, or t
  modified_base (218)..(218): a, c, t, g, unknown or other
  misc_feature (218)..(218): n is a, c, g, or t
  modified_base (313)..(313): a, c, t, g, unknown or other
  misc_feature (313)..(313): n is a, c, g, or t
  modified_base (391)..(391): a, c, t, g, unknown or other
  misc_feature (391)..(391): n is a, c, g, or t
  modified_base (632)..(632): a, c, t, g, unknown or other
  misc_feature (632)..(632): n is a, c, g, or t
tcagacgcgatcgacacgaccggtgctcgatttagacagtatatatccgcggggagtctccctcactgcccagctgggatctcagggcttcattttctgtcctccaccatcatgggtcaaccgccatcatcgccctcctcctggctgttctccaaggatctgtgccgaggtgcagctggtncagtcctggagcagaggtgaagaaacggtcccggganacggttctcgtagactacctcttacctaggtaaacggtatttctaggtaataaccgtaactttaaccgacctacgtaggactcgtcgtgggtacncgaccagacgtacggacccgggtaaagccgtaaggaacgtacggtggacatcatctacgtccgtaggtctactcgtanactaccgagtatacgacgttccgtacccttacggaacgtcacggtacactacgtctacgtacgacgactaacgtacctactacctaaccgacccgtactacctacggacctaggaccggtaacctacggccgttaccgaacggccccgacgacgtaaccgcggtaaccctagtttaccgtatccgttgaccggaacgtacgtcgcccgaaacgtcgtaacgttacgttcgtaccggttacncgtcccgttacgg

SEQ ID NO: 236896 - DNA, 654 bp, Homo sapiens
  misc_feature: GYAE6OF02G545T.45.15.B04.1.454.CMB.1.raw
  modified_base (359)..(359): a, c, t, g, unknown or other
  misc_feature (359)..(359): n is a, c, g, or t
  modified_base (426)..(426): a, c, t, g, unknown or other
  misc_feature (426)..(426): n is a, c, g, or t
  modified_base (452)..(452): a, c, t, g, unknown or other
  misc_feature (452)..(452): n is a, c, g, or t
tcagacgcgatcgacacgaccggtgctcgatttagacagtatatatccgcgggggacaacaggcaggcaggggcagcaagatggtgttgcagacccaggtcttcatttctctgttgctctggatctctggtgcctacggggacatcgtgatcgacccagtctccagacctccctgactgtgtctcgtgggcgaggacgggccaccatcaactgcacgtccagccagtagttcgtttttaccggccctaatacgtaagaacttacttagcttcggtaccagtacagaagcgaggcagcctcgtacgcctcgtcttctttacgcgggtcctccggtacccgggtacggtcccgggttcccncggtaccgtagttcgagtcgcgacggtcgggtcggtgggcagtacgtttcgacttcctacacctacncgtacgcacgcctagcacgtccgtanaacgtcgtcgtcgtacttaacgttttaccgtcgtacgttccaacgtacttaatttacgttaatcgggtaacttacctttcccgttacgttccgttaccggttacgggacggtaaccgggttaccttaagggtcgaaccgtaactaaaccggtaaaccggacgttgggacttaccggtcaccggtaaccttcggtacttacgg

SEQ ID NO: 236897 - DNA, 801 bp, Homo sapiens
  misc_feature: GYAE6OF02FMYE7.45.15.B04.1.454.CMB.1.raw
tcagacgcgatcgacacgaccggtgctcgatttagacagtatatatccgcgggggagctacaacaggcaggcaggggcagcaagatggtgttgcagacccaggtcttcattttctctgttgctctggatctctggtgcctacggggacatcgtgatcgacccagtctccagactccctgactgtgtctcgtgggcgaggacgggccaccgatcaactgcgacggtccgacgccagtaggtttcggttttttacccggacccctaagtaggtaaacgtaaccgttaaccgtttacgtcgtttacggtaacccgacgtacctaaggaacggccgacggggccacggtccctaccgtacgtcctcgtcctttaccgttttaccgtcgggtcccttccggtacccggggtacggttccccggggttcccgtacggtaaccggtacgttccgaacgggttcgggaccggtacgggtccggggttcgtcgggggtactaacgggttacttttaccgaccttccgttaccaaccgtactccgaacgcctaacggtccctcggaccgaccggtacccgtaggtaacgtacgttcggttacgtccgtttaacgttttaaccgtcgtaggtacctaacgtaacttaaagttacgttttaagtacgggtactttaaccgtttcctaaaccgtttcggttaacccgggtttacggggcccgggtaacggtaccggttaacgggttccgaacggttaacgtaacccgttaaacgtcggttacgggtaccgtaccgttacgaccgtaccgttacg

SEQ ID NO: 236898 - DNA, 555 bp, Homo sapiens
  misc_feature: GYAE6OF02GD6R1.45.15.B04.1.454.CMB.1.raw
tcagacgcgatcgacacgaccggtgctcgatttagacagtatatattcgcggggacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagtgtttttacggcccaatagtaagaactacttagcttggtaccagcagaagccagggcagcctcctagcctgctctttactggcctctacccgggagtccggggtcctgaccgattcagtggcagcgggtctggggcagtatttcactctcaccatcagcagcctgcagcctagaagtatgtcgctagtttactactgtcagctaacttattatgtatactttccctctctacgttttcgggacggtagggtacctaagggttcgacgtaacttaaccgaaaacggtaaccgttggtacggtacgttacggacctacccgtaattccgttacgg

SEQ ID NO: 236899 - DNA, 656 bp, Homo sapiens
  misc_feature: GYAE6OF02FQY2B.45.15.B04.1.454.CMB.1.raw
  modified_base (521)..(521): a, c, t, g, unknown or other
  misc_feature (521)..(521): n is a, c, g, or t
  modified_base (547)..(547): a, c, t, g, unknown or other
  misc_feature (547)..(547): n is a, c, g, or t
tcagacgcgatcgacacgaccggtgctcgatttagacagtatatatccgcggggacaacaggcaggcaggggcagcaagatggtgttgcagacccaggtcttcatttctctgttgctctggatctctggtgcctacggggacatcgtgatgacccagtctccagacctccctgactgtcgtctcgtgggcgaggacgggccaccatcaactgacaagtccacgccagagttgttttagacagtctacccaaactaataaagtaaccttacgttacgtcgttacggtaccagtaccgaacggtaaaaccacggttacacgtaccctaccgtaagctacgctctaatttcgtacggactacgtaccgtaacccgggaacgtcccgggtaccctacggtaaccgtagttacgtacgtcggacgtacggcgggtcgagggaactaggtactttaccacgtctactaacctactcgacgcacgctcgcgaggtctaggaagtacttggtgtacgttagttctcgtntacgtcacgtactaattattaacttntacttcctaccgttaccgttccggtaccgtagggtaacctaaggttacgtaacgttaaccgtaaacgtaacggtaacgttaccggtacggtactacggtacctaacccg

SEQ ID NO: 236900 - DNA, 572 bp, Homo sapiens
  misc_feature: GYAE6OF02HGN5F.45.15.B04.1.454.CMB.1.raw
  modified_base (217)..(217): a, c, t, g, unknown or other
  misc_feature (217)..(217): n is a, c, g, or t
  modified_base (536)..(536): a, c, t, g, unknown or other
  misc_feature (536)..(536): n is a, c, g, or t
tcagacgcgatcgacacgaccggtgctcgatttagacagtatatatccgcgggggagtctccctcactgcccagctgggatctcagggcttcattttctgtcctccaccatcatggggtcaaccgccatcatcgccctcctcctggctgttctccaaggagtctgtgccgaggtgcagctggtgcagtctggagcaggaggtgagaaacgcccgggnagtctctgactactctctgtaaggattctggatacaactttgacgaccactggatccgcgtgggtcgcgcagatcgaccgggaaaggcctaggaatcggtggacatcatctagtcctggtacactctagactaccgagtactacgagttcccgtccttaccgaaggtcccaggtaccaactagccttcgaaggtcaacgtaacgtccaacgtacgaaaccacccggtcctaacctggcaacgtcggaccctaacggcctaggacgtaccctacgacacggcgtacctatttactacgtgtacgtcgacgacgtccgacncgtacctattacgttcggtacgttcccgtgtacccg

SEQ ID NO: 236901 - DNA, 845 bp, Homo sapiens
  misc_feature: GYAE6OF02HWA3W.45.15.B04.1.454.CMB.1.raw
tcagacgcgatcgacacgaccggtgctcgatttagacagtatatatccgcgggggagctacaacaggcaggcaggggcagcaagatggtgttgcagacccaggtcttcatttctctgttgctctggatctctggtgccgtacgggacatcgtgatgacccagtctccagactccctgactgtcgtctcgtggcgagcggccactatcaactgactagtccagccgtagtagtttacggtttttaccggaccctaaagttaagtaacgtaaaccgttacgtttaacgtcggttaccggtaaccgtaggaccgtaaaggaccggtaccggaacggggtcctaacggtacccctttaccggtaaccggtcccgttacggttacctttaccgttttttaaccggtccgggtaccccgtttacccgggttaaacccgggggttaccgggtttcccccggggttacccctaacgggtaacccgttcggttaaccggtaacggttcgggtacgtacggggtaccggggttacggttacgggggacttaacgggtttacgttttaccgaaccgttccctacgtaacccgtagttaaccggaccgtacgtaccggtaccgtacggtcgtaacggtacgtaacggtaaagttacggtcggttacggtaaccgtttaggtttacttcgtacggttacgtaagaccgttaataagttttattaacgtttacttaccgttcccgttacgtccgtttaccgaccgtacggtaaaccgttaaggtacgttaacgtaaaccgtaacggtaaaacccgtaggttcgggttaacgaccgttcggtaacctcgttacgtttacg

SEQ ID NO: 236902 - DNA, 700 bp, Homo sapiens
  misc_feature: GYAE6OF02GSUV0.45.15.B04.1.454.CMB.1.raw
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgaccagtctcaggactcctgactgtgtctctgggcgaggacgggccaccgatcaactgcgacggtccagcctaggtacgttcggtttttaccggcccctaataggtaaacgtaactacttaggccttgggtaccaggctaaggaacgccgaaggggtcacggtccctaccgtacgcctagtccttacttttaaccgtcgggtacccttccggtaacccggggtacgttccccggggttcccctacggtacccgtattccgaggtcggacgacgggtcgggtcgtcggggctaggtactttcacgttctacactactcaggtccacgtcctgacgacgtccgtagaacgtcgtcggtcccgtacttaacggtttacctaccgttcggtaacctaacggactaaacgtttataacgttaggtaacttaccttccgttacgtacccgttacggtttaccgggcgggtaacgggttaaccgtagggttaccgacgtaacgttaaccgaaacggtacgttcgggtacgtaccggtaccgtctaaccgtcg

SEQ ID NO: 236903 - DNA, 946 bp, Homo sapiens
  misc_feature: GYAE6OF02H9Z9W.45.15.B04.1.454.CMB.1.raw
  modified_base (98)..(98): a, c, t, g, unknown or other
  misc_feature (98)..(98): n is a, c, g, or t
tcagacgcgatcgacacgaccggtgctcgatttagacagtatatatccgcgggggatctccctcactgcccagctgggatctcgaggcttcattttcngtccctccaccatcagtggggtccaaccgccatcacgtccgccctcctcgtcgtcgttcgttccacggaggtcgtcgtgtccggaccggtagggtcacgtacggtcgttgggtgacgtacggttacgtaggggaacgacgggtagggtagggaacggaaaaaccgggaacccggggtccccgggacgttacgttcccgtacggtaacgttaaaccttccccgttaccgtttaccgggttaaaaggttaacggtttacgtttacggttaaggtaaaccctttaaaacccgttaaaaccggtttaacccgaaccgtaccgggtacggtacccggtcccggttccgggtttacggggacccgtaccccgaaggtaaggtacccgggaaccccggggaaaacccggggtaacggtaccgggtaaacgggtaccggttacggggtaaccgtactactaccgtttacgttacccgtaccgttcgggtacgtacctacctacgttacgaaccgtaaccgaagttacccgtacgttcccgtacccgtttaaccggaacggtaccgtaccggtacctaacccgacgttaccgtccgtaacgtaccgtaaccgtaactaaccgaccctaaacgtaccccgtaacccgaccccgtacccgttacgaccgtacggtaccgggtaccctaaccggaccgtacggaacccggttacccgaccccggtaccggaacgtacccgtaccgttaacttaccgtttacccgttagaccgggtaaccgtaacggtaaccggtccgaacccgacccgttaagtaccttagttaccggttccggtcccgttccgtaccggtttcgtacgg

SEQ ID NO: 236904 - DNA, 799 bp, Homo sapiens
  misc_feature: GYAE6OF02IP88T.45.15.B04.1.454.CMB.1.raw
tcagacgcgatcgacacgaccggtgctcgatttagacagtatatatccgcggggacaacaggcaggcaggggcagcaagatggtgttgcagacccaggtcttcatttctctgttgctctggatctctggtgcctacgggacatcgtgatgacccagtctccagacctcctgactgtgtctcgtgggcgaggagggccaccatcaactgcacggtccacgccaggtacgttcgttttttaccggaccctaaatacgtaacgaacttaacttaacggtcgtttaggtaaccagacgaacgaacgaccgaaggggacaacgacccttaccgtaacgtcccgttacggtcctttacgtttttaaccgtcgggtacccttaccggtaacccggggtaacgttccccgggggttacccgtacggaccgtaacttcgaaggttcggcgacggtcgggtcgtacgggactaaggtactttccgaacctcctacctaccactaccgtagcacgtccgtaggacgacggatagaaacgtgtacggtagtacgttaaggttttacttacgtcgttacgtacgaacgtaacgttaaatttaaacgttttaactttaacgtttaccgtttaccccgttaaccgtttacccggttttacccggtaaccccgggttaacgggtaaaccctaaagggttacgggttaaacttaacggttaaaacccgttaaaccgggtaaccgttacgggttaacccgggtacgttaacccggtaacccgtaacccttacggtttacccgttacgtttaaccccg

SEQ ID NO: 236905 - DNA, 739 bp, Homo sapiens
  misc_feature: GYAE6OF02FR78O.45.15.B04.1.454.CMB.1.raw
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacgggacatcgtgatgacccagtctccagactccctgactgtgtctctggcgagagggccaccactacaactgcgaggtccacgcctagtacgtttttttaccgaccccaattagtaagtaactacttagcttgtaccagacagacgccgaggcacgcctaccgacgtccctgtctccttttaccgtgggtcctccgtacccgggacggttcccgggttccccgtacggacccgtacttcgtacggtcggccgtagggtccgggttcggtcgggggtcgtaacggtactttcccgaaccgtttccgtaccaacccgtactaccgtacggacctacggtcccttcgggaccgtacgggtactaacgggaacggtgtcgggtacggacgtttagttttaatccggtcctttaggtacgaacgttacgtaaattttacgtttaaaccttgtttaaaccctttccccgtaacccggtttaacgtttcccgggacccgggttaaacggtacccgttaaggtacgggttaactaaaccgttaaccgtaaaacccggttcggttacggttcggaaccgttccgaacctcccgttacgttccgtaccg

SEQ ID NO: 236906 - DNA, 810 bp, Homo sapiens
  misc_feature: GYAE6OF02IQTPF.45.15.B04.1.454.CMB.1.raw
  modified_base (503)..(503): a, c, t, g, unknown or other
  misc_feature (503)..(503): n is a, c, g, or t
  modified_base (585)..(585): a, c, t, g, unknown or other
  misc_feature (585)..(585): n is a, c, g, or t
  modified_base (672)..(672): a, c, t, g, unknown or other
  misc_feature (672)..(672): n is a, c, g, or t
tcagacgcgatcgacacgaccggtgctcgatttagacagtatatatccgcggggacaacaggcaggcaggggcagcaagatggtgttgcagacccaggtcttcatttctctgttgctctggatctctggtcgccgtacggggacatcgtagatcgacccagtccctaccacgtaccttccctgtaccttggttcgtccttcggtcgggacgacggaccggtacccaaccataccgtaacgttcggaccgtaacggtcccgaacgtaccgtaacggttacgtttttaccggtttttaaccccgggaccccttaaaaaggttaaacggttaaccgtaaacgttttaacgtttacggtaccgtttacggttaacccgaacgtacgaaaggaccgccggtaggaccaaccggtcccttacgtacgccttagttccgttttcgtttaccggccggtaccccgttccgggtacccgggtaccgggtccccgggtttccacggtaccgtnttccgacggtcggccgtagggttccggtacggtcggacgtagtttacttaccgacttccgtaaccacccgtagcgacgtacncgttccgtagccggactacgggtataacgtacgttccgtacggttacgttatttaccgtactcgactagtaccttaatagttaaccncgtttacttaccttcccgtaaacttaccggttcggttacgggaacgttcggtaaccgtcggttacgaacgttaccaaaaccggttcgtaacggttcgacggttaccctagacccgttaccgttacctttcggttaccc

SEQ ID NO: 236907 - DNA, 1123 bp, Homo sapiens
  misc_feature: GYAE6OF02GFO6X.45.15.B04.1.454.CMB.1.raw
  modified_base (246)..(246): a, c, t, g, unknown or other
  misc_feature (246)..(246): n is a, c, g, or t
tcagacgcgatcgacacgaccggtgctcgatttagacagtatatatccgcgggggagtctccctcactgcccagctgggatctcagggcttcattttctgtcctccaccatcagtggggtcaaccgccatcatcgccctcctcctggctgttctccgaaggagtctgtcgccgaggtcgcacggcgttgggtacgcgtaggtcgtaggacgcgtaaggaggtaggaaacggaaccgggcccgggtntacgtcgtctagtaacctacgttccgttaccgtaggttaacgtcgttacgtaacggtaacttaaaacccgtaaacgttttaaacccgaccgtaacggttacggaaccgttccggtaccggttcgggggtaccggacccgaacccggtaaggtaaccggtccgggggtaaaacccccgggggtaaacggttacccgggtaaacgggttaaacgggtccggggtaccggggtctaaacgttccgtaacggttaccgttaaccggttccgggttaaggggttacccgtaacgttaccgttaaggtaaccccgtttaaaccggaacgttaaacgttaaacccgggttccccggtttaccccggttttacccggtaaaacccgggtaccgggtaaccccgtaaccggttaaccccgaactttaacccggtttcccggtaaacccgttaacggggtttaaacccgtaaccccggttaaaccgaacccgtttaaccccgtaaaacccggtaaacccccgtaccccgttaacccggtttaaccccggtaacgggttaaccccgtaaaccgggggtttaaccctaaacccccgggttacccgttaaaccccggttaaaccgggggtaaacccccgtccccccgggttttaaaacccggaaccggttacccccgggggttaaccctttaaaaccccgtttttaccggtttaaaaaccccgggtttcggtttaaccgggtaccggtaaacccggggttaaccgttaaacccgggttaaccccgcccggttaaaccgggtttaacccccaagggtttttaaccccggggttttccggggtttaaacccgttcccccgggttaccggttacccggtttttaaacccgggg

SEQ ID NO: 236908 - DNA, 748 bp, Homo sapiens
  misc_feature: GYAE6OF02IR62V.45.15.B04.1.454.CMB.1.raw
  modified_base (159)..(159): a, c, t, g, unknown or other
  misc_feature (159)..(159): n is a, c, g, or t
  modified_base (182)..(182): a, c, t, g, unknown or other
  misc_feature (182)..(182): n is a, c, g, or t
  modified_base (193)..(193): a, c, t, g, unknown or other
  misc_feature (193)..(193): n is a, c, g, or t
  modified_base (223)..(223): a, c, t, g, unknown or other
  misc_feature (223)..(223): n is a, c, g, or t
  modified_base (668)..(668): a, c, t, g, unknown or other
  misc_feature (668)..(668): n is a, c, g, or t
tcagacgcgatcgacacgaccggtgctcgatttagacagtatatatccgcgggggagtctccctcactgcccagctgggatctcagggcttcattttctgtcctccaccatcatggggtcaaccgccatcatcgccctcctctggctgttctccaaggntctgtgccgaggtgcagctggtncagtctgggancgtaggacggtgaacgaaacggcccggganagtcctactagaattacctcgtacgtaggtaaggtcttgtaggtataactaactttgaaccgtaccaacgtggaagtccgtcgtgggtcgtccgaccaacggtatccgggaaccgggaaacggtcccgtaaggaacttcgggacgggtactaattaccgacttaccgtaacttccggttggtacgtacctttacacggtaaactaccgaagtaacgttacgtacccgttccttaccgttaccgaacgggtaccgtacggtaacctaccctacgttacctacgtaccggtaaccgtaaacgtaacgttacccgaactaacccgaaccgtaccccggtaaccccttacccgtgtaacccgtaggttaacccggcgtacccggtacgtacgggaaccgtacccgttaacgacccgttacgaccgtaacttaacgtttacttaccgggnttaccgggaacgaaacggtaccgtaccgaccgaacgtacccttaaggttaccgttacggtccgtaccgtccgttaaccgg

SEQ ID NO: 236909 - DNA, 776 bp, Homo sapiens
  misc_feature: GYAE6OF02F0DO6.45.15.B04.1.454.CMB.1.raw
tcagacgcgatcgacacgaccggtgctcgatttagacagtatatatccgcgggggagctacaacaggcaggcaggggcagcaagatggtgttgcagacccaggtcttcatttctctgttgctctggatctacgtggtgccgtacggggacatcgtgatcgacccagtctccagacctcctgtactgtcgtctcgtgggcgaggacgggcccaccatccaacgtcgacgtacggtacccacgaccgagttacggttttcggtttttacccggaccctaaagtaacggtaaacgtaaccttacgttacgtcgttacggtaaccgacgacgaaaggtaacgtaccgagggtaccaaccgtccctaccttacggccttcgtcctttcgtttacgtccggtccgtacccggttacccggggtaccggtccccgggtccgtacgaccgtacgtcggacggtcggaccgtcggtcgggtcggtacgggtcgtaacgtacttcctacgtcctaccgactacgtcacggtacaccgtcctggtaccgactcgtaaggtacgacgttacggtaccgtacgtttaaacgtttacccggtaattccgtaacggtaacgttaacggtaaacttttacggttaacgtagaaccgttttccttaccgttaccttaacgggttccggttaccggggacggttaaaccgggtacggttaacgggaccgttaacgaacttaacggaacccgtttacggacggttaccgggccctaacggtacctaccgtaaccg

SEQ ID NO: 236910 - DNA, 520 bp, Homo sapiens
  misc_feature: GYAE6OF01BQTO7.5.24.C02.1.454.CMB.1.raw
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacacccgacaaagcccccaaactcatcattttgaggtcactacgcgaccctcagggtccctgatcgcttctctggctccaagtctggcaacacggcctccctgacccgtctctgggctccaggctgaggatgaggctgattattactgcagctcatatgcaggcagcagcacgtccccatcgtgatcgttcgggcgggggaccaaggcgtcgaccgtccgtaggtcacgacccaaggccgtcgtcccccg

SEQ ID NO: 236911 - DNA, 546 bp, Homo sapiens
  misc_feature: GYAE6OF01AKE4Q.5.24.C02.1.454.CMB.1.raw
  modified_base (253)..(253): a, c, t, g, unknown or other
  misc_feature (253)..(253): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagccctccctccgcgtccgggtctcctggacagtcagtcaccatctcctgcactgcaaccagcagtgacgttggtggttcgaagtntgtctcctggtaccaacaacaccccgacaaacgccccaaactcatcattttgagtcactacgcgaccctcacgggtccctgatcgcttctctggctccaagtctggcacacggcctccctgaccgtctctgggctccaggctggaggatgaggctgtattattactgcagctcatatgcgaggcagccacgcgtacgtccccagtcgtgacttccggttcgggccgggggtacctaggccgtcggacccgttccgtacggtccacggacccgaacggtccgtccggtcccccg

SEQ ID NO: 236912 - DNA, 539 bp, Homo sapiens
  misc_feature: GYAE6OF01E4EKL.5.24.C02.1.454.CMB.1.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggtggttcgaagtntgtctcctggtaccaacaaccaccccgacaaacgcccccaaactcatctattttgagtcactacgcgaccctcgacgggtccctgactcgcttctctggctccaagtctggcaacacggcctcctcgacccgtctcgtgggctccgaggctgaggatggaggctagtattattactgcagctcatatgcaggcagcagcacgtcccatgtgtctccggtcgggcgggggaccaaggccgtcggacccgtcgtacggtacacgacccgacggccgtccggtcccccg

SEQ ID NO: 236913 - DNA, 512 bp, Homo sapiens
  misc_feature: GYAE6OF01BLPCB.5.24.C02.1.454.CMB.1.raw
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggtggttcaagtntgtctcctggtaccaacaacacccgacaaacgccccaaactcatcattttgaggtcactacgcgacctcagggtccctgatcgcttctctggctccaagtctggcaacacggcctccctgaccgtctctgggctccgaggctgaggactgaggctgtattattactgcagctcatatgcagcagcagcacgtcccatcgtgtactcgttcgggcggggaccagcgtgaccgtccgtaggtcacgccacgccgtcgtccccg

SEQ ID NO: 236914 - DNA, 581 bp, Homo sapiens
  misc_feature: GYAE6OF01C6XJL.5.24.C02.1.454.CMB.1.raw
  modified_base (444)..(444): a, c, t, g, unknown or other
  misc_feature (444)..(444): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacacacccgacaaacgcccccaaactcattctattttgaggtcactacgcgaccctcgacgggtccctgatcgcttctctggctccaagtctggcaacaccggtcctcccgtcgaccgtctcgtcgggcctccgaggctggaggagtggaggtctagtattattactgccagtctntattactgcgaaggcagcagtccacgtcccagtcgtagtacgttccggtaccggggacgggggaacctaaggtccgtaccggacccgttcccgtacggtccgaccggacccgtaacggcccgtccggtaccccccgg

SEQ ID NO: 236915 - DNA, 549 bp, Homo sapiens
  misc_feature: GYAE6OF01BRAQ5.5.24.C02.1.454.CMB.1.raw
  modified_base (253)..(253): a, c, t, g, unknown or other
  misc_feature (253)..(253): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtntgtctcctggtaccaacaacaccccgacaaacgcccccaaactcatctattttgaggtcactacgcgacctcgacgggtccctgactcgcttctctggcctcaagtctggcaacaccggcctccctgacccgttctcgtcgggccttccgaggctggaggagtgaggtctgtattattactgctagctcatatgcaggcagcagcacgtcccatcgtgatccggttccgggcgggggaccaaggctcggacccgttccgtacggtccacggacccgaaggtcccgtccgtcccccg

SEQ ID NO: 236916 - DNA, 535 bp, Homo sapiens
  misc_feature: GYAE6OF01CRV1M.5.24.C02.1.454.CMB.1.raw
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctctggtaccaacaacacccgacaaagcccccaaactcatcatttttgaggtcactacgcgaccctcacggggtccctgatcgcttctctggctcagtctggcaacncggcctcccngaccgtctctgggctccaggctgacggatgaggctagtattattactgacagctcatatgcaggcagcagcacgtccccatgtgattccgttcgggacgggggtaccaggtcgtcggacccgttccgtacggtccacggacccaacggccgtccgtcccccg

SEQ ID NO: 236917 - DNA, 513 bp, Homo sapiens
  misc_feature: GYAE6OF01CTPV5.5.24.C02.1.454.CMB.1.raw
  modified_base (242)..(242): a, c, t, g, unknown or other
  misc_feature (242)..(242): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggnggttcaagtatgtctcctggtaccaacaacaccccgacaaagcccccaaaactcatcatttttgagtcactacgcgaccctcaggggtccctgatcgcttctctggctccaaagtctggcaaacacggcctccctgaccgtctctgggctccaggctgaggatgagctgattattactgcagctcatatgcagcagcagcagtccccatgtgatcgttcggcggggggtaccaaggctgaccgtctaggtcaagcccaaggctcgcccccg

SEQ ID NO: 236918 - DNA, 539 bp, Homo sapiens
  misc_feature: GYAE6OF01CIVYA.5.24.C02.1.454.CMB.1.raw
  modified_base (241)..(241): a, c, t, g, unknown or other
  misc_feature (241)..(241): n is a, c, g, or t
  modified_base (252)..(252): a, c, t, g, unknown or other
  misc_feature (252)..(252): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggnggttcgaagtntgtctcctggtaccaacaacacccgacaaacgccccaaactcatcatttttgaggtcactacgcgacctcagggtccctgactcgcttctctggctccaagtctggcaacacggcctccctgaccgtctcgtcggctccgagctgaggatgaggctgattattactgcacgctcatatgctaggcagcagcacgtccccatcgtgtactcgttcgggacgggggtaccaaggcgtcggacccgtaccgttacggtccacggacccgaacggtccgtcgtccccccgg

SEQ ID NO: 236919 - DNA, 513 bp, Homo sapiens
  misc_feature: GYAE6OF01CP05F.5.24.C02.1.454.CMB.1.raw
  modified_base (365)..(365): a, c, t, g, unknown or other
  misc_feature (365)..(365): n is a, c, g, or t
  modified_base (400)..(400): a, c, t, g, unknown or other
  misc_feature (400)..(400): n is a, c, g, or t
  modified_base (417)..(417): a, c, t, g, unknown or other
  misc_feature (417)..(417): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctctggtaccaacaacacccgacaaacgccccaaactcatctatttttgagtcactacgcgaccctcgacgggtccctggactcgcttctctgtctcaagtctggcaacncgcctccctcgaccgtctcgtggctcgagctgagntgagctgtattatactncagctcatatgcagcagcagcacgtcccatgtcgatcgtcgggcggggaacaaggcgtcgaccgtcgtagtccacgcccaaggcctcggtcccccg

SEQ ID NO: 236920 - DNA, 658 bp, Homo sapiens
  misc_feature: GYAE6OF01DMBXO.5.24.C02.1.454.CMB.1.raw
  modified_base (254)..(254): a, c, t, g, unknown or other
  misc_feature (254)..(254): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgaggtcctgggcccaggctgccctgactcagcctccctccgcgtccgggtctcctggacagtcagtcaccatctcctgcactgcaaccagcagtgacgttggtggttacgaagtntgtctccgtggtaaccaaacaaccaccccgaacaaaccgacccccaaactcatctattttgagtcactacgccgacctcgacgggtccctgactcgcttctctcggctacgaagtctaggacctaacgaccggtcctcccgtcgacccgtctcgtcgggacctccgaggtcgtaggaggtatggaacgtcgttagtaatttaacgttacgtcgactacgtaccttactaattacgtcggacgtaacgggcctaacggaccgtaacggaccgtacccgttaccccgtagttcggtacggttacgttcccgggttacgggggaccgggggtaacctaaggtcgtcggtacccggttaccgtacggtaccgaccgacccgtaacggtcccgttcccggtacccccgg

SEQ ID NO: 236921 - DNA, 535 bp, Homo sapiens
  misc_feature: GYAE6OF01B1JN1.5.24.C02.1.454.CMB.1.raw
  modified_base (227)..(227): a, c, t, g, unknown or other
  misc_feature (227)..(227): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggtggttcgaagtatgtctcctggtaccaacaacaccccgacaaagcccccaaactcatcatttttgagtcactacgcgaccctcagggtccctgatcgcttctctggctccaagtctggcaacacggcctccctgaccgtctctgggctccaggctgaggatggaggctgatttattactgcagctcatatgcaggcagcagcacgtccccagtcgtgacttcgttcgggccggggggtaccaaggcgtcggacccgtccgtacggtcacgacccgaacggtccgtcgtccccccg

SEQ ID NO: 236922 - DNA, 528 bp, Homo sapiens
  misc_feature: GYAE6OF01CND3F.5.24.C02.1.454.CMB.1.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (430)..(430): a, c, t, g, unknown or other
  misc_feature (430)..(430): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggnggttcgaagtatgtctctggtacaacaacaccccgacaaacgccccaaactcatcattttgaggtcactacgcgaccctcacgggtcctgatcgcttctctggctccaagtctggcaacgacggcctcctgaccgtctctcgggctccgaggctgacgatgaggctgatattactgctagctcatatgnagcagcagctacgtacccagtcgtgtacgtccgttcggggcgggggtaccaaggcgtcgacccgtctacggtcacgtcccgaacggcgtcgtcccccg

SEQ ID NO: 236923 - DNA, 574 bp, Homo sapiens
  misc_feature: GYAE6OF01DSOL4.5.24.C02.1.454.CMB.1.raw
  modified_base (229)..(229): a, c, t, g, unknown or other
  misc_feature (229)..(229): n is a, c, g, or t
  modified_base (367)..(367): a, c, t, g, unknown or other
  misc_feature (367)..(367): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgccaaccngcagtgacgttggtggttcaagtatgtctctggtaaccaacaaccacccgacaaacgcccccaaatcatctattttgaggtcactacgcgaccctcgacgggtccctgatcgcttctctggctccaagtctggcaacncgcctccctgacccgtctcgtgggcctcgaggctggaggtatggagctagtatttactacgtgctagctactatatgacgtacgcacgcgtacgcgtaccgttacccagtcgtacgtacgtccggttcggggaccgggggtaaccaacggtccgtacggtacccgtccggtacggtccgaacgcccgaacggccgtccgtacccccg

SEQ ID NO: 236924 - DNA, 515 bp, Homo sapiens
  misc_feature: GYAE6OF01BZ590.5.24.C02.1.454.CMB.1.raw
  modified_base (252)..(252): a, c, t, g, unknown or other
  misc_feature (252)..(252): n is a, c, g, or t
  modified_base (433)..(433): a, c, t, g, unknown or other
  misc_feature (433)..(433): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtntgtctcctggtaccaacaacaccccgacaaacgcccccaaactcatcattttgagtcactacgcgaccctcacggggtccctgactcgcttctctggctccagtctggcaacacggcctccctgaccgtctctcgggctccaggcctggaggatgagctgattattactgcagtctcatangcaggcagcagcacgtcccatgtgagtcgtcgggcggggacagctcgccgtccgacggtcacgcccaacggcctcggccccg

SEQ ID NO: 236925 - DNA, 535 bp, Homo sapiens
  misc_feature: GYAE6OF01CNWUV.5.24.C02.1.454.CMB.1.raw
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggtggttcgaagtntgtctcctgtaccaacaacacccgacaaacgccccaaactcatctattttgagtcactacgcgacctcacgggtcctgactcgcttctctggctccaagtctgcaacacggcctcctcgaccgtctcgtcggctccgacggctggaggtatggagtcgtagtatttagttactgcagtctacatatgctagcagcagcacgtcccatgtgtactcggtcgggacggggtaccgagcgtcgaccgtccgtacggtcgacgaccgaacggtccgtccggtccccg

SEQ ID NO: 236926 - DNA, 547 bp, Homo sapiens
  misc_feature: GYAE6OF01BKS1D.5.24.C02.1.454.CMB.1.raw
  modified_base (253)..(253): a, c, t, g, unknown or other
  misc_feature (253)..(253): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtntgtctcctggtaccaacaacacccgacaaacgcccccaaactcatcatttttgaggtcactacgcgaccctcacggggtccctgactcgcttctctggctccaagtctggcaacacggcctccctcgaccgtctctcgggcctccgaggctggaggatggaggctagtattattactgcagctcatatgcaggcagcagccacgtccccatcggtgacgttccgtcgggccggggggaccaggccgtcggacccgtcctacgggtccacgcccgaacggccgtccggtcccccg

SEQ ID NO: 236927 - DNA, 528 bp, Homo sapiens
  misc_feature: GYAE6OF01BLDU7.5.24.C02.1.454.CMB.1.raw
  modified_base (252)..(252): a, c, t, g, unknown or other
  misc_feature (252)..(252): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (400)..(400): a, c, t, g, unknown or other
  misc_feature (400)..(400): n is a, c, g, or t
  modified_base (420)..(420): a, c, t, g, unknown or other
  misc_feature (420)..(420): n is a, c, g, or t
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtntgtctcctggtaccaacaacacccgacaaacgcccccaaactcactctattttgaggtcactacgcgaccctcgacgggtccctgactcgcttctctgctcaagtctggcacncgcctccngaccgtctcgtggctccgaggctgagntgaggctgattatacgtgcngctcatntgcnggacagcagctacgtcccatcgtgacgttcggtacgggccgggggacacgcgtcgacccgtcgacggtcacggacccgaaggtcccgtcgtcccccg

SEQ ID NO: 236928 - DNA, 587 bp, Homo sapiens
  misc_feature: GYAE6OF01A3ICW.5.24.C02.1.454.CMB.1.raw
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaaccacccgacaaacgacccccaaactcatctatttttgaggtcactacgcgaccctcgacgggtccctgatcgcttctctggctccaagtctggcaacgacggcctccctcgaccgtctctcgggcctccgaggctggaggatggacgtctgtatttattactgcagctcattatgcaggacagcgacgcctacgtaccccagtcgtcgtacgttccggttcggggaccgggggtaaccgaaggtccgttacggaccccggttccgttaacgggtccgacggtaccccggaacgggtccgtcccggtaccccccgg

SEQ ID NO: 236929 - DNA, 578 bp, Homo sapiens
  misc_feature: GYAE6OF01B5WDK.5.24.C02.1.454.CMB.1.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (251)..(251): a, c, t, g, unknown or other
  misc_feature (251)..(251): n is a, c, g, or t
tcagatcagacacgcacgaccggtgctcgatttagtacagatcgttagggaaaggggggggtctcaggaggcagcgctctcaggacgtcaccaccatgtcctgggctctgctcctcctcaccctcctcactcagggcacagggtcctgggcccaggctgccctgactcagcctccctccgcgtccgggtctcctggacagtcagtcaccatctcctgcactgcaacngcagtgacgttggngttcgaagtntgtctctgtaccaacaacacccgaacaaacgccccaaactcatctattttgagtcactacgcgacctcgacgggtccctgactcgcttctctcggctccaagtctcggacaacgaccggcctccctgtacccgtctcgtcgggcctccgacggcgtagaggagtcggaggtcgtagtatttatacgtgcagtctactatatgcgacggcacgcacgcctacgtccctagtcgtcgtacgttccggttacgggacgggggtaccgaggtccgtcggtacccgtccgttacggtaccgacggacccgaacggccgtcccggtcccccgg

SEQ ID NO: 236930 - DNA, 537 bp, Homo sapiens
  misc_feature: GYAE6OF01AN42A.5.24.C02.1.454.CMB.1.raw
  modified_base (363)..(363): a, c, t, g, unknown or other
  misc_feature (363)..(363): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaacgcccccaaactcatcatttttgagtcactacgcgaccctgacgggtccctgatcgcttctctgctcaagtctgcaacncgcctccctgacctctctgggcctccgagtctgaggatggaggtctagtatttactactgcagctaccatatgcaggcagcacgcacgtccccagtgtgacttcggtcgggcggggtaccagccgtcgacccgtcgtacggtccacggacccgaacggcccgtccggtcccccg

SEQ ID NO: 236931 - DNA, 602 bp, Homo sapiens
  misc_feature: GYAE6OF01CXXOV.5.24.C02.1.454.CMB.1.raw
  modified_base (434)..(434): a, c, t, g, unknown or other
  misc_feature (434)..(434): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttgggtggttcgaagtatgtctcctggtaccaacaaccacccgaacaaacgcccccaaaactcatctatttttgaggtacactaccgcgaccctcgacgggtcccctgactcgcttctcgtggtctcgaagtctggacaacacggccctccctcgaccgtctcgtggcctcagctgaggatgagctgtattattacngacagctacatatcgcgtacggctaggcacgccaccgtaccccgagttcggtacgtaacttccgggttaccggggccggggggtaaccaagggtccgtacgggtaccccgtaccgttaacgggtacccgaacggaccccgtaaacgggccgtcccggttaccccccgg

SEQ ID NO: 236932 - DNA, 554 bp, Homo sapiens
  misc_feature: GYAE6OF01B91MJ.5.24.C02.1.454.CMB.1.raw
  modified_base (242)..(242): a, c, t, g, unknown or other
  misc_feature (242)..(242): n is a, c, g, or t
  modified_base (253)..(253): a, c, t, g, unknown or other
  misc_feature (253)..(253): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggnggttcgaagtntgtctcctggtaccaacaacaccccgacaaacgcccccaaactcatcattttgaggtcactacgcgaccctcacgggtccctgatcgcttctctggctccaagtctggcaacacggcctccctgacccgtctctcgggctccgaggctgagatgaggctgatttattactgcagctcatatgcaggcagcagccacgtccccagtcgtgtactccggttccgggccgggggtacccaaggccgtcggacccgttcccgtacggtccacggaccccgaacggtccgtccggtacccccccgg

SEQ ID NO: 236933 - DNA, 565 bp, Homo sapiens
  misc_feature: GYAE6OF01CL1XE.5.24.C02.1.454.CMB.1.raw
  modified_base (241)..(241): a, c, t, g, unknown or other
  misc_feature (241)..(241): n is a, c, g, or t
  modified_base (250)..(250): a, c, t, g, unknown or other
  misc_feature (250)..(250): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggngttcaagtntgtctctgtaccaacaacacccgacaaacgccccaaactcatctattttgagtcactacgcgacctcagggtccctgactcgcttctctgctccaagtctggcaacgacgcctccctcgaccgtctctcgggctccgaggctgacggatgaggctagattatactgcagctacgatatcgacgacgcgacgacgacgtacgtacgtcccctatcgttgtacgtccggttcgggaccgggggtaccgaacggtccgtcgacccggttaccgtacggttccgaacggacccgaaacggccgttcccgtaccccccgg

SEQ ID NO: 236934 - DNA, 581 bp, Homo sapiens
  misc_feature: GYAE6OF01DG41Q.5.24.C02.1.454.CMB.1.raw
  modified_base (225)..(225): a, c, t, g, unknown or other
  misc_feature (225)..(225): n is a, c, g, or t
  modified_base (239)..(239): a, c, t, g, unknown or other
  misc_feature (239)..(239): n is a, c, g, or t
  modified_base (249)..(249): a, c, t, g, unknown or other
  misc_feature (249)..(249): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacaggtcctgggcccaggctgccctgactcagcctccctccgcgtccgggtctcctggacagtcagtcacatctctgcactgcaaccngcagtgacgttggngttcgaagtntgtctctggtaccaacaacacccgacaaacgccccaaatcatctattttgagtcactacgcgacctcagggtccctgatcgcttctcgtggctcaagtctggcaacgcggcctccctcgaccgtctcgtgggcctcgaggctggaggatgaggtctgtaatttattactgcagctcatatgcagcagcagccacgtacccctagtcgtcgtacgttccggttaccggggaccggggggtaaccctaagggtcccgtcgggtaaccccggttacccggttacggtacccgtacgggaccccgtaaacgggtcccgtcccggtacccccccggg

SEQ ID NO: 236935 - DNA, 570 bp, Homo sapiens
  misc_feature: GYAE6OF01AKGAK.5.24.C02.1.454.CMB.1.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (367)..(367): a, c, t, g, unknown or other
  misc_feature (367)..(367): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggtggttcgaagtntgtctcctggtaccaacaacacccgacaaacgcccccaaactcatcatttttgagtcactacgcgaccctcgacgggtccctgactcgcttctctggctccaagtctggcaacnccggcctcccgtgacccgttctcctgggcctccgaggtctgaggatggagtctgtatttattactgcagctacatatgcaggcagcacgccacgtccccagtcgtcgtacgttccggttcgggaccgggggtaccaaggtccgtcggtaccccggttccgtacggtccacggacccgaacgggtcccgtcccggtccccccgg

SEQ ID NO: 236936 - DNA, 567 bp, Homo sapiens
  misc_feature: GYAE6OF01BA04J.5.24.C02.1.454.CMB.1.raw
  modified_base (254)..(254): a, c, t, g, unknown or other
  misc_feature (254)..(254): n is a, c, g, or t
  modified_base (367)..(367): a, c, t, g, unknown or other
  misc_feature (367)..(367): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatcctcctgcactgcaaccagcagtgacgttggtggttcgaagtntgtctcctggtaccaacaacacccgacaaacgcccccaaactcatctattttgagtcactacgcgaccctcgacggggtccctgactcgcttctctgctccaagtctgcaacnccggcctcccgtgaccgtctcgtcgggctccgaggctgaggagtgaggtctgtattattactgcagtctcactatgcgagcagcagcctacgtcccagtcgtcgacgttccggtacggggaccggggtaccaggtccgtacggtacccgtaccgtacgggtaccacggacccgtaacggtcccgtcccggtaccccccgg

SEQ ID NO: 236937 - DNA, 605 bp, Homo sapiens
  misc_feature: GYAE6OF01A3ALB.5.24.C02.1.454.CMB.1.raw
  modified_base (251)..(251): a, c, t, g, unknown or other
  misc_feature (251)..(251): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctctcactcagggcacagggtcctgggcccaggctgccctgactcagcctcctccgcgtccgggtctcctggacagtcagtcaccatctcctgcactgcaaccagcagtcgacgttggtggttcaagtntgtctcctggtaccaacaacacccgacaaacgccccaaactcatctattttgaggtcactacgcgaccctcacgggtcctgatcgcttctctggctccaagtctcggacaacgacgtcctccgtcgaccgtctcgtcgggctccgaggtctaggacggactggacggtcctagtacttagttacgtgctagtctacacttagcgtacgaggccagccgacgactaccgtcccagttacgtacggtacgttccggttaccgggccggggggtaacctaggtccggttacggtaccggttcccgttaacgggtccgaaccggtacccgaacggtcccggtcccggttaccccccgg

SEQ ID NO: 236938 - DNA, 736 bp, Homo sapiens
  misc_feature: GYAE6OF01D3BLH.5.24.C02.1.454.CMB.1.raw
  modified_base (232)..(232): a, c, t, g, unknown or other
  misc_feature (232)..(232): n is a, c, g, or t
tcagatcagacacgcacgaccggtgctcgatttagtacagatcgttaggggaaaggggggggtctcaggaggcagcgctcgtcaggacgtcaccaccatggcctggctctgctcctcctcaccctcctcactcagggcacagggtcctgggcccaggctgccctgactcagcctccctccgcgtccgggtctcctggacagtcagtcaccatcctcctgcactgccaaaccngcagttgacgttggtagttcgaagtatgtctcctggtaccaacaaccacccgaacaaacgcccccaaactcacttctattttgagtcactacgcgaccctcgacgggtccctgactcgtcttctctggctaccaagtctcgacaacgaccggcctacccgtacgacccgttctccgtacgggtcctaccgtacggtaccgttcggaacggtagtacgggacggtaccgttaggttaatttaacgtttaaccttacggtaccgtaacgtcctacctaagttaacgttcgaccgtaacgggaccaacggaccgtaacggccgtaaccggttacccccgtaagttcgggttacgttaaccggtttccgggttaacccggggggaccggggggtaaacccgtaaacgggtacccggttaccgggtaaccccggttacccggttaaccgggtacccgaacccgggtaccccggtaaaccgggtcccgtaccccgggttacccccccggg

SEQ ID NO: 236939 - DNA, 542 bp, Homo sapiens
  misc_feature: GYAE6OF01AC5PT.5.24.C02.1.454.CMB.1.raw
  modified_base (253)..(253): a, c, t, g, unknown or other
  misc_feature (253)..(253): n is a, c, g, or t
  modified_base (343)..(343): a, c, t, g, unknown or other
  misc_feature (343)..(343): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtntgtctcctggtaccaacaacaccccgacaaacgccccaaactcatcattttgagtcactacgcgaccctcagggtccctgactcgcttcnctggctcaagtctggcaacacgcctccctcgaccgtctctgggctccagctgagatggagctgtattattactgcagctcatatcgcgacggcagcagcacgtccccagtcgtgacgttccgttcgggaccgggggactaacggcgtcggacccgtccgtacggtcgaccggacccgaacggtccgtccgtccccccgg

SEQ ID NO: 236940 - DNA, 561 bp, Homo sapiens
  misc_feature: GYAE6OF01EVSVH.5.24.C02.1.454.CMB.1.raw
  modified_base (228)..(228): a, c, t, g, unknown or other
  misc_feature (228)..(228): n is a, c, g, or t
  modified_base (254)..(254): a, c, t, g, unknown or other
  misc_feature (254)..(254): n is a, c, g, or t
  modified_base (369)..(369): a, c, t, g, unknown or other
  misc_feature (369)..(369): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggtggttcgaagttntgtctcctggtaccaacaaccacccgaacaaacgcccccaaactcatctattttgagtcactacgccgaccctcgacgggtccctgactcgcttctctggctcagtctggcaacncggcctccctcgaccgtctcgtgggcctccgaggctggaggagtgaggctgtattacttactgcagctcatatgcaggcacgcagccacgtccccagtgtgtacgttccggtacgggccgggggaaccgaaggtccgtcggacccgttaccgtacggtaccgacggacccaacggtccgtcccggtcccccg

SEQ ID NO: 236941 - DNA, 611 bp, Homo sapiens
  misc_feature: GYAE6OF01E11A9.5.24.C02.1.454.CMB.1.raw
  modified_base (260)..(260): a, c, t, g, unknown or other
  misc_feature (260)..(260): n is a, c, g, or t
  modified_base (372)..(372): a, c, t, g, unknown or other
  misc_feature (372)..(372): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatcctcctgccactgaccaaccagcaggtgacgttggtggttacgaagttntgtctcctggtaccaacaaccacccgaacaaacgccccaaactcatctattttgagtcactacgccgaccctcgacgggtccctgatcgcttctctggctcagtctgcaacnccgcctcctcgaccgtctcgtcggcctccgagctgagagtgagtctgtattattacgtgcacgtctacatatgcgtagcacgcacgcacgtccccagtcgtagtacgttccggtaccggggaccgggggtaccctaagggtcccggttccggtaaccccggttacccggttaaccgggtacccggaacccgggtaccccggtaaaccggggtccccgtaccccgggttacccccccggg

SEQ ID NO: 236942 - DNA, 536 bp, Homo sapiens
  misc_feature: GYAE6OF01B2EQL.5.24.C02.1.454.CMB.1.raw
  modified_base (252)..(252): a, c, t, g, unknown or other
  misc_feature (252)..(252): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcaagtntgtctcctggtaccaacaacacccgacaaacgccccaactcatcattttgagtcactacgcgaccctcgacgggtcctgactcgcttctctcggctccaagtctggcaacacgcctccctgaccgtctcgtcggcctccgaggctggaggtatggaggtctagtatttattactcgcagtctacatatgcaggcagcagcacgtcccatgtcgactccgttcgggcggggtacagccgtcgacccgtcgtacggtcgacgacccgaacggccgtcggtcccccg

SEQ ID NO: 236943 - DNA, 618 bp, Homo sapiens
  misc_feature: GYAE6OF01BZB07.5.24.C02.1.454.CMB.1.raw
  modified_base (198)..(198): a, c, t, g, unknown or other
  misc_feature (198)..(198): n is a, c, g, or t
  modified_base (255)..(255): a, c, t, g, unknown or other
  misc_feature (255)..(255): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccggtctcctggacngtcagtcaccatctcctgcactgacaaccagcaggtgacgtttggtggttcgaagtntgtctcctgtaccaacaacacccgacaaacgccccaaactcatctattttgagtcactacgcaccctcgacgggtcctgactcgcttctctgctcagtctggacaacgcggcctcctcgaccgtctcgtcgggcctccgaggtcgtaggacggagtaggacggcttaggtaactttattacgtagctaggtcctagaattacgtcgacgaggtccaacgcgaacgcctaaccgtcccctagtcggtacgtacgtcccggttaccgggggaccgggggtaacctaagggtccgtaccgggtacccgttaccggttacggtaccgtaccggaccccgtaaacggtcccgtcccggtaccccccgg

SEQ ID NO: 236944 - DNA, 577 bp, Homo sapiens
  misc_feature: GYAE6OF01CBTL2.5.24.C02.1.454.CMB.1.raw
  modified_base (233)..(233): a, c, t, g, unknown or other
  misc_feature (233)..(233): n is a, c, g, or t
  modified_base (257)..(257): a, c, t, g, unknown or other
  misc_feature (257)..(257): n is a, c, g, or t
  modified_base (456)..(456): a, c, t, g, unknown or other
  misc_feature (456)..(456): n is a, c, g, or t
tcagatcagacacgcacgaccggtgctcgatttagtacagatcgttaggggaaaggggggggtctcaggaggctagcgctctcaggacgtcaccaccatggcctgggctctgctcctcctcaccctccgtcactcagggcacagggtcctgggcccaggctgccctgactcagcctccctccgcgtccgggtctcctggaccagtcagtcaccatcctcctgcactgcaaccngcagtgacgttggtgttcgaagtntgtctctggtaccaacaacacccgacaaacgccccaaactcatctattttgagtcactacgcgaccctcgacgggtcctgactcgcttctctcggtctacgaagtctacgactaacgaccccggctcccgtcgaccgtctcgtcggctcgaggctggagtatggaggctgtaatttattacgtgtctagtctactatancgacgaggtcagccgacgccacgtcccagtcgtcgtacgttccgtcggggaccggggacctaaggccgtcgacccgttccgtacggtccgacgtaccccgacggtcccgtccgtcccccgg

SEQ ID NO: 236945 - DNA, 589 bp, Homo sapiens
  misc_feature: GYAE6OF01E2W7W.5.24.C02.1.454.CMB.1.raw
  modified_base (228)..(228): a, c, t, g, unknown or other
  misc_feature (228)..(228): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggtggttcgaagttatgtctcctggtaccaacaacacccgacaaacgccccaaactcatctattttgacgtcactacgccgaccctcgacgggtccctgactcgtcttctctggctcgaagtctggacaacgaccggtcctcctcgaccgtctcgtcgggctccgaggctggaggagtgaggtctagtatttattactgcagctctatatgcaggcacgcgacgacgacgtccccagtcgtacgtacgttccggtacggggccgggggtaacctaacggtccgtaccggtacccggttcccgtacgggtacccgacgaccccggaacggtcccgtcccggtaccccccgg

SEQ ID NO: 236946 - DNA, 529 bp, Homo sapiens
  misc_feature: GYAE6OF01BY7KU.5.24.C02.1.454.CMB.1.raw
  modified_base (253)..(253): a, c, t, g, unknown or other
  misc_feature (253)..(253): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtntgtctcctggtaccaacaacaccccgacaaacgcccccaaactcatcattttgagtcactacgcgaccctcagggtccctgatcgcttctctggctcagtctggcaacacggcctccctgaccgtctctggctccaggctgagatgaggcgtgtattattactgcagtctcatagtgcgagcagcacgctacgtcccatgtgtagtccgtcgggacgggggaccaagcgtcgtaccgtccgtacggtcacggacccgaacggccgtcgtcccccgg

SEQ ID NO: 236947 - DNA, 583 bp, Homo sapiens
  misc_feature: GYAE6OF01CIUOP.5.24.C02.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgttggtgttcgaagtntgtctcctggtaccaacaaccacccgacaaacgcccccaaactcatctattttgagtcactacgcgaccctcgacgggtccctgactcgcttctctggctcaagtctggacaacgaccggcctccgtcgaccgtctcgtggcctccgaggctggaggtactgaggctagtatttacttactgtacacgtctactatagtcgacgagcagcacggctacgtccctagtcgtcgtacgttcggttccggggaccgggggtaacctaaggacgttcggacccgttaccgtacggtacctacggacccgaacggtcccgtcccggtaccccccgg

SEQ ID NO: 236948 - DNA, 681 bp, Homo sapiens
  misc_feature: GYAE6OF01BNP24.5.24.C02.1.454.CMB.1.raw
  modified_base (250)..(250): a, c, t, g, unknown or other
  misc_feature (250)..(250): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctcgcgtccggtctcctggacagtcagtcaccatctcctgcactgcaaccagcagtgacgttggtgttcgaagtntgtctctgtaccaacaaccacccgaacaaacgaccccaaatcatctattttgagtcactacgcgacctcgacgggtcctgactcgcttctctcggctcaagtctaggacaacgaccggcctccctcgacccgtctcgtcgggcctcgacggtcgtagacgggtataggacggtctacgtaatttaacttactagtccacgtacttaccaagttatcgacgaagggtaccaaggccgtaaacggcctaaaccggtcccccaagttcggtacggtaacgtttcccgggtttaacccggggggaccggggggtaaaccccgtaaagggtacccgttccggggtaacccccgtttacccggttaaaccgggggtaccctaaacccggggtacccccggtaaaacgggtccccgttaccccgggtaccccccccgg

SEQ ID NO: 236949 - DNA, 673 bp, Homo sapiens
  misc_feature: GYAE6OF01DZDQI.5.24.C02.1.454.CMB.1.raw
  modified_base (211)..(211): a, c, t, g, unknown or other
  misc_feature (211)..(211): n is a, c, g, or t
  modified_base (254)..(254): a, c, t, g, unknown or other
  misc_feature (254)..(254): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctgggcccaggctcgccctgactcacgcctccctcgcgtccggtctccgtggacagtcagtcacntctcctgcactgacaacagcagtgacggttggtggttcaagtntcgtctccgtggtaccaacaaccacccgaacaaaccgccccaaactcatctagttttcgagtcactacgccgtacctcgacgggtcctagactccgtcttctcgttcggcctacgtaagtccgtggaccaaccgaccgggtccctaccgtcggtacccgtcgtccggtcgggcctcgacggtcgtaggacgtagtcggacggtcgttacggtaatttaacgttacgtacgacgtacgtacctacaagtttacgcgtacgaacggtacacggaccaacggtaccgaccgttaccccgtagttcggttacgtacggttccgggttaccgggggaccgggggaaccgtaacggtcgtcccggtaccggttacccgtacggtacccgaccggacccgaccggtcccgtacccggtacccccgg

SEQ ID NO: 236950 - DNA, 598 bp, Homo sapiens
  misc_feature: GYAE6OF01DWIWF.5.24.C02.1.454.CMB.1.raw
  modified_base (253)..(253): a, c, t, g, unknown or other
  misc_feature (253)..(253): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatcctctgcactgcaaccagcagtgacgttggtggttcgaagtntgtctctggtaccaacaacacccgacaaacgccccaaactcatcattttgagtcactacgcgacctcgacgggtccctgactcgcttctctcgctccaagtctcggacaaccacggcctccctcgtacccgtctccgtcgggcctccgaggtcgtagaggatgaggtctgtaattattactgcagtctactatatcgacgaggtacacgcgacgtaccaccgttaccccagttcgtcgtacgttccggttccggggaccggggggaacctaacggtccgtacggtacccggttaccgtaacgggtaccaaccggtaccccgaacggtccgtcccggtccccccgg

SEQ ID NO: 236951 - DNA, 559 bp, Homo sapiens
  misc_feature: GYAE6OF01EMN57.5.24.C02.1.454.CMB.1.raw
  modified_base (253)..(253): a, c, t, g, unknown or other
  misc_feature (253)..(253): n is a, c, g, or t
  modified_base (370)..(370): a, c, t, g, unknown or other
  misc_feature (370)..(370): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctctgcactgcaaccagcagtgacgttggtggttacgaagtntgtctcctggtaccaacaaccacccgacaaacgcccccaaactcactctattttgaggtcactacgccgaccctcgacgggtccctgatcgtcttctctgcctcaagtctggcaacnccggcctccgtcgacctcgtcgtcgggcctccgaggctgaggatgaggtctgtatttattactgcagtctacatatcgacgaggcagcgacgtccacgtccccagtgtgtacgttccggtccggggacggggaccaggcgtcggacccgtccgtacggtccgacgacccgacggccgtcccgtcccccg

SEQ ID NO: 236952 - DNA, 548 bp, Homo sapiens
  misc_feature: GYAE6OF01C1QU3.5.24.C02.1.454.CMB.1.raw
  modified_base (224)..(224): a, c, t, g, unknown or other
  misc_feature (224)..(224): n is a, c, g, or t
  modified_base (238)..(238): a, c, t, g, unknown or other
  misc_feature (238)..(238): n is a, c, g, or t
  modified_base (246)..(246): a, c, t, g, unknown or other
  misc_feature (246)..(246): n is a, c, g, or t
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacaggtcctgggcccaggctgccctgactcagcctccctcgcgtccggtctcctggacagtcagtcaccatctcctgcactgcaaccngcagtgacgttggngttcagtntgtctctggtaccaacaacacccgacaaacgcccccaaactcatctatttttcgaggtcactacgcgacctcgacgggtccctgactcgcttctctggctcaagtctgcaacacgcctccctgaccgtctcgtgggcctccgaggctgaggatggaggtctagtattacttactgcngctcatntgcaggcagcagcacgtcccatgtacgtacgtccgttacggggaccggggtaccaggtccgtcgacccggttaccgtacggtaccacggtaccccgaacggtccgtccggtccccccg

SEQ ID NO: 236953 - DNA, 554 bp, Homo sapiens
  misc_feature: GYAE6OF01C7Y6G.5.24.C02.1.454.CMB.1.raw
  modified_base (230)..(230): a, c, t, g, unknown or other
  misc_feature (230)..(230): n is a, c, g, or t
  modified_base (256)..(256): a, c, t, g, unknown or other
  misc_feature (256)..(256): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtccaccatcctcctgcactgcaaccngcagtgacgtttggtggttcgaagtntgtctcctggtaccaacaaccacccgaacaaacgcccccaaactcatctatttttgagtcactacgccgaccctcgacgggtccctgatcgctttctctcggctccaagttctggcaacgaccggtccctccctcgacccgtctcgtcggctcccgaggtctggaggatggaggctgtatttagttactgccagctctatactgcgacggcagcagcacgtcccatgtgtacgtcgtcgggccggggacaggctcggaccgtcgtacggtacacggcccaacggctcccggtcccccg

SEQ ID NO: 236954 - DNA, 542 bp, Homo sapiens
  misc_feature: GYAE6OF01C1F86.5.24.C02.1.454.CMB.1.raw
  modified_base (228)..(228): a, c, t, g, unknown or other
  misc_feature (228)..(228): n is a, c, g, or t
  modified_base (361)..(361): a, c, t, g, unknown or other
  misc_feature (361)..(361): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccngcagtgacgtttggtggttcgaagtatgtctcctggtaccaacaacaccccgaacaaacgcccccaaactcatcatttttgaggtcactacgcgaccctcaggggtccctgatcgcttctctgctccaagtcnggcaacacggcctccctgaccgtctctcgggctccaggctgagatgagctgtattattactgcagctcatatgcagcagcagcacgtccccagtgtgtacgttccgttcggggccgggggaaccaaggcgtcggacccgttccgtacggtccacggcccaaacggtcctccggtacccccg

SEQ ID NO: 236955 - DNA, 601 bp, Homo sapiens
  misc_feature: GYAE6OF01DCEBN.5.24.C02.1.454.CMB.1.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacngtcagtcacatctcctgcactgcaacngcagtcgacgttggtggttacgaagtatgtctcctggtaccaaacaaccaacccgaacaaacgccccaaaactcaattctatttttgacggtcactacgcgaccctcgacgggtcctgatcgcttctctgtctcaagtctcggctaacgcgcctcctcgaccgtctcgtggcctcgaggctaggaggtagtggaggtctagtatttacgttactcgtacacgtctactatacgtcgacgaggtcaggtacacgtcaaccgtacccagtcgtcgtacgtccggttacggggacgggggtaacctaggttccgaccggtttaccgtacgggttaccaccggtacccgtaagggcccttaccggcccccgttaccggg

SEQ ID NO: 236956 - DNA, 617 bp, Homo sapiens
  misc_feature: GYAE6OF01BC63A.5.24.C02.1.454.CMB.1.raw
  modified_base (255)..(255): a, c, t, g, unknown or other
  misc_feature (255)..(255): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcatagggtcctgggcccaggctgccctgactcagcctccctccgcgtccgggtctcctggacagtcagtcaccatcctcctgcactgacaaccagcagtgacgttggtggttcgaagtntgtctctggtaccaacaaccacccgaacaaacgccccaaactcatctattttgagtcactacgcgacctcgacgggtcctgatcgcttctctggctcaagtctcggacaaacgacgcctcccgtgacccgtctcgtcgggccttccgaggtctaggaggtagtggaggtcgtagtaatttacgttacgtgacgtacgtctactatactacgcaacggcaacgccgagccgtacgtaccccagttcggtacgtagtccggttaccggggaccgggggtaaccaacggtccgttaccgggacccgttaccggtaacgggtcccgaaccggtacccgaaacggtccgtaccccggtaccccccgg

SEQ ID NO: 236957 - DNA, 531 bp, Homo sapiens
  misc_feature: GYAE6OF01CDDUU.5.24.C02.1.454.CMB.1.raw
  modified_base (226)..(226): a, c, t, g, unknown or other
  misc_feature (226)..(226): n is a, c, g, or t
  modified_base (240)..(240): a, c, t, g, unknown or other
  misc_feature (240)..(240): n is a, c, g, or t
  modified_base (467)..(467): a, c, t, g, unknown or other
  misc_feature (467)..(467): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctctgcactgcaacngcagtgacgttggngttcgaagtatgtctctggtaccaacaacacccgacaaacgccccaaactcatcattttgaggtcactacgcgaccctcgacggggtccctgactcgcttctctcggctccaagtctggcaacacggcctccgtcgaccgtctcgtgggcctccgaggtctggaggtatggacggtctagtattattactgctagctcattatgctaggcagcagcacgtcccatgntagtccgttacgggcggggacagcgtcgaccgtctacggtcacggcccaggtcctcgtcccccg

SEQ ID NO: 236958 - DNA, 669 bp, Homo sapiens
  misc_feature: GYAE6OF01CECV6.5.24.C02.1.454.CMB.1.raw
  modified_base (257)..(257): a, c, t, g, unknown or other
  misc_feature (257)..(257): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatcctcctgcactgaccaaccagcaagtgacgttggtggttcgaagtntgtctcctggtaccaacaacacccgacaaacgccccaaactcatcattttgagtcactacgccgaccctcgacgggtcctgactcgtcttctctggctccaagtctggcaaccgacggccctccgtcgaccgtctcgtcgggcctccgaggtcgtggacggtagtggacggtcttagtaatttacttacgtcgactacgtaccttctaacgttaagtcggacgtaacggtacgaacggtccgtaacggacctacccggtacccctaagttcggttacggtaccgttccgggttaccgggggacccgggggtaaacccgtaagggcccgttacgggaccccggttacccgttaacggggtacccgaaccggtacccccggaacgggtccccgttccccggtaccccccccggg

SEQ ID NO: 236959 - DNA, 549 bp, Homo sapiens
  misc_feature: GYAE6OF01CDLD3.5.24.C02.1.454.CMB.1.raw
  modified_base (448)..(448): a, c, t, g, unknown or other
  misc_feature (448)..(448): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaaccacccgacaaacgcccccaaactcatcattttgagtcactacgcgacctcgacgggtccctgactcgcttctctcggctccaagtctcggcaacgacggcctcccgtgacccgtctcgtcgggcctccgacgctggaggatgaggctgatttattctgcagctcatatgcaggcngcagcacgtcccagtcgtgacgttccgttcggggcgggggaccaaggtccgtcggacccgtccgtacggtcgaccggaccgacggtcgtcccgtcccccgg

SEQ ID NO: 236960 - DNA, 652 bp, Homo sapiens
  misc_feature: GYAE6OF01CIFO4.5.24.C02.1.454.CMB.1.raw
  modified_base (253)..(253): a, c, t, g, unknown or other
  misc_feature (253)..(253): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacaggtcctgggcccaggctgccctgactcagcctccctccgcgtccgggtctcctggacagtcagtcaccatcctcctgcactgcaaccagcagtgacgttggtggttcgaagtntgtctcctggtaccaacaacacccgacaaacgcccccaaactcatctattttgagtcactacgccgaccctcgacgggtccctgactcgctttctctcggtctccgaagtcctggaccaaccaccggtccctccccgtgacccgttccttcgtcgggcctcccgacggtcgtggacggtattggacggtcttaggtaactttacgttaacgtgtcacgtctacctatactcgtcgaggctacgcgtacgaccaccgtccccagttcgtcgtacgttccggttaccggggacccggggggtaaccgtaagggtacccggttccggaaccccggttacccggttaacgggtcccgaacccggaccccgtaaacgggtcccggttccccggtacccccccgg

SEQ ID NO: 236961 - DNA, 575 bp, Homo sapiens
  misc_feature: GYAE6OF01CTFPI.5.24.C02.1.454.CMB.1.raw
  modified_base (227)..(227): a, c, t, g, unknown or other
  misc_feature (227)..(227): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctctcactcagggcacagggtcctgggcccaggctgccctgactcagcctccctccgcgtccgggtctcctggacagtcagtcaccatctcctgcactgcaaccngcagtgacgttggtggttcgaagtatgtctcctggtaaccaaacaacaccccgaacaaacgcccccaaactcatcctatttttgagtcactacgccgaccctcgacgggtccctgactcgctttctctggctccaagtctggcaacaccgtcctccctgacccgttctcgtcgggcttccgaggcctaggaggtatgaggtctggtaatttattactgcacgtctctatatgcgaggcagcacgcacgtcccatcgtagtacgttcggttccgggcgggggaacccaaggtcgtcgacccgttccgttacggtaccgaccgacccgaacggtccgtcccggtcccccg

SEQ ID NO: 236962 - DNA, 618 bp, Homo sapiens
  misc_feature: GYAE6OF01A6COZ.5.24.C02.1.454.CMB.1.raw
  modified_base (256)..(256): a, c, t, g, unknown or other
  misc_feature (256)..(256): n is a, c, g, or t
  modified_base (471)..(471): a, c, t, g, unknown or other
  misc_feature (471)..(471): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctgggcccaggctgccctgactcacgccctccctccgcgtccggtctcctggacagtcagtcaccatcctcctgcactgccaaccagcagtgacgttggtgttcgaagtntgtctccgtggtaaccaacaaccacccgaacaaacgccccaaactcatctattttgagtacactaccgcgtaccctgacgggtccctgactcgcttctcgtcggtcctccgaagtcgtcggacaacgtccggccctcccgtcgaccgttctcgtcgggcctccgacggtctggaggacgtaggacggtcttaggtaactttacgttacgtgtacncgtcctactaatagtcgcgtagactacgcgtacgccgtaccgtcccgagtcgtacgtcgttccgttccggggacgggtacgacggtcgtaccgacccggttacgtacggtaccgaccgacccggtaacggtccgtccggtcccccgg

SEQ ID NO: 236963 - DNA, 696 bp, Homo sapiens
  misc_feature: GYAE6OF01CPKE6.5.24.C02.1.454.CMB.1.raw
tcagatcagacacgcacgaccggtgctcgatttagtacagatcgttagggaaagggggggtctcaggaggcagcgctctcaggacgtcaccaccatggcctgggctctgctcctcctcaccctctcactcagggcacagggtcctgggcccaggctgccctagactcacgccctcccgtcgcgtccggtctccgtggacagtcacgtcaccatcctctgcactgaccaacagcagtcgtacgttggtgttacgaatacgtcgtactcgtaggtaaccaacgaaccacccgaactaaaccgaccccaaatcatctattttgacgtcactacgccgaccgtcgacgggtacctcggactccgtcttactcgtcgtactccgaagttcgtaccggtacaaaccggtcccgcccgttaccgtcggacccgtttcgtcgtccggccgttaccgtacggcgtaggtacggtacgtacggtacggtactaggtacttacgttacgtcgtacgtactcttacgtaacgttacgttcggaacgttacgacgtacgtaccgtacgtaccgtaccgtcccgtaaggttccgtacgttaccgttaccgggtaccgggtaccgggtaacctacggtcggttaccggttacccggtacgttaccggtaccggtaaccgaccggttaaccgtccgtccccggttaccccgg

SEQ ID NO: 236964 - DNA, 593 bp, Homo sapiens
  misc_feature: GYAE6OF01D26E0.5.24.C02.1.454.CMB.1.raw
  modified_base (201)..(201): a, c, t, g, unknown or other
  misc_feature (201)..(201): n is a, c, g, or t
  modified_base (256)..(256): a, c, t, g, unknown or other
  misc_feature (256)..(256): n is a, c, g, or t
  modified_base (365)..(365): a, c, t, g, unknown or other
  misc_feature (365)..(365): n is a, c, g, or t
tcagatcagacacgcacgaccggtgctcgatttagtacagatcgttagggaaaggggggggtctcaggaggcagcgctccctcaggacgtcaccaccatggcctgggctctgctcctcctcaccctcctcactcagggcacagggtcctgggcccaggctgccctgactcagcctccctccgcgtccgggtctcctggacngtcagtcaccatctcctgcactgacaaccagcagtgacgttggtggttcgaagtntgtctcctggtaaccaacaaccaccccgaacaaacgccccaaactcatctattttgagtcactacgcacctcgacgggtcctgactcgcttctctgctcagtctgcacncgcctcctgaccgtctcgtcggcctccgaggtctaggagagtgacggctagtattattactgcagtctactatatcgacgacggacagcgacgaccgtacgtccctagtcgtacgtacgttccggttacggggaccgggggtaacctaaggtaccgtaccggtacccgttaccggtacggtaccgtaccggaaccccggtaaccggtcccgttcccggtaccccccgg

SEQ ID NO: 236965 - DNA, 577 bp, Homo sapiens
  misc_feature: GYAE6OF01ASELC.5.24.C02.1.454.CMB.1.raw
  modified_base (251)..(251): a, c, t, g, unknown or other
  misc_feature (251)..(251): n is a, c, g, or t
  modified_base (360)..(360): a, c, t, g, unknown or other
  misc_feature (360)..(360): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctcgcgtccgggtctcctggacagtcagtcaccatctcctgcactgcaaccagcagtgacgttggtgttcgaagtntgtctctggtaccaacaaccacccgaacaaacgccccaaactcatctattttgacgtcactacgcgaccctcgacgggtccctgactcgtcttctctcggctacagtcnggacaacgaccggcctcctcgaccgttctcgtcggcctcgagctagacggtatggacgtcgtagtattacgttacgtcgacgtacgtctctatatcgcgaggcacgcgtacgacacgtcccagtcgtagtacgtcggtaccggggcggggaaccgtacgtacgtcggtacccgttccgtacgtccgacgtacccgaacggtccgtcccggtcccccg

SEQ ID NO: 236966 - DNA, 572 bp, Homo sapiens
  misc_feature: GYAE6OF01BWDIU.5.24.C02.1.454.CMB.1.raw
  modified_base (254)..(254): a, c, t, g, unknown or other
  misc_feature (254)..(254): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttacgaagtntgtctcctggtaccaacaaccacccgacaaacgccccaaactcatctattttgagtcactacgcgacctcgacgggtcctgactcgcttctctggctccgaagtctgcaacgaccggcctcccgtcgacccgttctccgtcgggcctccgaggcgtagaggatcggagtcgtagtactttacgttacgtgacgacgtctactatatgcacggacagcacgcctacgtcccatcgtgtacgtccggttcgggacggggaccaggccgtcggtacccgtccgtacggtccacggacccgacggtccgtcccggtcccccg

SEQ ID NO: 236967 - DNA, 536 bp, Homo sapiens
  misc_feature: GYAE6OF01CNJIT.5.24.C02.1.454.CMB.1.raw
  modified_base (222)..(222): a, c, t, g, unknown or other
  misc_feature (222)..(222): n is a, c, g, or t
  modified_base (247)..(247): a, c, t, g, unknown or other
  misc_feature (247)..(247): n is a, c, g, or t
  modified_base (421)..(421): a, c, t, g, unknown or other
  misc_feature (421)..(421): n is a, c, g, or t
tcagatcagacacgcacgaccggtgctcgatttagtacagatcgttagggaaaggggggtctcaggaggcagcgctctcaggacgtcaccaccatggcctgggctctgctcctcctcaccctctcactcaggcacaggtcctgggcccaggctgccctgactcagcctccctccgcgtccggtctcctggacagtcagtcaccatctcctgcactgcaaacngcagtgacgttggtgttcgaaagtntgtctctgtaccaacaacacccgacaaacgccccaaactcatcattttgagtcactacgcgacctcacgggtccctgactcgcttctctgctccaagtctggcaacacggcctcccgtcgaccgtctcgtcggctccgagctgagagtgagctgtattatactgcagctcatangtcgagcagcagcacgtcccatcgtacgtacgtccgttcgggaccggggaacctaaggctacggtacccgttccgtacggttccacgtacccgaacggccgtccggtccccccgg

SEQ ID NO: 236968 - DNA, 654 bp, Homo sapiens
  misc_feature: GYAE6OF01C7DV1.5.24.C02.1.454.CMB.1.raw
  modified_base (211)..(211): a, c, t, g, unknown or other
  misc_feature (211)..(211): n is a, c, g, or t
  modified_base (228)..(228): a, c, t, g, unknown or other
  misc_feature (228)..(228): n is a, c, g, or t
  modified_base (255)..(255): a, c, t, g, unknown or other
  misc_feature (255)..(255): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctgggcccaggctgccctgactcagccctccctccgcgtccgggtctcctggacagtcagtcacntctcctgcactgcaacngcagtgtacgttggtgttacgaagttntgtctctggtaccaacaacacccgaacaaacgccccaaactcatctattttgagtcactacgcgacctcgacgggtcctgactcgtcttctcgtcgcctacgaagtctacggaccaacgtccggtcctcccgtacgtacccgtctcgtcggccttccgaggtcgtaggaggtataggaggtcttagtactttattacgtgtctagtctactattagtcgacgacggacacgacgtacgaccgtacgtacccctagttaccggttcggtaccgttaccgggttaccggggacccgggggtaacccgtaacgggtcccggttaccggtaaccccggttaccggttaaccggtaccggtaacccggaccccggtaacggtcccgttaccccggtccccccgg

SEQ ID NO: 236969 - DNA, 533 bp, Homo sapiens
  misc_feature: GYAE6OF01D9775.5.24.C02.1.454.CMB.1.raw
  modified_base (362)..(362): a, c, t, g, unknown or other
  misc_feature (362)..(362): n is a, c, g, or t
tcagatcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaacgcccccaaactcatcattttgagtcactacgcgaccctcagggtccctgatcgcttctctgctccaagtctggcaacncggtcctccctgaccgtctcgtcgggctccgaggctgagatgaggctgtattattactgcagctcatactgcaggcagcacgcacgtccccatgtgactcgttcgggccgggggtaccaaggccgtcgacccgtcgtacggtccacgacccgaacggccgtccgtcccccg

SEQ ID NO: 236970 - DNA, 604 bp, Homo sapiens
  misc_feature: GYAE6OF01EFWVO.5.24.C02.1.454.CMB.1.raw
  modified_base (227)..(227): a, c, t, g, unknown or other
  misc_feature (227)..(227): n is a, c, g, or t
  modified_base (253)..(253): a, c, t, g, unknown or other
  misc_feature (253)..(253): n is a, c, g, or t
  modified_base (375)..(375): a, c, t, g, unknown or other
  misc_feature (375)..(375): n is a, c, g, or t
  modified_base (458)..(458): a, c, t, g, unknown or other
  misc_feature (458)..(458): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccggtctcctggacagtcagtcaccatctcctgcactgcaaccngcagtgacgttggtggttacgaagtntgtctccgtaggtacccaacaaccaaccccgacaaaaccgacccccaaactcatctagttttgacgtcactaccgccgaccctcgacgggtccctgatcgtcttctctgctcagtctgcacncgcctcctcgaccgtctcgtcggctccgagtctagagtgtggaggtctagtattacgttacgtgcctagtctacgtattacgngacgacggacacgtcgacgacctacgttcccagttcggacgtacgttccggtaccgggggaccggggtacctaacggccggttacggacccggttccgtaacgggtccgaacggaccccgtaacggtcccgtccccggttcccccg

SEQ ID NO: 236971 - DNA, 711 bp, Homo sapiens
  misc_feature: GYAE6OF01BQABN.5.24.C02.1.454.CMB.1.raw
  modified_base (211)..(211): a, c, t, g, unknown or other
  misc_feature (211)..(211): n is a, c, g, or t
  modified_base (225)..(225): a, c, t, g, unknown or other
  misc_feature (225)..(225): n is a, c, g, or t
  modified_base (239)..(239): a, c, t, g, unknown or other
  misc_feature (239)..(239): n is a, c, g, or t
  modified_base (249)..(249): a, c, t, g, unknown or other
  misc_feature (249)..(249): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacgagggtcctgggcccaggctgccctgactcagcctccctcgcgtccggtctcgtggacagtcagtcacatcnctgcactgcaaccngcagtgacgttggngtacgaagtntgtctctaggtaccaacacacccgaacaacgccccaatcatctatttgagtacactacgcgacctcgacgggtcctgactcgtcttcgtcgtcggcctacgtaacgtcgtacggaccaaccgtccggtcccttcccgtacgtacccggttcgtaccggtccggggtaccctaccggtacgggtccgtagggtaacgggtacgtacgggtaacggtcgttaacggttaaacttttacgttaaccgtacgtaccgtacgtaccgttactaattacggtaccggacgaacgggacctacggaccgtaacgccgttaacccggtaccccgtaggttaccggttacggtaccggttccggggttaccgggggaccgggggtaacctacgggtcccggttaccggtacccggttccggtaccggtaccgaaccggtacccggaacggtccccgtcccggtacccccgg

SEQ ID NO: 236972 - DNA, 578 bp, Homo sapiens
  misc_feature: GYAE6OF01B6Y1K.5.24.C02.1.454.CMB.1.raw
  modified_base (226)..(226): a, c, t, g, unknown or other
  misc_feature (226)..(226): n is a, c, g, or t
  modified_base (240)..(240): a, c, t, g, unknown or other
  misc_feature (240)..(240): n is a, c, g, or t
  modified_base (249)..(249): a, c, t, g, unknown or other
  misc_feature (249)..(249): n is a, c, g, or t
  modified_base (432)..(432): a, c, t, g, unknown or other
  misc_feature (432)..(432): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcacgcctccctcgcgtccggtctctggacagtcagtcacatctcctgcactgacaaccngcagtgacgttggngttcaagtntgtctcctgtaccaacaaccacccgacaaacgaccccaactcatctattttgagtcactacgccgacctcgacgggtccctgacttcgcttctcgtcgctacagtctgcaacgcgcctccgtcgtaccgtcgtcgtcggcctccgaggctagaggtagtggacgtctagtacttacgttacgngtcgacgtactactatatgacgacgcacgacgtacgacctacgtacccgagttcgtacgtacgttccggtaccggggaccgggggactaacggcgtccggtaccgttaccggtaggtaccacgacccgacgccgtcccggtccccg

SEQ ID NO: 236973 - DNA, 628 bp, Homo sapiens
  misc_feature: GYAE6OF01BJTLU.5.24.C02.1.454.CMB.1.raw
  modified_base (255)..(255): a, c, t, g, unknown or other
  misc_feature (255)..(255): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatcctcctgcactgacaaccagcagtgacgttggtggttcgaagtntgtctcctggtaccaacaccaccccgacaaacgaccccaactcatctattttgagtcactacgccgaccctcgacgggtcctgactcgcttctctcgctcaagtctcgacaacgaccgcctccctcgaccgtcgtccgtcgggcctccgacggtccgtagacgggagttcggaggcgttagtaatttaacttacgtgtcgacgtctacaattatcgacgaacggcgacgacgtacgctaccgtcccgtagtcgttacgtacgttccggttaccggggtaccggggggaaccctaagggtccgtaccggtacccggttacccggtaacggtcccgaaccggaacccggtacggcccgtccggtacccccccggg

SEQ ID NO: 236974 - DNA, 542 bp, Homo sapiens
  misc_feature: GYAE6OF01DTA4Y.5.24.C02.1.454.CMB.1.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (252)..(252): a, c, t, g, unknown or other
  misc_feature (252)..(252): n is a, c, g, or t
  modified_base (379)..(379): a, c, t, g, unknown or other
  misc_feature (379)..(379): n is a, c, g, or t
  modified_base (405)..(405): a, c, t, g, unknown or other
  misc_feature (405)..(405): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctcgcgtccgggtctcctggacagtcagtcaccatcctcctgcactgcaaccngcagtgacgttggngttcgaagtntgtctcctggtaccaacaaccacccgaacaaacgcccccaaatcatctattttgaggtcactacgcgaccctcgacgggtccctgactcgtcttctctggctccaagtctgacaacacggcctcccngaccgtctcgtggctccgagctgagntgagctagtattatactgcagctctatatgcgacgcagcagcacgtcccatgtcgtacgtcgtcggggacggggaaccaaggcgtcggacccgttcgtacggtacaacggacccgaacggcccgtccggtacccccg

SEQ ID NO: 236975 - DNA, 562 bp, Homo sapiens
  misc_feature: GYAE6OF01CFW5H.5.24.C02.1.454.CMB.1.raw
  modified_base (323)..(323): a, c, t, g, unknown or other
  misc_feature (323)..(323): n is a, c, g, or t
  modified_base (364)..(364): a, c, t, g, unknown or other
  misc_feature (364)..(364): n is a, c, g, or t
  modified_base (433)..(433): a, c, t, g, unknown or other
  misc_feature (433)..(433): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtgttcgaagtatgtctcctggtaccaacaacaccccgacaaacgcccccaaactcatctattttgagtcactacgcaccctnacgggtccctgatcgcttctctggctacagtctggacaacnccggcctccctcgaccgtctcgtcggctccgaggtctcggagagtggacggctgtaattattactgacngtctcgtatatgcgaggacagaccagcacgtccccattcgtcgtacgtccggttacgggacgggggtaccacggacgtcggaccgtaccgtacgtaccgacgacccgtaacggccgtcccgtcccccgg

SEQ ID NO: 236976 - DNA, 623 bp, Homo sapiens
  misc_feature: GYAE6OF01BIHU7.5.24.C02.1.454.CMB.1.raw
  modified_base (253)..(253): a, c, t, g, unknown or other
  misc_feature (253)..(253): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgccaaccagcagtgacgttggtgttacaagtntgtctcctgtaccaacaaccacccgaacaaccgacccccaactcactctattttgagtcactacgccaccctcgacgggtccctgactcgtcttctcgtgcctccaagtcgtcggacaaccgaccggtccctcccgtcgtacccgtcgtcgtcgggcctccggacggtcgtaggaggtagtcggaggtcttagtaactttacgttacgtcgacgtacgtctactattacgtgacgacggaccagccgacgccgtaccgtaccctagtcgtcgtacgttccgggttaccggggacggggaacctacggtccgtaccggtacccgtaccgtacggtccgaccggacccgaacggtcccgtcccggtcccccg

SEQ ID NO: 236977 - DNA, 669 bp, Homo sapiens
  misc_feature: GYAE6OF01EAJVB.5.24.C02.1.454.CMB.1.raw
  modified_base (262)..(262): a, c, t, g, unknown or other
  misc_feature (262)..(262): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcgagggcacagggtcctgggcccaggctgccctgactcagcctccctccgcgtccggtctccgtggacagtcagtcaccatctcctgcactgacaaccagcaggtcgtacggttgggtggttacgaagttntcgtcctccgtacggtaaccaacaaccacccgaacaaaccgacccccaaactcacttctattttcggacgtcaccgtaccgccgtaccctcggacgggtcctagtactcgtcttctcgtcgtctacagtcacgacaacgccggtccctccgtacgtacccgttcgtcgtcggtcctaccgacggtcgtacggaggtacgtaggtacggtacgttagtaactttacgttacgtacgtacgtacgtacctactattacgtcgacgacggacgacgaccgacgtaccgtacgtacccgtagttcgtacgtacgttccgggtacggggaccggggtaaccgtacggtaccgtacggacccgttacggtacggtaccgaccggacccgtacggtcccgtccccgtaccccgg

SEQ ID NO: 236978 - DNA, 542 bp, Homo sapiens
  misc_feature: GYAE6OF01CD7VM.5.24.C02.1.454.CMB.1.raw
  modified_base (252)..(252): a, c, t, g, unknown or other
  misc_feature (252)..(252): n is a, c, g, or t
tcagatcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatcctcctgcactgcaaccagcagtgacgttggtgttcgaatntgtctcctggtaccaacaacacccgacaaacgcccccaaactcatcatttttgaggtcactacgcgaccctcacggggtccctgactcgcttctctggctccaagtctgcaacacgcctcctcgaccgtctcgtgggcctccaggctggacggatggacggctgtaacttattactgctagtctcatatgctaggcagcgacgcacgtccccatgtcgtatcggttccgggccgggggacaggccgtggacccgtcgtacggtcacgacccgaacggccgtcgtcccccg
